United States Patent 7,625,699 (GENETIC POLYMORPHISMS ASSOCIATED WITH CORONARY STENOSIS, METHODS OF DETECTION AND USES THEREOF) - sequence listing, part 2

SEQ ID NO: 1094 - protein, 669 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 1095 - protein, 668 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 1096 - protein, 668 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 1097 - protein, 667 aa, Homo sapiens
MHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 1098 - protein, 133 aa, Homo sapiens
MMLNSDTMELDLPPTHSETESGFSDCGGGAGPDGAGPGGPGGGQARGPEPGEPGRKDLQHLSREERRRRRRATAKYRTAHATRERIRVEAFNLAFAELRKLLPTLPPDKKLSKIEILRLAICYISYLNHVLDV

SEQ ID NO: 1099 - protein, 732 aa, Homo sapiens [sequence omitted]

SEQ ID NO: 1100 - protein, 619 aa, Homo sapiens [sequence omitted]

SEQ ID NO: 1101 - protein, 1375 aa, Homo sapiens [sequence omitted]

SEQ ID NO: 1102 - protein, 255 aa, Homo sapiens [sequence omitted]

SEQ ID NO: 1103 - protein, 263 aa, Homo sapiens [sequence omitted]

SEQ ID NO: 1104 - protein, 149 aa, Homo sapiens [sequence omitted]

SEQ ID NO: 1105 - protein, 149 aa, Homo sapiens [sequence omitted]

SEQ ID NO: 1106 - protein, 2480 aa, Homo sapiens [sequence omitted]

SEQ ID NO: 1107 - protein, 3116 aa, Homo sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLRPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 1108 - protein, 2107 aa, Homo sapiens [sequence omitted]

SEQ ID NO: 1109 - protein, 1363 aa, Homo sapiens [sequence omitted]

SEQ ID NO: 1110 - protein, 1408 aa, Homo sapiens
MGTLQRKLLIPAGCRVYRARDENTGPRFPVHEAGSAPDPSDASTVRLLTCLAFCSFSLVVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 1111 - protein, 1409 aa, Homo sapiens
MGTLQRKLLIPAGCRVYRARDENTGPRFPVHEAGSAPDPSDASTVRLLTCLAFCSFSLVVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 1112 - protein, 1364 aa, Homo sapiens [sequence omitted]

SEQ ID NO: 1113 - protein, 1397 aa, Homo sapiens
MGTLQRKLLIPAGCRVYRARDENTGPRFPVHEAGSAPDPSDASTVRLLTCLAFCSFSLVVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 1114 - protein, 343 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 1115 - protein, 343 aa, Homo sapiens; identical to SEQ ID NO: 1114

SEQ ID NO: 1116 - protein, 343 aa, Homo sapiens; identical to SEQ ID NO: 1114

SEQ ID NO: 1117 - protein, 343 aa, Homo sapiens; identical to SEQ ID NO: 1114

SEQ ID NO: 1118 - protein, 405 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 1119 - protein, 1197 aa, Homo sapiens
MPQDAVQQWGLCILGAAADHPGSPRDPQAGRMNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAQEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGRCSGGNAW

SEQ ID NO: 1120 - protein, 1396 aa, Homo sapiens
MPQDAVQQWGLCILGAAADHPGSPRDPQAGRMNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTLSISQLAASPRSPTQHCLARPTSQLPHGSQASPAQAQEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVWWGCAWDS

SEQ ID NO: 1121 - protein, 254 aa, Homo sapiens
MFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGDAVLNEAAQILRLLHIEELRELQTKINEAIVAVQAIITLLACLEIKMSHSRGRKPRKLGMF

SEQ ID NO: 1122 - protein, 1141 aa, Homo sapiens
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 1123 - protein, 557 aa, Homo sapiens
MIVVFGLEYIVRVWSAGCCCRYRGWQGRFRFARKPFCVIDFIVFVASVAVIAAGTQGNIFATSALRSMRFLQILRMVRMDRRGGTWKLLGSVVYAHSKELITAWYIGFLVLIFASFLVYLAEKDANSDFSSYADSLWWGTITLTTIGYGDKTPHTWLGRVLAAGFALLGISFFALPAGILGSGFALKVQEQHRQKHFEKRRMPAANLIQAAWRLYSTDMSRAYLTATWYYYDSILPSFRELALLFEHVQRARNGGLRPLEVRRAPVPDGAPSRYPPVATCHRPGSTSFCPGESSRMGIKDRIRMGSSQRRTGPSKQHLAPPTMPTSPSSEQVGEATSPTKVQKSWSFNDRTRFRASLRLKPRTSAEDAPSEEVAEEKSYQCELTVDDIMPAVKTVIRSIRILKFLVAKRKFKETLRPYDVKDVIEQYSAGHLDMLGRIKSLQTRVDQIVGRGPGDRKAREKGDKGPSDAEVVDEISMMGRVVKVEKQVQSIEHKLDLLLGFYSRCLRSGTSASLGAVQVPLFDPDITSDYHSPVDHEDISVSAQTLSISRSVSTNMD

SEQ ID NO: 1124 - protein, 105 aa, Homo sapiens
MPGRTEGSSSGRPAASGPPSALPTPSRPYVAHLAGAQPREWERALGPWALTQLPAMQESHPSTHSETAVERARRMGLPYDQGDMGRSPPSFHDRGSAINSVLGYA

SEQ ID NO: 1125 - protein, 407 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 1126 - protein, 348 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 1127 - protein, 580 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAEPPPPKIPKIETTHPPLPPAHPPPDRKPPLAAALGEAEPPGPVDATDLPKVQIPPPAHPAPVHQPPPLPHRPPPPPPSSYMTGMSTTSSYMSGEGYQSLQSMMKTEGPSYGALPPAYGPPAHLPYHPHVYPPNPPPPPVPPPPASFPPPAIPPPTPGYPPPPPTYNPNFPPPPPRLPPTHAVPPHPPPGLGLPPASYPPPAVPPGGQPPVPPPIPPPGMPPVGGLGRAAWMR

SEQ ID NO: 1128 - protein, 557 aa, Homo sapiens [sequence omitted]

SEQ ID NO: 1129 - protein, 355 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDSPLILLQGWACRQPATHLLPSPLEDSLLCPRPFPHPACLQLGGWGGQPG

SEQ ID NO: 1130 - protein, 580 aa, Homo sapiens; identical to SEQ ID NO: 1127

SEQ ID NO: 1131 - protein, 1279 aa, Homo sapiens [sequence omitted]

SEQ ID NO: 1132 - protein, 2244 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1133 - protein, 2205 aa, Homo sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1134 - protein, 2210 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1135 - protein, 2411 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1136 - protein, 3177 aa, Homo sapiens [sequence omitted]

SEQ ID NO: 1137 - protein, 2971 aa, Homo sapiens [sequence omitted]

SEQ ID NO: 1138 - protein, 2977 aa, Homo sapiens [sequence omitted]

SEQ ID NO: 1139 - protein, 2211 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1140 - protein, 573 aa, Homo sapiens
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 1141 - protein, 1178 aa, Homo sapiens [sequence omitted]

SEQ ID NO: 1142 - protein, 858 aa, Homo sapiens [sequence omitted]

SEQ ID NO: 1143 - protein, 137 aa, Homo sapiens [sequence omitted]

SEQ ID NO: 1144 - protein, 858 aa, Homo sapiens [sequence omitted]

SEQ ID NO: 1145 - protein, 773 aa, Homo sapiens [sequence omitted]

SEQ ID NO: 1146 - protein, 633 aa, Homo sapiens
MESGPKMLAPVCLVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQLHYVTELTELIKAKSSPRPDGVEDSTEFVSFFPDFLWTVRDFTLELKLNGHPITEDEYLENALKLIQGNNPRVQTSNFPRECIRRFFPKRKCFVFDRPTNDKDLLANIEKVSEKQLDPKFQEQTNIFCSYIFTHARIKTLREGITVTGNRLGTLAVTYVEAINSGAVPCLENAVITLAQRENSAAVQRASDYYSQQMAQRVKFPTDTLQELLDVHAACEREAIAIFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQVKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 1147 - protein, 580 aa, Homo sapiens
MSDFEEWISGTYRKMEEGPLPLLTFATAPYHDQKPGTSGLRKKTYYFEEKPCYLENFIQSIFFSIDLKDRQGSSLVVGGDGRYFNKSAIETIVQMAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 1148 - protein, 562 aa, Homo sapiens
MVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 1149 - protein, 651 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 1150 - protein, 642 aa, Homo sapiens
MVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 1151 - protein, 196 aa, Homo sapiens
MAAEHLLPGPPPSLADFRLEAGGKGTERGSGSSKPTGSSRGPRMAKFLSQDQINEYKECFSLYDKQQRGKIKATDLMVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 1152 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 1153 - protein, 387 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIR

SEQ ID NO: 1154 - protein, 488 aa, Homo sapiens; identical to SEQ ID NO: 1152

SEQ ID NO: 1155 - protein, 421 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLATLLQAHASTGQQQVDGQDRGVPGLGLLPRVPGERPSANVPPLGVHGHDGSDPTGLVRGPLFPGQLWQRSCVAVAHHRTANSRPHVRPRLLRAQL

SEQ ID NO: 1156 - protein, 464 aa, Homo sapiens
MASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 1157 - protein, 452 aa, Homo sapiens
MEVTTRLTWNDENHLRKLLGNVSLSLLYKSSVHGGSIEDMVERCSRQGCTITMAYIDYNMIVAFMLGNYINLHESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 1158 - protein, 218 aa, Homo sapiens
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 1159 - protein, 452 aa, Homo sapiens
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 1160 - protein, 452 aa, Homo sapiens; identical to SEQ ID NO: 1159

SEQ ID NO: 1161 - protein, 452 aa, Homo sapiens; identical to SEQ ID NO: 1159

SEQ ID NO: 1162 - protein, 452 aa, Homo sapiens; identical to SEQ ID NO: 1159

SEQ ID NO: 1163 - protein, 335 aa, Homo sapiens
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 1164 - protein, 835 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRQGTGVAAEPGRLRRHVPLCPGHPHAPQGAMPRVVAKALPRCAAHAHPLLGGICAKVQLAATQCTSRPGQPCQACLPGLCAWPRVQPPA

SEQ ID NO: 1165 - protein, 779 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 1166 - protein, 777 aa, Homo sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKVLGSLQNLAAFADTFHCARGTPMHPKERCRVW

SEQ ID NO: 1167 - protein, 779 aa, Homo sapiens; identical to SEQ ID NO: 1165

SEQ ID NO: 1168 - protein, 198 aa, Homo sapiens
MSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 1169 - protein, 293 aa, Homo sapiens
MDAPHSKAALDSINELPENILLELFTHVPARQLLLNCRLVCSLWRDLIDLMTLWKRKCLREGFITKDWDQPVADWKIFYFLRSLHRNLLRNPCAEEDMFAWQIDFNGGDRWKVESLPGAHGTDFPDPKVKKYFVTSYEMCLKSQLVDLVAEGYWEELLDTFRPDIVVKDWFAARADCGCTYQLKVQLASADYFVLASFEPPPVTIQQWNNATWTEVSYTFSDYPRGVRYILFQHGGRDTQYWAGWYGPRVTNSSIVVSPKMTRNQASSEAQPGQKHGQEEAAQSPYRAVVQIF

SEQ ID NO: 1170 - protein, 233 aa, Homo sapiens
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 1171 - protein, 614 aa, Homo sapiens
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGECTNQKWSVASRPGSQEGCYSGCSLSYTNSHVEKDDLP

SEQ ID NO: 1172 - protein, 614 aa, Homo sapiens; identical to SEQ ID NO: 1171

SEQ ID NO: 1173 - protein, 664 aa, Homo sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 1174 - protein, 366 aa, Homo sapiens
MAARTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 1175 - protein, 303 aa, Homo sapiens [sequence omitted]

SEQ ID NO: 1176 - protein, 303 aa, Homo sapiens [sequence omitted]

SEQ ID NO: 1177 - protein, 785 aa, Homo sapiens [sequence omitted]

SEQ ID NO: 1178 - protein, 103 aa, Homo sapiens [sequence omitted]

SEQ ID NO: 1179 - protein, 103 aa, Homo sapiens [sequence omitted]

SEQ ID NO: 1180 - protein, 89 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 1181 - protein, 103 aa, Homo sapiens [sequence omitted]

SEQ ID NO: 1182 - protein, 1041 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 1183 - protein, 981 aa, Homo sapiens
MSEDPRGPKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 1184 - protein, 224 aa, Homo sapiens
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMTI

SEQ ID NO: 1185 - protein, 560 aa, Homo sapiens
MESQPAQECLMQMFLPIEPACFVEWLGTSPSQLGVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 1186 - protein, 381 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 1187 - protein, 381 aa, Homo sapiens; identical to SEQ ID NO: 1186

SEQ ID NO: 1188 - protein, 235 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 1189 - protein, 237 aa, Homo sapiens
HRRIHTGEKCYKYIECGKAFSDYSGLIAHLLIHSGKKPYKCHERGKVFRHSLSLSNHQRIHTGERPYKCYECGKVFNQIAHLARHWRTHTGEKPYKSNECGKIFSHNSHFTEHWIIHMEEKPYRCNECGKVYSSYSYLAQCWRIHTGEKLYKCNKCAKEFGGHSSLTTHLLIHTGKKPYTCKECDKDFRNKFSLTIHQRIHTGERHKCNECGRAFNQISHLAKHQIVHTGEKSYKCN

SEQ ID NO: 1190 - protein, 155 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 1191 - protein, 155 aa, Homo sapiens; identical to SEQ ID NO: 1190

SEQ ID NO: 1192 - protein, 248 aa, Homo sapiens
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 1193 - protein, 248 aa, Homo sapiens; identical to SEQ ID NO: 1192

SEQ ID NO: 1194 - protein, 400 aa, Homo sapiens
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 1195 - protein, 201 aa, Homo sapiens [sequence omitted]

SEQ ID NO: 1196 - protein, 422 aa, Homo sapiens
MAGCVPLLQGLVLVLALHRVEPSATSLKERHGLHSDSACTGVQESLFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 1197 - protein, 399 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGKQRLGLTASATQPSWFLPRILSGLRVFRGANAFEMILGPLSHCQNILPWK

SEQ ID NO: 1198 - protein, 557 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 1199 - protein, 873 aa, Homo sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 1200 - protein, 873 aa, Homo sapiens; identical to SEQ ID NO: 1199

SEQ ID NO: 1201 - protein, 845 aa, Homo sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQRINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 1202 - protein, 845 aa, Homo sapiens; identical to SEQ ID NO: 1201

SEQ ID NO: 1203 - protein, 378 aa, Homo sapiens
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 1204 - protein, 378 aa, Homo sapiens; identical to SEQ ID NO: 1203

SEQ ID NO: 1205 - protein, 314 aa, Homo sapiens
MVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 1206 - protein, 248 aa, Homo sapiens
MVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGGPQALWSLLACLRFLHLQCPFHFVLCP

SEQ ID NO: 1207 - protein, 477 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 1208 - protein, 477 aa, Homo sapiens; identical to SEQ ID NO: 1207

SEQ ID NO: 1209 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIVGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPDEAEAPESFPAAASPGDSATGHRRPPLGSRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 1210 - protein, 75 aa, Homo sapiens [sequence omitted]

SEQ ID NO: 1211 - protein, 271 aa, Homo sapiens
MISAHCNLHLPGSSDSPASASQVAGITGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 1212 - protein, 222 aa, Homo sapiens
MHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 1213 - protein, 261 aa, Homo sapiens [sequence omitted]

SEQ ID NO: 1214 - protein, 494 aa, Homo sapiens
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 1215 - protein, 494 aa, Homo sapiens; identical to SEQ ID NO: 1214

SEQ ID NO: 1216 - protein, 494 aa, Homo sapiens; identical to SEQ ID NO: 1214

SEQ ID NO: 1217 - protein, 445 aa, Homo sapiens [sequence omitted]

SEQ ID NO: 1218 - protein, 176 aa, Homo sapiens [sequence omitted]

SEQ ID NO: 1219 - protein, 179 aa, Homo sapiens [sequence omitted]

SEQ ID NO: 1220 - protein, 1535 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKVVLSASQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1221 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1222 - protein, 1532 aa, Homo sapiens; identical to SEQ ID NO: 1221

SEQ ID NO: 1223 - protein, 1516 aa, Homo sapiens
MAPILSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1224 - protein, 1518 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKVVLSASQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1225 - protein, 1532 aa, Homo sapiens; identical to SEQ ID NO: 1221

SEQ ID NO: 1226 - protein, 1515 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1227 - protein, 1532 aa, Homo sapiens; identical to SEQ ID NO: 1221

SEQ ID NO: 1228 - protein, 398 aa, Homo sapiens
MMSMLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 1229 - protein, 398 aa, Homo sapiens; identical to SEQ ID NO: 1228

SEQ ID NO: 1230 - protein, 175 aa, Homo sapiens [sequence omitted]

SEQ ID NO: 1231 - protein, 141 aa, Homo sapiens
MSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATGFLVLKKRRK

SEQ ID NO: 1232 - protein, 481 aa, Homo sapiens
MATSATSPHAPGFPAEGRCGYYVEKKKRFCRMVVAAGKRFCGEHAGAMEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATDLALRCLVETYAASFEERNEEPLAKRIKNDKTEKEIYTLAKEGNEKNVPEKWNPVAGIVIALCCHHRCDWRHYVGKEYFRALGLGAVEFHYFQRMSSWATCGMRKTSLETSNSTTKRQDNQNDDSEEHDDGGYRITDDGADCLPGLLSVEEKKKIGHLCKLLIDQGRIQYLQQKGFSPALQYYTDPLVSLENVLLTALPNHSSSPETTA

SEQ ID NO: 1233 - protein, 335 aa, Homo sapiens
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLIVLDLSRNTISEIPPGIGLLTRLQELILSYNKIKTVPKELSNCASLEKLELAVNRDICDLPQELSNLLKLTHLDLSMNDFTTIPLAVLNMPALEWLDMGSNKLEQLPDTIERMQNLHTLWLQRNEITCLPQTISNMKNLGTLVLSNNKLQDIPVCMEEMANLRFVNFRDNPLKLKVSLPPSEGTDEEEERELFGLQFMHTYIQESRRRADHQVNGSTTLPISINTDG

SEQ ID NO: 1234 - protein, 335 aa, Homo sapiens; identical to SEQ ID NO: 1233

SEQ ID NO: 1235 - protein, 311 aa, Homo sapiens
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGCAISQSFTDIAKVSIGRLRPHFLSVCNPDFSQINCSEGYIQNYRCRGDDSKVQEARKSFFSGHASFSMYTMLYLVLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 1236 - protein, 311 aa, Homo sapiens; identical to SEQ ID NO: 1235

SEQ ID NO: 1237 - protein, 311 aa, Homo sapiens; identical to SEQ ID NO: 1235

SEQ ID NO: 1238 - protein, 311 aa, Homo sapiens; identical to SEQ ID NO: 1235

SEQ ID NO: 1239 - protein, 861 aa, Homo sapiens
MAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKRDAKEAKAQNEATSTPHRIRRKSSVLTMNRIRQQLRFLGNSKSDQEEKEILPAAEISDSSSDEEEASTPPLPRRAPRTVSRNLRSSLKSSLHTLTKVPKKSLKPRTPRCAAPQIRSRSLAAQEPASVLEEARLRLHVSAVPESLPCREQEFQDIYNFVESKLLDHTGGCMYISGVPGTGKTATVHEVIRCLQQAAQANDVPPFQYIEVNGMKLTEPHQVYVQILQKLTGQKATANHAAELLAKQFCTRGSPQETTVLLVDELDLLWTHKQDIMYNLFDWPTHKEARLVVLAIANTMDLPERIMMNRVSSRLGLTRMCFQPYTYSQLQQILRSRLKHLKAFEDDAIQLVARKVAALSGDARRCLDICRRATEICEFSQQKPDSPGLVTIAHSMEAVDEMFSSSYITAIKNSSVLEQSFLRAILAEFRRSGLEEATFQQIYSQHVALCRMEGLPYPTMSETMAVCSHLGSCRLLLVEPSRNDLLLRVRLNVSQDDVLYALKDE

SEQ ID NO: 1240 - protein, 329 aa, Homo sapiens [sequence omitted]

SEQ ID NO: 1241 - protein, 1992 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYSSFLDQQAKQS

SEQ ID NO: 1242 - protein, 1455 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 1243 - protein, 2314 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 1244 - protein, 2314 aa, Homo sapiens; identical to SEQ ID NO: 1243

SEQ ID NO: 1245 - protein, 167 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEVSQEICCVLFYFLNN

SEQ ID NO: 1246 - protein, 166 aa, Homo sapiens
MSLHSSPTLPTSLYQSCDLSVGGPSLLTWVWRRERRCCKVFSVSHCLEAGPAKAWAHSCTGSPRGRTGWGSRACEALGKGMGLWGRGGMGFRSICTIRKVLRSFFLEGTLSSLSLFLDLGLELRMGRCAQGGTHQSTREGGYLGVSQGLCQCLQPTSRSLEFGEWG

SEQ ID NO: 1247 - protein, 230 aa, Homo sapiens
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRRGTYLPQTYIIQEEMVVTEHVSDKEALGSFIYHLCNGKDTYRLRRRATRRRINKRGAKNCNAIRHFENTFVVETLICGVV

SEQ ID NO: 1248 - protein, 267 aa, Homo sapiens
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 1249 - protein, 267 aa, Homo sapiens; identical to SEQ ID NO: 1248

SEQ ID NO: 1250 - protein, 353 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEVSGHPACARAAMAPAVGTGLGPGCTLASQPRTAACGFCVEEALLLAPAVSKGVQPSHTLPTRGHSTAGRTAGRASRGGRPFLASVSSPCSVGWLRGVHGTLSPTVVQRARWTLGSGPSEAIRIPEGGLLGPQANLLFFLPR

SEQ ID NO: 1251 - protein, 331 aa, Homo sapiens [sequence omitted]

SEQ ID NO: 1252 - protein, 331 aa, Homo sapiens [sequence omitted]

SEQ ID NO: 1253 - protein, 348 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGRESPIFKQFFKDWK

SEQ ID NO: 1254 - protein, 348 aa, Homo sapiens; identical to SEQ ID NO: 1253

SEQ ID NO: 1255 - protein, 348 aa, Homo sapiens; identical to SEQ ID NO: 1253

SEQ ID NO: 1256 - protein, 348 aa, Homo sapiens; identical to SEQ ID NO: 1253

SEQ ID NO: 1257 - protein, 542 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 1258 - protein, 542 aa, Homo sapiens; identical to SEQ ID NO: 1257

SEQ ID NO: 1259 - protein, 1128 aa, Homo sapiens
MSRRKPASGGLAASSSAPARQAVLSRFFQSTGSLKSTSSSTGAADQVDPGAAAAAAPPAPAFPPQLPPHVATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 1260 - protein, 118 aa, Homo sapiens
MEFMTINGTTLRNLEILQNQKKVGKGRHQAGLSSNIWEGELRVGQGSEVLEYTAKAVDKTDIEVFKKHKEHQGQKMILVSKPTVQEERKIVIKNGRHPVIDVLLGEQDQYVPNNTDLS

SEQ ID NO: 1261 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 1262 - protein, 212 aa, Homo sapiens [sequence omitted]

SEQ ID NO: 1263 - protein, 890 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 1264 - protein, 905 aa, Homo sapiens [sequence omitted]

SEQ ID NO: 1265 - protein, 881 aa, Homo sapiens [sequence omitted]

SEQ ID NO: 1266 - protein, 727 aa, Homo sapiens
MSGRKRSFTFGAYGGVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 1267 - protein, 689 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEESLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 1268 - protein, 663 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 1269 - protein, 663 aa, Homo sapiens; identical to SEQ ID NO: 1268

SEQ ID NO: 1270 - protein, 694 aa, Homo sapiens
MAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 1271 - protein, 663 aa, Homo sapiens; identical to SEQ ID NO: 1268

SEQ ID NO: 1272 - protein, 663 aa, Homo sapiens; identical to SEQ ID NO: 1268

SEQ ID NO: 1273 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 1274 - protein, 777 aa, Homo sapiens; identical to SEQ ID NO: 1273

SEQ ID NO: 1275 - protein, 1885 aa, Homo sapiens [sequence omitted]

SEQ ID NO: 1276 - protein, 1711 aa, Homo sapiens [sequence omitted]

SEQ ID NO: 1277 - protein, 337 aa, Homo sapiens
VSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDSQSGFSS

SEQ ID NO: 1278 - protein, 146 aa, Homo sapiens [sequence omitted]

SEQ ID NO: 1279 - protein, 97 aa, Homo sapiens
MAQKRPACTLKPECVQQLLVCSQEAKKSAYCPYSHFPVGAALLTQEGRIFKGCNIENACYPLGICAERTAIQKAVSEGYKDFRAIAIASLAPTGPCT

SEQ ID NO: 1280 - protein, 101 aa, Homo sapiens
MERPAPGEVVMSQAIQPAHATARGELSAGQLLKWIDTTACLAAEKHAGVSCVTASVDDIQFEETARVGQVITIKAKVTRAFSTSMEPPVLGSSLSEVRRYV

SEQ ID NO: 1281 - protein, 555 aa, Homo sapiens
MERPAPGEVVMSQAIQPAHATARGELSAGQLLKWIDTTACLAAEKHAGVSCVTASVDDIQFEETARVGQVITIKAKVTRAFSTSMEISIKVMVQDMLTGIEKLVSVAFSTFVAKPVGKEKIHLKPVTLLTEQDHVEHNLAAERRKVRLQHEDTFNNLMKESSKFDDLIFDEEEGAVSTRGTSVQSIELVLPPHANHHGNTFGGQIMAWMETVATISASRLCWAHPFLKSVDMFKFRGPSTVGDRLVFTAIVNNTFQTCVEVGVRVEAFDCQEWAEGRGRHINSAFLIYNAADDKENLITFPRIQPISKDDFRRYRGAIARKRIRLGRKYVISHKEEVPLCIHWDISKQASLSDSNVEALKKLAAKRGWEVTSTVEKIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSYFNHMSASILPYFAGNLGGWSKSIEETAASCIQFLENPPDDGFVSTF

SEQ ID NO: 1282 - protein, 894 aa, Homo sapiens [sequence omitted]

SEQ ID NO: 1283 - protein, 858 aa, Homo sapiens [sequence omitted]

SEQ ID NO: 1284 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 1285 - protein, 788 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 1286 - protein, 459 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHIARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 1287 - protein, 438 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTVIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHIARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 1288 - protein, 459 aa, Homo sapiens; identical to SEQ ID NO: 1286

SEQ ID NO: 1289 - protein, 285 aa, Homo sapiens
MVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 1290 - protein, 933 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 1291 - protein, 603 aa, Homo sapiens [sequence omitted]

SEQ ID NO: 1292 - protein, 933 aa, Homo sapiens; identical to SEQ ID NO: 1290

SEQ ID NO: 1293 - protein, 972 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 1294 - protein, 949 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSIGTREVVTQKNLSGLVPIRDLRLDPSLLCSIPLLALSPNLLIVWLFLSIAYLVTKLRCK

SEQ ID NO: 1295 - protein, 587 aa, Homo sapiens [sequence omitted]

SEQ ID NO: 1296 - protein, 458 aa, Homo sapiens
MLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSIGTREVVTQKNLSGLVPIRDLRLDPSLLCSIPLLALSPNLLIVWLFLSIAYLVTKLRCK

SEQ ID NO: 1297 - protein, 713 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 1298 - protein, 739 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGPLIPEENKERVQELPDSGALMLVPNRQLTADYFEKTWLSLKVAHQQVLPWRGEFHPDTLQMALQVVNIQTIAMSRAGSRPWKAYLSAQDDTGCLFLTELLLEPGNSEMQISVKQNEARTETLNSFISVLETVIGTIEEIKS

SEQ ID NO: 1299 - protein, 739 aa, Homo sapiens; identical to SEQ ID NO: 1298

SEQ ID NO: 1300 - protein, 739 aa, Homo sapiens; identical to SEQ ID NO: 1298

SEQ ID NO: 1301 - protein, 739 aa, Homo sapiens; identical to SEQ ID NO: 1298

SEQ ID NO: 1302 - protein, 532 aa, Homo sapiens
MNGVLIPHTPIAVDFWSLRRAGTARLFFLSHMHSDHTVGLSSTWARPLYCSPITAHLLHRHLQVSKQWIQALEVGESHVLPLDEIGQETMTVTLLDANHCPGSVMFLFEGYFGTILYTGDFRYTPSMLKEPALTLGKQIHTLYLDNTNCNPALVLPSRQEAAHQIVQLIRKHPQHNIKIGLYSLGKESLLEQLALEFQTWVVLSPRRLELVQLLGLADVFTVEEKAGRIHAVDHMEICHSNMLRWNQTHPTIAILPTSRKIHSSHPDIHVIPYSDHSSYSELRAFVAALKPCQVVPIVSRRPCGGFQDSLSPRISVPLIPDSVQQYMSSSSRKPSLLWLLERRLKRPRTQGVVFESPEESADQSQADRDSKKAKKEKLSPWPADLEKQPSHHPLRIKKQLFPDLYSKEWNKAVPFCESQKRVTMLTAPLGFSVHLRSTDEEFISQKTREEIGLGSPLVPMGDDDGGPEATGNQSAWMGHGSPLSHSSKGTPLLATEFRGLALKYLLTPVNFFQAGYSSRRFDQQVEKYHKPC

SEQ ID NO: 1303 - protein, 524 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 1304 - protein, 524 aa, Homo sapiens; identical to SEQ ID NO: 1303

SEQ ID NO: 1305 - protein, 524 aa, Homo sapiens; identical to SEQ ID NO: 1303

SEQ ID NO: 1306 - protein, 469 aa, Homo sapiens
MFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 1307 - protein, 131 aa, Homo sapiens
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKDTPRYSF

SEQ ID NO: 1308 - protein, 131 aa, Homo sapiens; identical to SEQ ID NO: 1307

SEQ ID NO: 1309 - protein, 633 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1310 - protein, 712 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1311 - protein, 633 aa, Homo sapiens; identical to SEQ ID NO: 1309

SEQ ID NO: 1312 - protein, 115 aa, Homo sapiens [sequence omitted]

SEQ ID NO: 1313 - protein, 712 aa, Homo sapiens; identical to SEQ ID NO: 1310

SEQ ID NO: 1314 - protein, 682 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1315 - protein, 221 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGVSAASGDGAAPAPGARAAWGPGERAFLGAGSPAQRGEAPGPRRFPPPLPAG

SEQ ID NO: 1316 - protein, 485 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGPPGREPSPSGSAPGQLEGASWNTPLAPQVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSSELGWVSAGSRG

SEQ ID NO: 1317 - protein, 293 aa, Homo sapiens
MRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPV

SEQ ID NO: 1318 - protein, 475 aa, Homo sapiens
MELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 1319 - protein, 475 aa, Homo sapiens; identical to SEQ ID NO: 1318

SEQ ID NO: 1320 - protein, 864 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 1321 - protein, 803 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 1322 - protein, 208 aa, Homo sapiens [sequence omitted]

SEQ ID NO: 1323 - protein, 220 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMVSTMNHPVLRM

SEQ ID NO: 1324 - protein, 331 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 1325 - protein, 331 aa, Homo sapiens; identical to SEQ ID NO: 1324

SEQ ID NO: 1326 - protein, 334 aa, Homo sapiens
MALRWGIVSVGLISSDFTAVLQTLPRSEHQVVAVAARDLSRAKEFAQKHDIPKAYGSYEELAKDPSVEVAYIGTQHPQHKAAVMLCLAAGKAVLCEKPTGVNAAEVREMVAEARSRALFLMEAIWTRFFPASEALRSVLAQGTLGDLRVARAEFGKNLIHVPRAVDRAQAGGALLDIGIYCVQFTSMVFGGQKPEKISVVGRRHETGVDDTVTVLLQYPGEVHGSFTCSITVQLSNTASVSGTKGMVQLLNPCWCPTELVVKGEHKEFPLPPVPKDCNFDNGAGMSYEAKHVWECLRKGMKESPVIPLSESELLADILEEVRKAIGVTFPQDKR

SEQ ID NO: 1327 - protein, 1179 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 1328 - protein, 551 aa, Homo sapiens
MPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 1329 - protein, 569 aa, Homo sapiens
MSSEQSAPGASPRAPRPGTQKSSGAVTKKGERAAKEKPATVLPPVGEEEPKSPEEYQCSGVLETDFAELCTRWGYTDFPKVVNRPRPHPPFVPSASLSEKATLDDPRLSGSCSLNSLESKYVFFRPTIQVELEQEDSKSVKEIYIRGWKVEERILGVFSKCLPPLTQLQAINLWKVGLTDKTLTTFIELLPLCSSTLRKVSLEGNPLPEQSYHKLMALDSTIAHLSLRNNNIDDRGAQLLGQALSTLHSCNRTLVSLNLGFNHIGDEGAGYIADGLRLNRSLLWLSLAHNRIQDKGALKLAEVLRAFELTHTEVVERRRLLLEKGTQERSRSPSSSRHGDSKTDREKSQMVGISNSALVDKTDKTQTMKTPKGLGKKKEKSWELAKKEEKLGSGQSPTQGTPKKEDATKAGKGKVTIPEQKPSRAKGIKIGSREKRSILLESEQLVVEATEVVNPLLEPVEHRDGKVFMPGNKVLLHLNLIRNRITEVGLEGFLATVQYQMQFSKAKSASKGPVGLLWLSLAVSPFHSLLLKQTLPLSAVILDSCCRQLLSPHFQGRKIASPHNVLRTP

SEQ ID NO: 1330 - protein, 315 aa, Homo sapiens [sequence omitted]

SEQ ID NO: 1331 - protein, 1568 aa, Homo sapiens
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 1332 - protein, 1568 aa, Homo sapiens; identical to SEQ ID NO: 1331

SEQ ID NO: 1333 - protein, 918 aa, Homo sapiens [sequence omitted]

SEQ ID NO: 1334 - protein, 1019 aa, Homo sapiens [sequence omitted]

SEQ ID NO: 1335 - protein, 828 aa, Homo sapiens [sequence omitted]

SEQ ID NO: 1336 - protein, 247 aa, Homo sapiens
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 1337 - protein, 247 aa, Homo sapiens; identical to SEQ ID NO: 1336

SEQ ID NO: 1338 - protein, 281 aa, Homo sapiens
MKSLSLLHLFPLPRAKREQGGNNSSSNQGSLPEKMQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 1339 - protein, 225 aa, Homo sapiens
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 1340 - protein, 225 aa, Homo sapiens; identical to SEQ ID NO: 1339

SEQ ID NO: 1341 - protein, 225 aa, Homo sapiens; identical to SEQ ID NO: 1339

SEQ ID NO: 1342 - protein, 225 aa, Homo sapiens; identical to SEQ ID NO: 1339

SEQ ID NO: 1343 - protein, 580 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASASQSAGITGVSHCTWPCCNPVFFSRDRVSPCWPGWSRTPDLR

SEQ ID NO: 1344 - protein, 1823 aa, Homo sapiens
MMMVGQGPMKRLTTLKSSSSAMRKMGETLMRRELRATGIPNQLLVRNGPLKQMAKRATPPTANRPLLRRPGQKPLGLQRQSRDLLPQSLPYPHLTGDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1345 - protein, 2108 aa, Homo sapiens [sequence omitted]

SEQ ID NO: 1346 - protein, 2102 aa, Homo sapiens [sequence omitted]

SEQ ID NO: 1347 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1348 - protein, 499 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFRRPPPLRQPPARCTATPSSI

SEQ ID NO: 1349 - protein, 723 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 1350 - protein, 723 aa, Homo sapiens; identical to SEQ ID NO: 1349

SEQ ID NO: 1351 - protein, 500 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAPPARCTATPSSI

SEQ ID NO: 1352 - protein, 743 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 1353 - protein, 1573 aa, Homo sapiens
MDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 1354 - protein, 1573 aa, Homo sapiens; identical to SEQ ID NO: 1353

SEQ ID NO: 1355 - protein, 482 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITGEKKSAFATYKVKAAASAHPLQMEAY

SEQ ID NO: 1356 - protein, 619 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 1357 - protein, 524 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRCKYSKEVSGTVRA

SEQ ID NO: 1358 - protein, 442 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 1359 - protein, 494 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRCKYSKEVSGTVRA

SEQ ID NO: 1360 - protein, 447 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSSFLSSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 1361 - protein, 596 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 1362 - protein, 596 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 1363 - protein, 662 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 1364 - protein, 579 aa, Homo sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 1365 - protein, 425 aa, Homo sapiens
MMRAHAPPTAVPACTAPRAPPPRDHRAGIAREALGRTGRSGFRDCLGTREVALQAREKAQAAAWQGEAGCSAHWVRHTRGAAPEGRPRVPRAAGVLTGCTVFRRTWIQRDAQIQARQERWAKGESGPWGELRGLATQPAVRASGRRGRRLERQDILEVFRCLAASWNGGFGAVKPPEVADARSGLGSGDSFCLVSVSLTKTAKKGLELKQNLIEELRKCVDTYKYLFIFSVANMRNSKLKDIRNAWKHSRMFFGKNKVMMVALGRSPSDEYKDNLHQVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 1366 - protein, 993 aa, Homo sapiens
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 1367 - protein, 943 aa, Homo sapiens
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQSLDLEFGSGFQPRVLPTQPNPVDASRAQFFLHLSPSHYALLQYHYGTLSLLKNFPQTALVSFATTGEKTVAAVMACRNEVVSIENNSQHLGFSFLVSTRNPENQKSGHIDLQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 1368 - protein, 241 aa, Homo sapiens
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPWDWGWSRPTGARDGTHACLGRVWMDICRLWGHVQG

SEQ ID NO: 1369 - protein, 525 aa, Homo sapiens
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 1370 - protein, 461 aa, Homo sapiens
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQEFEEGLLDRCPAPGPHPALVEGRRSSVKVEAEASRQ

SEQ ID NO: 1371 - protein, 525 aa, Homo sapiens; identical to SEQ ID NO: 1369

SEQ ID NO: 1372 - protein, 847 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 1373 - protein, 847 aa, Homo sapiens; identical to SEQ ID NO: 1372

SEQ ID NO: 1374 - protein, 847 aa, Homo sapiens; identical to SEQ ID NO: 1372

SEQ ID NO: 1375 - protein, 847 aa, Homo sapiens; identical to SEQ ID NO: 1372

SEQ ID NO: 1376 - protein, 483 aa, Homo sapiens [sequence omitted]

SEQ ID NO: 1377 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 1378 - protein, 331 aa, Homo sapiens; identical to SEQ ID NO: 1377

SEQ ID NO: 1379 - protein, 402 aa, Homo sapiens [sequence omitted]

SEQ ID NO: 1380 - protein, 331 aa, Homo sapiens; identical to SEQ ID NO: 1377

SEQ ID NO: 1381 - protein, 407 aa, Homo sapiens
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 1382 - protein, 407 aa, Homo sapiens; identical to SEQ ID NO: 1381

SEQ ID NO: 1383 - protein, 3714 aa, Homo sapiens [sequence omitted]

SEQ ID NO: 1384 - protein, 3690 aa, Homo sapiens [sequence omitted]

SEQ ID NO: 1385 - protein, 402 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 1386 - protein, 344 aa, Homo sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 1387 - protein, 402 aa, Homo sapiens; identical to SEQ ID NO: 1385

SEQ ID NO: 1388 - protein, 458 aa, Homo sapiens [sequence omitted]

SEQ ID NO: 1389 - protein, 536 aa, Homo sapiens [sequence omitted]

SEQ ID NO: 1390 - protein, 531 aa, Homo sapiens [sequence omitted]

SEQ ID NO: 1391 - protein, 795 aa, Homo sapiens
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 1392 - protein, 796 aa, Homo sapiens
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDREEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFS

SEQ ID NO: 1393 - protein, 711 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGNQCRKVCGHKQSLKQHQIHTQKKPDGCSECGGSFTQKSHLFAQQRIHSVGNLHECGKCGKAFMPQLKLSVYLTDHTGDIPCICKECGKVFIQRSELLTHQKTHTRKKPYKCHDCGKAFFQMLSLFRHQRTHSREKLYECSECGKGFSQNSTLIIHQKIHTGERQYACSECGKAFTQKSTLSLHQRIHSGQKSYVCIECGQAFIQKAHLIVHQRSHTGEKPYQCHNCGKSFISKSQLDIHHRIHTGEKPYECSDCGKTFTQKSHLNIHQKIHTGERHHVCSECGKAFNQKSILSMHQRIHTGEKPYKCSECGKAFTSKSQFKEHQRIHTGEKPYVCTECGKAFNGRSNFHKHQITHTRERPFVCYKCGKAFVQKSELITHQRTHMGEKPYECLDCGKSFSKKPQLKVHQRIHTGERPYVCSECGKAFNNRSNFNKHQTTHTRDKSYKCSYSVKGFTKQ

SEQ ID NO: 1394 - protein, 112 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQGLAQLAPPFHLHHL

SEQ ID NO: 1395 - DNA, 201 bp, Homo sapiens
ggcaaaaggcggtgcattggcgaagaactttctaagatgcagctttttctcttcatctccatcctggctcaccagtgcgatttcagggccaacccaaatgrgcctgcgaaaatgaatttcagttatggtctaaccattaaacccaagtcatttaaagtcaatgtcactctcagagagtccatggagctccttgatagtgct

SEQ ID NO: 1396 - DNA, 201 bp, Homo sapiens
ctgctactcctgtcggtgctggccactgtgcatgtgggccagcggctgctgaggcaacggaggcggcagctccggtccgcgcccccgggcccgtttgcgtrgccactgatcggaaacgcggcggcggtgggccaggcggctcacctctcgttcgctcgcctggcgcggcgctacggcgacgttttccagatccgcctgggc

SEQ ID NO: 1397 - DNA, 201 bp, Homo sapiens
gctgcagtggctgctcctcctcttcaccaggtatcctgatgtgcagactcgagtgcaggcagaattggatcaggtcgtggggagggaccgtctgccttgtrtgggtgaccagcccaacctgccctatgtcctggccttcctttatgaagccatgcgcttctccagctttgtgcctgtcactattcctcatgccaccactgc

SEQ ID NO: 1398 - DNA, 201 bp, Homo sapiens
gcctgcgggttcctgttgacgtcttgccctaggcaaaggtcccagttccttctcggagccggctgtcccgcgccactggaaaccgcacctccccgcagcaygggcaccagcctcagcccgaacgacccttggccgctaaacccgctgtccatccagcagaccacgctcctgctactcctgtcggtgctggccactgtgcat

SEQ ID NO: 1399 - DNA, 201 bp, Homo sapiens
tcttcacgcgccagccgcgcagccgccaagtcctcgagggccacgtgctgagcgaggcgcgcgagctggtggcgctgctggtgcgcggcagcgcggacggmgccttcctcgacccgaggccgctgaccgtcgtggccgtggccaacgtcatgagtgccgtgtgtttcggctgccgctacagccacgacgaccccgagttcc

SEQ ID NO: 1400 - DNA, 201 bp, Homo sapiens
tggcgcgcggctggatttggagaacgtaccggccactatcactgacatcttcggcgccagccaggacaccctgtccaccgcgctgcagtggctgctcctcytcttcaccaggtatcctgatgtgcagactcgagtgcaggcagaattggatcaggtcgtggggagggaccgtctgccttgtatgggtgaccagcccaacct

SEQ ID NO: 1401 - DNA, 201 bp, Homo sapiens
ctgtccaccgcgctgcagtggctgctcctcctcttcaccaggtatcctgatgtgcagactcgagtgcaggcagaattggatcaggtcgtggggagggaccrtctgccttgtatgggtgaccagcccaacctgccctatgtcctggccttcctttatgaagccatgcgcttctccagctttgtgcctgtcactattcctcat

SEQ ID NO: 1402 - DNA, 201 bp, Homo sapiens
gctgaccgtcgtggccgtggccaacgtcatgagtgccgtgtgtttcggctgccgctacagccacgacgaccccgagttccgtgagctgctcagccacaacraagagttcgggcgcacggtgggcgcgggcagcctggtggacgtgatgccctggctgcagtacttccccaacccggtgcgcaccgttttccgcgaattcga

SEQ ID NO: 1403 - DNA, 201 bp, Homo sapiens
agcgcggacggcgccttcctcgacccgaggccgctgaccgtcgtggccgtggccaacgtcatgagtgccgtgtgtttcggctgccgctacagccacgacgwccccgagttccgtgagctgctcagccacaacgaagagttcgggcgcacggtgggcgcgggcagcctggtggacgtgatgccctggctgcagtacttcccc

SEQ ID NO: 1404 - DNA, 201 bp, Homo sapiens
tcggctgccgctacagccacgacgaccccgagttccgtgagctgctcagccacaacgaagagttcgggcgcacggtgggcgcgggcagcctggtggacgtsatgccctggctgcagtacttccccaacccggtgcgcaccgttttccgcgaattcgagcagctcaaccgcaacttcagcaacttcatcctggacaagttct

SEQ ID NO: 1405 - DNA, 201 bp, Homo sapiens
tcggtgctggccactgtgcatgtgggccagcggctgctgaggcaacggaggcggcagctccggtccgcgcccccgggcccgtttgcgtggccactgatcgraaacgcggcggcggtgggccaggcggctcacctctcgttcgctcgcctggcgcggcgctacggcgacgttttccagatccgcctgggcagctgccccata

SEQ ID NO: 1406 - DNA, 201 bp, Homo sapiens
cagtgaagtggcctaacccggagaactttgatccagctcgattcttggacaaggatggcctcatcaacaaggacctgaccagcagagtgatgattttttcwgtgggcaaaaggcggtgcattggcgaagaactttctaagatgcagctttttctcttcatctccatcctggctcaccagtgcgatttcagggccaacccaa

SEQ ID NO: 1407 - DNA, 201 bp, Homo sapiens
ttgggctaccacattcccaaggacactgtggtttttgtcaaccagtggtctgtgaatcatgacccagtgaagtggcctaacccggagaactttgatccagstcgattcttggacaaggatggcctcatcaacaaggacctgaccagcagagtgatgattttttcagtgggcaaaaggcggtgcattggcgaagaactttct

SEQ ID NO: 1408 - DNA, 201 bp, Homo sapiens
gtggctgctcctcctcttcaccaggtatcctgatgtgcagactcgagtgcaggcagaattggatcaggtcgtggggagggaccgtctgccttgtatgggtraccagcccaacctgccctatgtcctggccttcctttatgaagccatgcgcttctccagctttgtgcctgtcactattcctcatgccaccactgccaacac

SEQ ID NO: 1409 - DNA, 201 bp, Homo sapiens
gcagtacttccccaacccggtgcgcaccgttttccgcgaattcgagcagctcaaccgcaacttcagcaacttcatcctggacaagttcttgaggcactgckaaagccttcggcccggggccgccccccgcgacatgatggacgcctttatcctctctgcggaaaagaaggcggccggggactcgcacggtggtggcgcgcg

SEQ ID NO: 1410 - DNA, 201 bp, Homo sapiens
caggcagaattggatcaggtcgtggggagggaccgtctgccttgtatgggtgaccagcccaacctgccctatgtcctggccttcctttatgaagccatgcrcttctccagctttgtgcctgtcactattcctcatgccaccactgccaacacctctgtcttgggctaccacattcccaaggacactgtggtttttgtcaac

SEQ ID NO: 1411 - DNA, 201 bp, Homo sapiens
gactcgagtgcaggcagaattggatcaggtcgtggggagggaccgtctgccttgtatgggtgaccagcccaacctgccctatgtcctggccttcctttatraagccatgcgcttctccagctttgtgcctgtcactattcctcatgccaccactgccaacacctctgtcttgggctaccacattcccaaggacactgtggt

SEQ ID NO: 1412 - DNA, 201 bp, Homo sapiens
aggacactgtggtttttgtcaaccagtggtctgtgaatcatgacccagtgaagtggcctaacccggagaactttgatccagctcgattcttggacaaggahggcctcatcaacaaggacctgaccagcagagtgatgattttttcagtgggcaaaaggcggtgcattggcgaagaactttctaagatgcagctttttctct

SEQ ID NO: 1413 - DNA, 201 bp, Homo sapiens
actgccaacacctctgtcttgggctaccacattcccaaggacactgtggtttttgtcaaccagtggtctgtgaatcatgacccagtgaagtggcctaaccyggagaactttgatccagctcgattcttggacaaggatggcctcatcaacaaggacctgaccagcagagtgatgattttttcagtgggcaaaaggcggtgc

SEQ ID NO: 1414 - DNA, 201 bp, Homo sapiens
tattcctcatgccaccactgccaacacctctgtcttgggctaccacattcccaaggacactgtggtttttgtcaaccagtggtctgtgaatcatgacccastgaagtggcctaacccggagaactttgatccagctcgattcttggacaaggatggcctcatcaacaaggacctgaccagcagagtgatgattttttcagt

SEQ ID NO: 1415 - DNA, 201 bp, Homo sapiens
ttcaccaggtatcctgatgtgcagactcgagtgcaggcagaattggatcaggtcgtggggagggaccgtctgccttgtatgggtgaccagcccaacctgcyctatgtcctggccttcctttatgaagccatgcgcttctccagctttgtgcctgtcactattcctcatgccaccactgccaacacctctgtcttgggctac

SEQ ID NO: 1416 - DNA, 201 bp, Homo sapiens
cggagccggctgtcccgcgccactggaaaccgcacctccccgcagcatgggcaccagcctcagcccgaacgacccttggccgctaaacccgctgtccatcyagcagaccacgctcctgctactcctgtcggtgctggccactgtgcatgtgggccagcggctgctgaggcaacggaggcggcagctccggtccgcgccccc

SEQ ID NO: 1417 - DNA, 201 bp, Homo sapiens
ccgcgcagccgccaagtcctcgagggccacgtgctgagcgaggcgcgcgagctggtggcgctgctggtgcgcggcagcgcggacggcgccttcctcgaccygaggccgctgaccgtcgtggccgtggccaacgtcatgagtgccgtgtgtttcggctgccgctacagccacgacgaccccgagttccgtgagctgctcagc

SEQ ID NO: 1418 - DNA, 201 bp, Homo sapiens
gtgcgcggcagcgcggacggcgccttcctcgacccgaggccgctgaccgtcgtggccgtggccaacgtcatgagtgccgtgtgtttcggctgccgctacakccacgacgaccccgagttccgtgagctgctcagccacaacgaagagttcgggcgcacggtgggcgcgggcagcctggtggacgtgatgccctggctgcag

SEQ ID NO: 1419 - DNA, 201 bp, Homo sapiens
gtcttgggctaccacattcccaaggacactgtggtttttgtcaaccagtggtctgtgaatcatgacccagtgaagtggcctaacccggagaactttgatcsagctcgattcttggacaaggatggcctcatcaacaaggacctgaccagcagagtgatgattttttcagtgggcaaaaggcggtgcattggcgaagaactt

SEQ ID NO: 1420 - DNA, 201 bp, Homo sapiens
atctcaacgctgtgaggaaacctcgactttgccaggtccccaagggcagcggggctcggcgagcgaggcacccttctccgtccccatcccaatccaagcgytcctggcactgacgacgccaagagactcgagtgggagttaaagcttccagtgagggcagcaggtgtccaggccgggcctgcgggttcctgttgacgtctt

SEQ ID NO: 1421 - DNA, 201 bp, Homo sapiens
tgctactcctgtcggtgctggccactgtgcatgtgggccagcggctgctgaggcaacggaggcggcagctccggtccgcgcccccgggcccgtttgcgtgsccactgatcggaaacgcggcggcggtgggccaggcggctcacctctcgttcgctcgcctggcgcggcgctacggcgacgttttccagatccgcctgggca

SEQ ID NO: 1422 - DNA, 201 bp, Homo sapiens
ccaggacaccctgtccaccgcgctgcagtggctgctcctcctcttcaccaggtatcctgatgtgcagactcgagtgcaggcagaattggatcaggtcgtgkggagggaccgtctgccttgtatgggtgaccagcccaacctgccctatgtcctggccttcctttatgaagccatgcgcttctccagctttgtgcctgtcac

SEQ ID NO: 1423 - DNA, 201 bp, Homo sapiens
taacccggagaactttgatccagctcgattcttggacaaggatggcctcatcaacaaggacctgaccagcagagtgatgattttttcagtgggcaaaaggyggtgcattggcgaagaactttctaagatgcagctttttctcttcatctccatcctggctcaccagtgcgatttcagggccaacccaaatgagcctgcgaa

SEQ ID NO: 1424 - DNA, 201 bp, Homo sapiens
cagccgcgcagccgccaagtcctcgagggccacgtgctgagcgaggcgcgcgagctggtggcgctgctggtgcgcggcagcgcggacggcgccttcctcgwcccgaggccgctgaccgtcgtggccgtggccaacgtcatgagtgccgtgtgtttcggctgccgctacagccacgacgaccccgagttccgtgagctgctc

SEQ ID NO: 1425 - DNA, 201 bp, Homo sapiens
agtcctcgagggccacgtgctgagcgaggcgcgcgagctggtggcgctgctggtgcgcggcagcgcggacggcgccttcctcgacccgaggccgctgaccrtcgtggccgtggccaacgtcatgagtgccgtgtgtttcggctgccgctacagccacgacgaccccgagttccgtgagctgctcagccacaacgaagagtt

SEQ ID NO: 1426 - DNA, 201 bp, Homo sapiens
aggcggcagctccggtccgcgcccccgggcccgtttgcgtggccactgatcggaaacgcggcggcggtgggccaggcggctcacctctcgttcgctcgccyggcgcggcgctacggcgacgttttccagatccgcctgggcagctgccccatagtggtgctgaatggcgagcgcgccatccaccaggccctggtgcagcag

SEQ ID NO: 1427 - DNA, 201 bp, Homo sapiens
tgcagtacttccccaacccggtgcgcaccgttttccgcgaattcgagcagctcaaccgcaacttcagcaacttcatcctggacaagttcttgaggcactgmgaaagccttcggcccggggccgccccccgcgacatgatggacgcctttatcctctctgcggaaaagaaggcggccggggactcgcacggtggtggcgcgc

SEQ ID NO: 1428 - DNA, 201 bp, Homo sapiens
ggccgccccccgcgacatgatggacgcctttatcctctctgcggaaaagaaggcggccggggactcgcacggtggtggcgcgcggctggatttggagaacktaccggccactatcactgacatcttcggcgccagccaggacaccctgtccaccgcgctgcagtggctgctcctcctcttcaccaggtatcctgatgtgca

SEQ ID NO: 1429 - DNA, 201 bp, Homo sapiens
caaaggtcccagttccttctcggagccggctgtcccgcgccactggaaaccgcacctccccgcagcatgggcaccagcctcagcccgaacgacccttggcygctaaacccgctgtccatccagcagaccacgctcctgctactcctgtcggtgctggccactgtgcatgtgggccagcggctgctgaggcaacggaggcgg

SEQ ID NO: 1430 - DNA, 201 bp, Homo sapiens
gtttttgtcaaccagtggtctgtgaatcatgacccagtgaagtggcctaacccggagaactttgatccagctcgattcttggacaaggatggcctcatcarcaaggacctgaccagcagagtgatgattttttcagtgggcaaaaggcggtgcattggcgaagaactttctaagatgcagctttttctcttcatctccatc

SEQ ID NO: 1431 - DNA, 201 bp, Homo sapiens
ccggtccgcgcccccgggcccgtttgcgtggccactgatcggaaacgcggcggcggtgggccaggcggctcacctctcgttcgctcgcctggcgcggcgcwacggcgacgttttccagatccgcctgggcagctgccccatagtggtgctgaatggcgagcgcgccatccaccaggccctggtgcagcagggctcggcctt

SEQ ID NO: 1432 - DNA, 201 bp, Homo sapiens
ccagatccgcctgggcagctgccccatagtggtgctgaatggcgagcgcgccatccaccaggccctggtgcagcagggctcggccttcgccgaccggccgkccttcgcctccttccgtgtggtgtccggcggccgcagcatggctttcggccactactcggagcactggaaggtgcagcggcgcgcagcccacagcatgat

SEQ ID NO: 1433 - DNA, 201 bp, Homo sapiens
ggccactatcactgacatcttcggcgccagccaggacaccctgtccaccgcgctgcagtggctgctcctcctcttcaccaggtatcctgatgtgcagactygagtgcaggcagaattggatcaggtcgtggggagggaccgtctgccttgtatgggtgaccagcccaacctgccctatgtcctggccttcctttatgaagc

SEQ ID NO: 1434 - DNA, 201 bp, Homo sapiens
cagccaggacaccctgtccaccgcgctgcagtggctgctcctcctcttcaccaggtatcctgatgtgcagactcgagtgcaggcagaattggatcaggtcrtggggagggaccgtctgccttgtatgggtgaccagcccaacctgccctatgtcctggccttcctttatgaagccatgcgcttctccagctttgtgcctgt

SEQ ID NO: 1435 - DNA, 201 bp, Homo sapiens
cccgctgtccatccagcagaccacgctcctgctactcctgtcggtgctggccactgtgcatgtgggccagcggctgctgaggcaacggaggcggcagctcsggtccgcgcccccgggcccgtttgcgtggccactgatcggaaacgcggcggcggtgggccaggcggctcacctctcgttcgctcgcctggcgcggcgcta

SEQ ID NO: 1436 - DNA, 201 bp, Homo sapiens
gcaggcagaattggatcaggtcgtggggagggaccgtctgccttgtatgggtgaccagcccaacctgccctatgtcctggccttcctttatgaagccatgmgcttctccagctttgtgcctgtcactattcctcatgccaccactgccaacacctctgtcttgggctaccacattcccaaggacactgtggtttttgtcaa

SEQ ID NO: 1437 - DNA, 201 bp, Homo sapiens
ggctaccacattcccaaggacactgtggtttttgtcaaccagtggtctgtgaatcatgacccagtgaagtggcctaacccggagaactttgatccagctcrattcttggacaaggatggcctcatcaacaaggacctgaccagcagagtgatgattttttcagtgggcaaaaggcggtgcattggcgaagaactttctaag

SEQ ID NO: 1438 - DNA, 201 bp, Homo sapiens; identical to SEQ ID NO: 1395

SEQ ID NO: 1439 - DNA, 201 bp, Homo sapiens; identical to SEQ ID NO: 1396

SEQ ID NO: 1440 - DNA, 201 bp, Homo sapiens
gccttctggtatacttccttacttttaaggataaatcataaagtcagttgctcaaaaagaaatcaatagttgaattagtgagtatagtggggttccatgakttatcatgaattttaaagtatgcattattaaattgtaaaactccaaggtgatgttgtacctcttttgcttgccaaagtacagaatttgaattatcagcaa

SEQ ID NO: 1441 - DNA, 201 bp, Homo sapiens; identical to SEQ ID NO: 1397

SEQ ID NO: 1442 - DNA, 201 bp, Homo sapiens
tatcatgaattttaaagtatgcattattaaattgtaaaactccaaggtgatgttgtacctcttttgcttgccaaagtacagaatttgaattatcagcaaaraaaaaaaaaaaagccagccaagctttaaattatgtgaccataatgtactgatttcagtaagtctcataggttaaaaaaaaaagtcaccaaatagtgtgaa

SEQ ID NO: 1443 - DNA, 201 bp, Homo sapiens
  misc_feature (1)...(201): n = A,T,C or G, or insertion/deletion polymorphism (see Tables 1-2)
aaaaagtcaccaaatagtgtgaaatatattacttaactgtccgtaagcagtatattagtattatcttgttcaggaaaaggttgaataatatatgccttgtntaatattgaaaattgaaaagtacaactaacgcaaccaagtgtgctaaaaatgagcttgattaaatcaaccacctatttttgacatggaaatgaagcaggg

SEQ ID NO: 1444 - DNA, 201 bp, Homo sapiens
gcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacat

SEQ ID NO: 1445 - DNA, 201 bp, Homo sapiens; identical to SEQ ID NO: 1398

SEQ ID NO: 1446 - DNA, 201 bp, Homo sapiens; identical to SEQ ID NO: 1399

SEQ ID NO: 1447 - DNA, 201 bp, Homo sapiens; identical to SEQ ID NO: 1400

SEQ ID NO: 1448 - DNA, 201 bp, Homo sapiens; identical to SEQ ID NO: 1401

SEQ ID NO: 1449 - DNA, 201 bp, Homo sapiens; identical to SEQ ID NO: 1402

SEQ ID NO: 1450 - DNA, 201 bp, Homo sapiens; identical to SEQ ID NO: 1403

SEQ ID NO: 1451 - DNA, 201 bp, Homo sapiens; identical to SEQ ID NO: 1404

SEQ ID NO: 1452 - DNA, 201 bp, Homo sapiens; identical to SEQ ID NO: 1405

SEQ ID NO: 1453 - DNA, 201 bp, Homo sapiens; identical to SEQ ID NO: 1406

SEQ ID NO: 1454 - DNA, 201 bp, Homo sapiens; identical to SEQ ID NO: 1408

SEQ ID NO: 1455 - DNA, 201 bp, Homo sapiens; identical to SEQ ID NO: 1407

SEQ ID NO: 1456 - DNA, 201 bp, Homo sapiens; identical to SEQ ID NO: 1409

SEQ ID NO: 1457 - DNA, 201 bp, Homo sapiens; identical to SEQ ID NO: 1410

SEQ ID NO: 1458 - DNA, 201 bp, Homo sapiens
gtttttacgtatgtaggcccagtcgtcatcagatgcttgcggcaaaaggaaagctgtgtttatatggaagaaagtaaggtgcttggagtttacctggcttwtttaatatgcttataacctagttaaagaaaggaaaagaaaacaaaaaacgaatgaaaataactgaatttggaggctggagtaatcagattactgctttaa

SEQ ID NO: 1459 - DNA, 201 bp, Homo sapiens; identical to SEQ ID NO: 1411

SEQ ID NO: 1460 - DNA, 201 bp, Homo sapiens; identical to SEQ ID NO: 1412

SEQ ID NO: 1461 - DNA, 201 bp, Homo sapiens; identical to SEQ ID NO: 1413

SEQ ID NO: 1462 - DNA, 201 bp, Homo sapiens; identical to SEQ ID NO: 1414

SEQ ID NO: 1463 - DNA, 201 bp, Homo sapiens; identical to SEQ ID NO: 1415

SEQ ID NO: 1464 - DNA, 201 bp, Homo sapiens
gaaattttagaaatattcacatcttcggagatgaggagtaaaattcagtttttttccagttcctcttttgtgctgcttctcaattagcgtttaaggtgagsataaatcaactgtccatcaggtgaggtgtgctccatacccagcggttcttcatgagtagtgggctatgcaggagcttctgggagatttttttgagtcaaa

SEQ ID NO: 1465 - DNA, 145 bp, Homo sapiens
tagacaaagtacattctggggaaacaacatttatatgtagcctttactgtttgatataccaaattaaaaaaaaattgtatctcattacttatactgggacmccattaccaaaataataaaaatcactttcataatcttgttatga

SEQ ID NO: 1466 - DNA, 201 bp, Homo sapiens; identical to SEQ ID NO: 1416

SEQ ID NO: 1467 - DNA, 201 bp, Homo sapiens; identical to SEQ ID NO: 1417

SEQ ID NO: 1468 - DNA, 201 bp, Homo sapiens; identical to SEQ ID NO: 1418

SEQ ID NO: 1469 - DNA, 201 bp, Homo sapiens; identical to SEQ ID NO: 1419

SEQ ID NO: 1470 - DNA, 201 bp, Homo sapiens; identical to SEQ ID NO: 1420

SEQ ID NO: 1471 - DNA, 201 bp, Homo sapiens; identical to SEQ ID NO: 1421

SEQ ID NO: 1472 - DNA, 201 bp, Homo sapiens; identical to SEQ ID NO: 1422

SEQ ID NO: 1473 - DNA, 201 bp, Homo sapiens; identical to SEQ ID NO: 1423

SEQ ID NO: 1474 - DNA, 201 bp, Homo sapiens; identical to SEQ ID NO: 1424

SEQ ID NO: 1475 - DNA, 201 bp, Homo sapiens; identical to SEQ ID NO: 1425

SEQ ID NO: 1476 - DNA, 201 bp, Homo sapiens; identical to SEQ ID NO: 1426

SEQ ID NO: 1477 - DNA, 201 bp, Homo sapiens; identical to SEQ ID NO: 1427

SEQ ID NO: 1478 - DNA, 201 bp, Homo sapiens
attattatatacatactgcatcttggttatttctgaaggtagcattctttggagttaaaatgcacatatagacacatacacccaaacacttacaccaaacwactgaatgaagaagtattttggtaaccaggccatttttggtgggaatccaagattggtctcccatatgcagaaatagacaaaaagtatattaaacaaagt

SEQ ID NO: 1479 - DNA, 201 bp, Homo sapiens; identical to SEQ ID NO: 1428

SEQ ID NO: 1480 - DNA, 201 bp, Homo sapiens; identical to SEQ ID NO: 1429

SEQ ID NO: 1481 - DNA, 201 bp, Homo sapiens; identical to SEQ ID NO: 1430

SEQ ID NO: 1482 - DNA, 201 bp, Homo sapiens; identical to SEQ ID NO: 1431

SEQ ID NO: 1483 - DNA, 201 bp, Homo sapiens; identical to SEQ ID NO: 1432

SEQ ID NO: 1484 - DNA, 201 bp, Homo sapiens; identical to SEQ ID NO: 1433

SEQ ID NO: 1485 - DNA, 201 bp, Homo sapiens; identical to SEQ ID NO: 1434

SEQ ID NO: 1486 - DNA, 201 bp, Homo sapiens; identical to SEQ ID NO: 1435

SEQ ID NO: 1487 - DNA, 201 bp, Homo sapiens; identical to SEQ ID NO: 1436

SEQ ID NO: 1488 - DNA, 201 bp, Homo sapiens; identical to SEQ ID NO: 1437

SEQ ID NO: 1489 - DNA, 201 bp, Homo sapiens
atactgcatcttggttatttctgaaggtagcattctttggagttaaaatgcacatatagacacatacacccaaacacttacaccaaactactgaatgaagmagtattttggtaaccaggccatttttggtgggaatccaagattggtctcccatatgcagaaatagacaaaaagtatattaaacaaagtttcagagtatat

SEQ ID NO: 1490 - DNA, 201 bp, Homo sapiens
gaattagtgagacatcagggagtaagtgacactttgaactcctcaaggacagagaactgtctttcatttttgaaccctcggtgtacacagaggcgggtctrtaacaggcaatcaacaaacgtttcttgagctagaccaaggtcagatttgaaaagaacagaaggactgaagaccagctgtgtttcttaactaaatttgtct

SEQ ID NO: 1491 - DNA, 201 bp, Homo sapiens
gataaatcatataataatgataagaaatcaaggttacaagatgagaagaaaggtgatggcgttagagttggcttctttcaattgtttcggttttcttcatyaactgacatttggctgatgtttgtgggaagtttgtgtgcatttctccatggaatagcccagccaggcgtgctactcatttttggcacaatgacagatgtt

SEQ ID NO: 1492 - DNA, 201 bp, Homo sapiens
agccaccactcagtgcttctctgtgcaggagccagtcctgattaatatgtgggaattagtgagacatcagggagtaagtgacactttgaactcctcaaggrcagagaactgtctttcatttttgaaccctcggtgtacacagaggcgggtctgtaacaggcaatcaacaaacgtttcttgagctagaccaaggtcagattt

SEQ ID NO: 1493 - DNA, 201 bp, Homo sapiens
catataataatgataagaaatcaaggttacaagatgagaagaaaggtgatggcgttagagttggcttctttcaattgtttcggttttcttcatcaactgayatttggctgatgtttgtgggaagtttgtgtgcatttctccatggaatagcccagccaggcgtgctactcatttttggcacaatgacagatgtttttattg

SEQ ID NO: 1494 - DNA, 201 bp, Homo sapiens
ccattatccttccagaccagaggtgaagattctaaatgacctcaacatggtcattaaaccaggggaaatgacagctctggtaggacccagtggagctggaraaagtacagcactgcaactcattcagcgattctatgacccctgtgaaggaatggtgaccgtggatggccatgacattcgctctcttaacattcagtggct

SEQ ID NO: 1495 - DNA, 201 bp, Homo sapiens
gtcattttcctacatcggaatccaagctaatttctaatggccttccataataattctgctttagatgtgtatacagaaaatgaaagaaactagggtccatrtgagggaaaacccaatgtcaagtggcagctcagccaccactcagtgcttctctgtgcaggagccagtcctgattaatatgtgggaattagtgagacatca

SEQ ID NO: 1496 - DNA, 201 bp, Homo sapiens
ctgacatttggctgatgtttgtgggaagtttgtgtgcatttctccatggaatagcccagccaggcgtgctactcatttttggcacaatgacagatgttttyattgactacgacgttgagttacaagaactccagattccaggaaaagcatgtgtgaataacaccattgtatggactaacagttccctcaaccagaacatga

SEQ ID NO: 1497 - DNA, 201 bp, Homo sapiens
gaaatgacagctctggtaggacccagtggagctggaaaaagtacagcactgcaactcattcagcgattctatgacccctgtgaaggaatggtgaccgtggrtggccatgacattcgctctcttaacattcagtggcttagagatcagattgggatagtggagcaagagccagttctgttctctaccaccattgcagaaaat

SEQ ID NO: 1498 - DNA, 201 bp, Homo sapiens
cataataattctgctttagatgtgtatacagaaaatgaaagaaactagggtccatgtgagggaaaacccaatgtcaagtggcagctcagccaccactcagkgcttctctgtgcaggagccagtcctgattaatatgtgggaattagtgagacatcagggagtaagtgacactttgaactcctcaaggacagagaactgtct

SEQ ID NO: 1499 - DNA, 201 bp, Homo sapiens
ccgctcaaacattggaattgtttcccaggaaccagtgttgtttgcctgtagcataatggacaatatcaagtatggagacaacaccaaagaaattcccatgraaagagtcatagcagctgcaaaacaggctcagctgcatgattttgtcatgtcactcccagagaaatatgaaactaacgttgggtcccaggggtctcaact

SEQ ID NO: 1500 - DNA, 201 bp, Homo sapiens
agttgtactgagtgcgacagctcttggaagagccttctcttacaccccaagttatgcaaaagctaaaatatcagctgcacgcttttttcaactgctggacygacaacccccaatcagtgtatacaatactgcaggtgaaaaatgggacaacttccaggggaagattgattttgttgattgtaaatttacatatccttctcg

SEQ ID NO: 1501 - DNA, 201 bp, Homo sapiens
cgaattctgcttcctacagatatggaggttacttaatctccaatgaggggctccatttcagctatgtgttcagggtgatctctgcagttgtactgagtgcracagctcttggaagagccttctcttacaccccaagttatgcaaaagctaaaatatcagctgcacgcttttttcaactgctggaccgacaacccccaatca

SEQ ID NO: 1502 - DNA, 201 bp, Homo sapiens
cactgttgctggaattggaaaggagaggcggttcattgaagcacttgagactgagctggagaagcccttcaagacagccattcagaaagccaatatttacrgattctgctttgcctttgcccagtgcatcatgtttattgcgaattctgcttcctacagatatggaggttacttaatctccaatgaggggctccatttcag

SEQ ID NO: 1503 - DNA, 201 bp, Homo sapiens
tccaagtttacggactatgagctgaaggcctatgccaaagcaggggtggtggctgatgaagtcatttcatcaatgagaacagtggctgcttttggtggtgrgaaaagagaggttgaaaggtatgagaaaaatcttgtgttcgcccagcgttggggaattagaaaaggaatagtgatgggattctttactggattcgtgtgg

SEQ ID NO: 1504 - DNA, 201 bp, Homo sapiens
actcagtaattcttcgaagtataaagaaatttggagaggagaatgatggttttgagtcagataaatcatataataatgataagaaatcaaggttacaagaygagaagaaaggtgatggcgttagagttggcttctttcaattgtttcggttttcttcatcaactgacatttggctgatgtttgtgggaagtttgtgtgcat

SEQ ID NO: 1505 - DNA, 201 bp, Homo sapiens
agattccaggaaaagcatgtgtgaataacaccattgtatggactaacagttccctcaaccagaacatgacaaatggaacacgttgtgggttgctgaacatygagagcgaaatgatcaaatttgccagttactatgctggaattgctgtcgcagtacttatcacaggatatattcaaatatgcttttgggtcattgccgcag

SEQ ID NO: 1506 - DNA, 201 bp, Homo sapiens
tttgggtcattgccgcagctcgtcagatacagaaaatgagaaaattttactttaggagaataatgagaatggaaatagggtggtttgactgcaattcagtsggggagctgaatacaagattctctgatgatattaataaaatcaatgatgccatagctgaccaaatggcccttttcattcagcgcatgacctcgaccatct

SEQ ID NO: 1507 - DNA, 201 bp, Homo sapiens
tacaagttggatcgaatcaagggtgaaattgaattccataatgtgaccttccattatccttccagaccagaggtgaagattctaaatgacctcaacatggycattaaaccaggggaaatgacagctctggtaggacccagtggagctggaaaaagtacagcactgcaactcattcagcgattctatgacccctgtgaagga

SEQ ID NO: 1508 - DNA, 201 bp, Homo sapiens
tcaggggttggaaactgaccttggttattatttctgtcagccctctcattgggattggagcagccaccattggtctgagtgtgtccaagtttacggactaygagctgaaggcctatgccaaagcaggggtggtggctgatgaagtcatttcatcaatgagaacagtggctgcttttggtggtgagaaaagagaggttgaaa

SEQ ID NO: 1509 - DNA, 201 bp, Homo sapiens
gaaaatgagaaaattttactttaggagaataatgagaatggaaatagggtggtttgactgcaattcagtgggggagctgaatacaagattctctgatgatrttaataaaatcaatgatgccatagctgaccaaatggcccttttcattcagcgcatgacctcgaccatctgtggtttcctgttgggatttttcaggggttg

SEQ ID NO: 1510 - DNA, 201 bp, Homo sapiens
tttacggactatgagctgaaggcctatgccaaagcaggggtggtggctgatgaagtcatttcatcaatgagaacagtggctgcttttggtggtgagaaaaragaggttgaaaggtatgagaaaaatcttgtgttcgcccagcgttggggaattagaaaaggaatagtgatgggattctttactggattcgtgtggtgtctc

SEQ ID NO: 1511 - DNA, 201 bp, Homo sapiens
gatattaataaaatcaatgatgccatagctgaccaaatggcccttttcattcagcgcatgacctcgaccatctgtggtttcctgttgggatttttcagggkttggaaactgaccttggttattatttctgtcagccctctcattgggattggagcagccaccattggtctgagtgtgtccaagtttacggactatgagctg

SEQ ID NO: 1512 - DNA, 201 bp, Homo sapiens
aaggtatgagaaaaatcttgtgttcgcccagcgttggggaattagaaaaggaatagtgatgggattctttactggattcgtgtggtgtctcatctttttgwgttatgcactggccttctggtacggctccacacttgtcctggatgaaggagaatatacaccaggaacccttgtccagattttcctcagtgtcatagtagg

SEQ ID NO: 1513 - DNA, 201 bp, Homo sapiens
ccgacaacccccaatcagtgtatacaatactgcaggtgaaaaatgggacaacttccaggggaagattgattttgttgattgtaaatttacatatccttctygacctgactcgcaagttctgaatggtctctcagtgtcgattagtccagggcagacactggcgtttgttgggagcagtggatgtggcaaaagcactagcat

SEQ ID NO: 1514 - DNA, 201 bp, Homo sapiens
ttttcctcagtgtcatagtaggagctttaaatcttggcaatgcctctccttgtttggaagcctttgcaactggacgtgcagcagccaccagcatttttgaracaatagacaggaaacccatcattgactgcatgtcagaagatggttacaagttggatcgaatcaagggtgaaattgaattccataatgtgaccttccatt

SEQ ID NO: 1515 - DNA, 201 bp, Homo sapiens
aagcactagcattcagctgttggaacgtttctatgatcctgatcaagggaaggtgatgatagatggtcatgacagcaaaaaagtaaatgtccagttcctcygctcaaacattggaattgtttcccaggaaccagtgttgtttgcctgtagcataatggacaatatcaagtatggagacaacaccaaagaaattcccatgga

SEQ ID NO: 1516 - DNA, 201 bp, Homo sapiens
catggacctgccacagcaatttgacacccttgttggagaaggaggaggccagatgagtggtggccagaaacaaagggtagctatcgccagagccctcatcygaaatcccaagattctgcttttggacatggccacctcagctctggacaatgagagtgaagccatggtgcaagaagtgctgagtaagattcagcatgggca

SEQ ID NO: 1517 - DNA, 201 bp, Homo sapiens
catcaatgagaacagtggctgcttttggtggtgagaaaagagaggttgaaaggtatgagaaaaatcttgtgttcgcccagcgttggggaattagaaaaggratagtgatgggattctttactggattcgtgtggtgtctcatctttttgtgttatgcactggccttctggtacggctccacacttgtcctggatgaaggag

SEQ ID NO: 1518 - DNA, 201 bp, Homo sapiens
actggaaaggaaaggtgtttacttcactctagtgactttgcaaagccagggaaatcaagctcttaatgaagaggacataaaggatgcaactgaagatgacrtgcttgcgaggacctttagcagagggagctaccaggatagtttaagggcttccatccggcaacgctccaagtctcagctttcttacctggtgcacgaacc

SEQ ID NO: 1519 - DNA, 201 bp, Homo sapiens; identical to SEQ ID NO: 1490

SEQ ID NO: 1520 - DNA, 201 bp, Homo sapiens
acaaggagagataataatgataagaaatcaaggttacaagatgagaagaaaggtgatggcgttagagttggcttctttcaattgtttcggttttcttcatyaactgacatttggctgatgtttgtgggaagtttgtgtgcatttctccatggaatagcccagccaggcgtgctactcatttttggcacaatgacagatgtt

SEQ ID NO: 1521 - DNA, 201 bp, Homo sapiens; identical to SEQ ID NO: 1492

SEQ ID NO: 1522 - DNA, 201 bp, Homo sapiens
gagataataatgataagaaatcaaggttacaagatgagaagaaaggtgatggcgttagagttggcttctttcaattgtttcggttttcttcatcaactgayatttggctgatgtttgtgggaagtttgtgtgcatttctccatggaatagcccagccaggcgtgctactcatttttggcacaatgacagatgtttttattg

SEQ ID NO: 1523 - DNA, 201 bp, Homo sapiens; identical to SEQ ID NO: 1494

SEQ ID NO: 1524 - DNA, 201 bp, Homo sapiens; identical to SEQ ID NO: 1495

SEQ ID NO: 1525 - DNA, 201 bp, Homo sapiens; identical to SEQ ID NO: 1496

SEQ ID NO: 1526 - DNA, 201 bp, Homo sapiens; identical to SEQ ID NO: 1497

SEQ ID NO: 1527 - DNA, 201 bp, Homo sapiens; identical to SEQ ID NO: 1498

SEQ ID NO: 1528 - DNA, 201 bp, Homo sapiens; identical to SEQ ID NO: 1499

SEQ ID NO: 1529 - DNA, 201 bp, Homo sapiens; identical to SEQ ID NO: 1500

SEQ ID NO: 1530 - DNA, 201 bp, Homo sapiens; identical to SEQ ID NO: 1501

SEQ ID NO: 1531 - DNA, 201 bp, Homo sapiens; identical to SEQ ID NO: 1502

SEQ ID NO: 1532 - DNA, 201 bp, Homo sapiens; identical to SEQ ID NO: 1503

SEQ ID NO: 1533 - DNA, 201 bp, Homo sapiens
atgatggttttgagtcagataaatcatgtgagtggcttttttccctcactgcatcttgtacaaggagagataataatgataagaaatcaaggttacaagaygagaagaaaggtgatggcgttagagttggcttctttcaattgtttcggttttcttcatcaactgacatttggctgatgtttgtgggaagtttgtgtgcat

SEQ ID NO: 1534 - DNA, 201 bp, Homo sapiens; identical to SEQ ID NO: 1505

SEQ ID NO: 1535 - DNA, 201 bp, Homo sapiens; identical to SEQ ID NO: 1506

SEQ ID NO: 1536 - DNA, 201 bp, Homo sapiens; identical to SEQ ID NO: 1507

SEQ ID NO: 1537 - DNA, 201 bp, Homo sapiens; identical to SEQ ID NO: 1508

SEQ ID NO: 1538 - DNA, 201 bp, Homo sapiens; identical to SEQ ID NO: 1509

SEQ ID NO: 1539 - DNA, 201 bp, Homo sapiens; identical to SEQ ID NO: 1510

SEQ ID NO: 1540 - DNA, 201 bp, Homo sapiens; identical to SEQ ID NO: 1511

SEQ ID NO: 1541 - DNA, 201 bp, Homo sapiens; identical to SEQ ID NO: 1512

SEQ ID NO: 1542 - DNA, 201 bp, Homo sapiens; identical to SEQ ID NO: 1513

SEQ ID NO: 1543 - DNA, 201 bp, Homo sapiens; identical to SEQ ID NO: 1514

SEQ ID NO: 1544 - DNA, 201 bp, Homo sapiens; identical to SEQ ID NO: 1515

SEQ ID NO: 1545 - DNA, 201 bp, Homo sapiens; identical to SEQ ID NO: 1516

SEQ ID NO: 1546 - DNA, 201 bp, Homo sapiens; identical to SEQ ID NO: 1517

SEQ ID NO: 1547 - DNA, 201 bp, Homo sapiens; identical to SEQ ID NO: 1518

SEQ ID NO: 1548 - DNA, 201 bp, Homo sapiens
ccaccaaagtcaccagagggaaaaacaagtgcacagacaacaccaagtaagataccaaggtataaaggacaaggtaagaagaagacaagcgggcagaaggstggtgacaagaaggccaatgatgaggccaatcagagtgatacaagtgtctccttgtcagaacccaagagcaaaagcagccttcacttactgtcccatgaa

SEQ ID NO: 1549 - DNA, 201 bp, Homo sapiens
ttgtatttccttccatttggaaggtttgttagaccattaaggttatattaaagtactcttgtgtgtgctatttagttttgcttgttttaaagaaatctagmagtggttatgagttttaattcatagaattgtcaataacataacatttgcaatcgtcattcctcctgttatccatgtaagcagctttagtcgtaggttctc

SEQ ID NO: 1550 - DNA, 201 bp, Homo sapiens
ttgtccagatgaagatgatatggaaggagattctttctttgatgatcccattcctaagccagagaaaacttacggtttgaggaaggaacctaggaagcaascaggaagtctggcctcgctctcggatgcaccccccttaaaaagtggactcagctccctggcgggagccccttctttaaaagactctgagagtaaaagggg

SEQ ID NO: 1551 - DNA, 201 bp, Homo sapiens
cggtttgaggaaggaacctaggaagcaagcaggaagtctggcctcgctctcggatgcaccccccttaaaaagtggactcagctccctggcgggagcccctyctttaaaagactctgagagtaaaaggggaaatacagttttgaaagatctgaaattgatcagtgataaaattggatcacttggattaggaactggagaaga

SEQ ID NO: 1552 - DNA, 198 bp, Homo sapiens
cggccgcgtagcccgcgcgcggagcgtaccctgctgcggccgttggccgttagcgcggcttcggcggttgtcttggagaagcaagatggcggcgacgrcggccgcagtggtggccgaggaggacacggagctgcgggacctgctggtgcagacgctggagaacagcggggtcctgaaccgcatcaaggctgaactccg

SEQ ID NO: 1553 - DNA, 201 bp, Homo sapiens
gctttttaaaatttaagtgaaactaagctgtaaacatcaagaggaagtaggacataaactgggccggtacagcctgggagccctgtgtatttctgccctcygtctgtgagctgctatctcagtctccttcagctcttcatgtcttagtaaacagcaccacgtgcagatgtaatcttgttgcagtcccccagtgtggttgtt

SEQ ID NO: 1554 - DNA, 201 bp, Homo sapiens
taatttcaattaagttgcggctttttactacaagttaactttattagtaaaaggagcaaattagacctaattcattgatctcggttaagtgagcagactgyatgacttgtgtaatgccagtttctcatttcatattagcctaaatattacagaaattactccttgggctctaaaatgtagaggaaatgaaaatgtaaggat

SEQ ID NO: 1555 - DNA, 201 bp, Homo sapiens
agaccatgttcagtttgacaagctttatatactgtacataatttcattgtaacccttaaaaatagagccaataatagaatttccacagtctcatttatacrgttaaagcattattgctattatgtaggtcacggatgtttataatactaaagtattttaaaatgtgcaagtagaaaaaacagtagaaagtgatgcatgcat

SEQ ID NO: 1556 - DNA, 201 bp, Homo sapiens
agtcactttctaaaagcactatagttctggtcccctggaatctggatcacatgtatgatttatttttaatatttgataggaactaggtttcagtgaaatgrtttgaaagcatagcaggatgtggctttttaaatttatgaaactttcgaacagtagcaactgaaatttgtcacttttctgttacgcagagaatcagacctt

SEQ ID NO: 1557 - DNA, 201 bp, Homo sapiens
ccaagtaagataccaaggtataaaggacaaggtaagaagaagacaagcgggcagaaggctggtgacaagaaggccaatgatgaggccaatcagagtgatayaagtgtctccttgtcagaacccaagagcaaaagcagccttcacttactgtcccatgaaacaaaaattggatcttttctaagcaacagaactttagatggc

SEQ ID NO: 1558 - DNA, 201 bp, Homo sapiens
aagacaaagctggcctttgtccagatgaagatgatatggaaggagattctttctttgatgatcccattcctaagccagagaaaacttacggtttgaggaakgaacctaggaagcaagcaggaagtctggcctcgctctcggatgcaccccccttaaaaagtggactcagctccctggcgggagccccttctttaaaagact

SEQ ID NO: 1559 - DNA, 201 bp, Homo sapiens; identical to SEQ ID NO: 1549

SEQ ID NO: 1560 - DNA, 201 bp, Homo sapiens; identical to SEQ ID NO: 1550

SEQ ID NO: 1561 - DNA, 201 bp, Homo sapiens; identical to SEQ ID NO: 1551

SEQ ID NO: 1562 - DNA, 198 bp, Homo sapiens; identical to SEQ ID NO: 1552

SEQ ID NO: 1563 - DNA, 201 bp, Homo sapiens; identical to SEQ ID NO: 1553

SEQ ID NO: 1564 - DNA, 201 bp, Homo sapiens; identical to SEQ ID NO: 1554

SEQ ID NO: 1565 - DNA, 201 bp, Homo sapiens; identical to SEQ ID NO: 1555

SEQ ID NO: 1566 - DNA, 201 bp, Homo sapiens; identical to SEQ ID NO: 1556

SEQ ID NO: 1567 - DNA, 201 bp, Homo sapiens
ctatctgatgtacattctccaccaaagtcaccagagggaaaaacaagtgcacagacaacaccaagtaagaaggccaatgatgaggccaatcagagtgatayaagtgtctccttgtcagaacccaagagcaaaagcagccttcacttactgtcccatgaaacaaaaattggatcttttctaagcaacagaactttagatggc

SEQ ID NO: 1568 - DNA, 201 bp, Homo sapiens; identical to SEQ ID NO: 1558

SEQ ID NO: 1569 - DNA, 201 bp, Homo sapiens
tcctcatcaccatcatcgccatgagctcactgggcgtcctcctgggggccacctgtgcaggcctcctgctctactgcacctgttcctactcgggcctgagytcccgaagctgcaccacactggagaactacaacttcgagctctacgatggccttaagcacaaggtcaagatgaaccaccaaaagtgctgctccgaggcat

SEQ ID NO: 1570 - DNA, 201 bp, Homo sapiens
gtgaatccgcagacctcctgggcaaacactgtgggaacatcgccccgcccaccatcatctcctcgggctccatgctctacatcaagttcacctccgactaygcccggcagggggcaggcttctctctgcgctacgagatcttcaagacaggctctgaagattgctcaaaaaacttcacaagccccaacgggaccatcgaat

SEQ ID NO: 1571 - DNA, 201 bp, Homo sapiens
cacctccgactacgcccggcagggggcaggcttctctctgcgctacgagatcttcaagacaggctctgaagattgctcaaaaaacttcacaagccccaacsggaccatcgaatctcctgggtttcctgagaagtatccacacaacttggactgcacctttaccatcctggccaaacccaagatggagatcatcctgcagtt

SEQ ID NO: 1572 - DNA, 201 bp, Homo sapiens
ccaacatgctggggatgctctcaggcctcattgcagactcccagatctccgcctcttccacccaggaatacctctggagccccagtgcagcccgcctggtyagcagccgctcgggctggttccctcgaatccctcaggcccagcccggtgaggagtggcttcaggtagatctgggaacacccaagacagtgaaaggtgtca

SEQ ID NO: 1573 - DNA, 201 bp, Homo sapiens
cggtggctaagtcattgcaggaacggggctgtgttctctgctgggacaaaacaggagctcatctctttggggtcacagttctattttgtttgtgagtttgwattattattattattattattattattattatattttatttctttggtctgtgagcaactcaaagaggcagaagaggagaatgacttttccagaatagaa

SEQ ID NO: 1574 - DNA, 201 bp, Homo sapiens
agtacgattggctggacatctgggatggcattccacatgttggccccctgattggcaagtactgtgggaccaaaacaccctctgaacttcgttcatcgacrgggatcctctccctgacctttcacacggacatggcggtggccaaggatggcttctctgcgcgttactacctggtccaccaagagccactagagaactttc

SEQ ID NO: 1575 - DNA, 201 bp, Homo sapiens
aggatggcttctctgcgcgttactacctggtccaccaagagccactagagaactttcagtgcaatgttcctctgggcatggagtctggccggattgctaaygaacagatcagtgcctcatctacctactctgatgggaggtggacccctcaacaaagccggctccatggtgatgacaatggctggacccccaacttggatt

SEQ ID NO: 1576 - DNA, 201 bp, Homo sapiens
cgaagctgcaccacactggagaactacaacttcgagctctacgatggccttaagcacaaggtcaagatgaaccaccaaaagtgctgctccgaggcatgacrgattgcacctgaatcctatctgacgtttcattccagcaagaggggctggggaagattacatttttttttcctttggaaactgaatgccataatctcgatc

SEQ ID NO: 1577 - DNA, 201 bp, Homo sapiens
ccaacaaggagtatctccaggtggacctgcgctttttaaccatgctcacggccatcgcaacacagggagcgatttccagggaaacacagaatggctactaygtcaaatcctacaagctggaagtcagcactaatggagaggactggatggtgtaccggcatggcaaaaaccacaaggtatttcaagccaacaacgatgcaa

SEQ ID NO: 1578 - DNA, 201 bp, Homo sapiens
aagtctcctacagcctaaacggcaaggactgggaatacattcaggaccccaggacccagcagccaaagctgttcgaagggaacatgcactatgacacccckgacatccgaaggtttgaccccattccggcacagtatgtgcgggtatacccggagaggtggtcgccggcggggattgggatgcggctggaggtgctgggct

SEQ ID NO: 1579 - DNA, 201 bp, Homo sapiens
gggccacctgtgcaggcctcctgctctactgcacctgttcctactcgggcctgagctcccgaagctgcaccacactggagaactacaacttcgagctctaygatggccttaagcacaaggtcaagatgaaccaccaaaagtgctgctccgaggcatgacggattgcacctgaatcctatctgacgtttcattccagcaaga

SEQ ID NO: 1580 - DNA, 201 bp, Homo sapiens
gttcctactcgggcctgagctcccgaagctgcaccacactggagaactacaacttcgagctctacgatggccttaagcacaaggtcaagatgaaccaccaraagtgctgctccgaggcatgacggattgcacctgaatcctatctgacgtttcattccagcaagaggggctggggaagattacatttttttttcctttgga

SEQ ID NO: 1581 - DNA, 201 bp, Homo sapiens
attcgggatggggacagtgaatccgcagacctcctgggcaaacactgtgggaacatcgccccgcccaccatcatctcctcgggctccatgctctacatcargttcacctccgactacgcccggcagggggcaggcttctctctgcgctacgagatcttcaagacaggctctgaagattgctcaaaaaacttcacaagcccc

SEQ ID NO: 1582 - DNA, 201 bp, Homo sapiens
tggctaatttgaggccctgagtgggccttgaatgctaaaaagaagcagggtacgcagggctacatgtagataccacaccaaggctggaggctggtctgtcrtaagacagaaagaaagacgctgggcccaattttgacttggccaggggacaccttggtgtgtttgttatctttatctgtgggtaggctagctgacccatct

SEQ ID NO: 1583 - DNA, 201 bp, Homo sapiens
agaaacctctgcataagacgttgtaaggaggaaaataaaagagagaaaaacacaaagatttaaacaagaaacctacgaacccagctctggaaagagccacyttctccaaaatggatatgtttcctctcacctgggttttcttagccctctacttttcaagacaccaagtgagaggccaaccagacccaccgtgcggaggtc

SEQ ID NO: 1584 - DNA, 201 bp, Homo sapiens
tcaccattggctaatttgaggccctgagtgggccttgaatgctaaaaagaagcagggtacgcagggctacatgtagataccacaccaaggctggaggctgstctgtcataagacagaaagaaagacgctgggcccaattttgacttggccaggggacaccttggtgtgtttgttatctttatctgtgggtaggctagctga

SEQ ID NO: 1585 - DNA, 201 bp, Homo sapiens
aactcaacctgcatccctctaaaagtcctatatccatattcaccattggctaatttgaggccctgagtgggccttgaatgctaaaaagaagcagggtacgsagggctacatgtagataccacaccaaggctggaggctggtctgtcataagacagaaagaaagacgctgggcccaattttgacttggccaggggacacctt

SEQ ID NO: 1586 - DNA, 201 bp, Homo sapiens
cacctgaatcctatctgacgtttcattccagcaagaggggctggggaagattacatttttttttcctttggaaactgaatgccataatctcgatcaaaccratccagaataccgaaggtatggacaggacagaaaagcgagtcgcaggaggaagggagatgcagccgcacaggggatgattaccctcctaggaccgcggtg

SEQ ID NO: 1587 - DNA, 201 bp, Homo sapiens
agcaaaacccactagcaagaaatgaaagaacatttcttaggctaaaatcctcaaggaagtctacataaatgattgtatgtgctatgttcagcccagcaatrtctcatataccacgtatcattgaagaatgacattccatttaggtgaagtgtccagatactgaaatatccacctttaaagttcttaaaagagaactttaaa

SEQ ID NO: 1588 - DNA, 201 bp, Homo sapiens
tgcaattgtaactgtctcaatgcaagcttcgctgtagatgcccttcttaacaatatgctttatcttctgactgagaaaatcacttgagatgttatcatgcmcaatcccacttgttctgcctctccaccctggcaccttctccgaacccagagatcccagagggccagcatctcaccccatgtaactccatgtaattctccc

SEQ ID NO: 1589 - DNA, 201 bp, Homo sapiens
ggggacatgatatggacctgttacgtgggcccacagcatccaggtccagcctaagctgggaagatcaaggaaggctccctggaggaggtgacgcctatackaattctaaagaatttggccaggcagcagggagtgtgtttggctggtgtcataggcagacagcagcatgcccaaagacaagaaggagggagggtttgatgc

SEQ ID NO: 1590 - DNA, 201 bp, Homo sapiens; identical to SEQ ID NO: 1583

SEQ ID NO: 1591 - DNA, 201 bp, Homo sapiens
caggtacgtggtggacgaatgggagcagctggctgctggccccacacttaccaaccttgaccacagggtccacccagcaactccacctcacccatggatcrgggggaaaaacaactcacagactgttctcctcttaccaaggttaaaacgcagctggaattactttgggcagtttgtttttaaaaatgagtgttgcaattg

SEQ ID NO: 1592 - DNA, 201 bp, Homo sapiens
agccaaaggacaaaagggcgagactacgggccgtctgggcaaacagagagaagccactttattccctgtggagtggaggatgctaggatgttgctgctccrgcagacagaggcctttcgcttgagtcatcagccaacagactgaatgttatggttttagaaacccatacacaaagttgagtggttttttccatttctaaaa

SEQ ID NO: 1593 - DNA, 201 bp, Homo sapiens
ctcactttgaaatcgagaagcacgactgcaacttgctgtctgcttggaaaatttcactcacaagccgcagctttgcctgactcagtgcaatccaaggccaycatctctggtgaacttcccttgactcctccctccagccacttgcagaaatgcaaatcctgggcacccacaggctgtttgggggcctgtatagaagctgtg

SEQ ID NO: 1594 - DNA, 201 bp, Homo sapiens; identical to SEQ ID NO: 1569

SEQ ID NO: 1595 - DNA, 201 bp, Homo sapiens; identical to SEQ ID NO: 1570

SEQ ID NO: 1596 - DNA, 201 bp, Homo sapiens; identical to SEQ ID NO: 1571

SEQ ID NO: 1597 - DNA, 201 bp, Homo sapiens; identical to SEQ ID NO: 1572

SEQ ID NO: 1598 - DNA, 201 bp, Homo sapiens; identical to SEQ ID NO: 1573

SEQ ID NO: 1599 - DNA, 201 bp, Homo sapiens; identical to SEQ ID NO: 1574

SEQ ID NO: 1600 - DNA, 201 bp, Homo sapiens; identical to SEQ ID NO: 1575

SEQ ID NO: 1601 - DNA, 201 bp, Homo sapiens; identical to SEQ ID NO: 1576

SEQ ID NO: 1602 - DNA, 201 bp, Homo sapiens; identical to SEQ ID NO: 1577

SEQ ID NO: 1603 - DNA, 201 bp, Homo sapiens; identical to SEQ ID NO: 1578

SEQ ID NO: 1604 - DNA, 201 bp, Homo sapiens; identical to SEQ ID NO: 1579

SEQ ID NO: 1605 - DNA, 201 bp, Homo sapiens; identical to SEQ ID NO: 1580

SEQ ID NO: 1606 - DNA, 201 bp, Homo sapiens; identical to SEQ ID NO: 1581

SEQ ID NO: 1607 - DNA, 201 bp, Homo sapiens; identical to SEQ ID NO: 1582

SEQ ID NO: 1608 - DNA, 201 bp, Homo sapiens; identical to SEQ ID NO: 1583

SEQ ID NO: 1609 - DNA, 201 bp, Homo sapiens; identical to SEQ ID NO: 1584

SEQ ID NO: 1610 - DNA, 201 bp, Homo sapiens; identical to SEQ ID NO: 1585

SEQ ID NO: 1611 - DNA, 201 bp, Homo sapiens; identical to SEQ ID NO: 1586

SEQ ID NO: 1612 - DNA, 201 bp, Homo sapiens; identical to SEQ ID NO: 1570

SEQ ID NO: 1613 - DNA, 201 bp, Homo sapiens
ttacctcaatggaggctttcacacattagaaaaagaagtgtccctttccctgtagaccaggaattcagaacggtcaaagatcgcccaaactgccttccccsctctctagccaaagtcagctgaaaacgcagttggagccaaattcttccccagatactccattttagtcaccaggtaaaagacacaacctggaaattgcca

SEQ ID NO: 1614 - DNA, 201 bp, Homo sapiens; identical to SEQ ID NO: 1571

SEQ ID NO: 1615 - DNA, 201 bp, Homo sapiens
cctaggggtcattttcccgtaaggttctcagtgagctaggaactatcagtcagcttgggttacctcaatggaggctttcacacattagaaaaagaagtgtycctttccctgtagaccaggaattcagaacggtcaaagatcgcccaaactgccttcccccctctctagccaaagtcagctgaaaacgcagttggagccaaa

SEQ ID NO: 1616 - DNA, 201 bp, Homo sapiens; identical to SEQ ID NO: 1572

SEQ ID NO: 1617 - DNA, 201 bp, Homo sapiens
cagaagacagtgtcattggcctaggggtcattttcccgtaaggttctcagtgagctaggaactatcagtcagcttgggttacctcaatggaggctttcacrcattagaaaaagaagtgtccctttccctgtagaccaggaattcagaacggtcaaagatcgcccaaactgccttcccccctctctagccaaagtcagctga

SEQ ID NO: 1618 - DNA, 201 bp, Homo sapiens
ttgacaggagtgctttccctaaacaaaggtttgggaaacagtctaagactatcgatgtgtgaccagaagacagtgtcattggcctaggggtcattttcccrtaaggttctcagtgagctaggaactatcagtcagcttgggttacctcaatggaggctttcacacattagaaaaagaagtgtccctttccctgtagaccag

SEQ ID NO: 1619 - DNA, 201 bp, Homo sapiens; identical to SEQ ID NO: 1574

SEQ ID NO: 1620 - DNA, 201 bp, Homo sapiens; identical to SEQ ID NO: 1575

SEQ ID NO: 1621 - DNA, 201 bp, Homo sapiens
aagtgctgggattataggcatgaaccaccgcgcccggcctggactcttttttaatcgttacaacatctgtgcaaagtagatctttttgtcactcccatttyagagatgataaactgacacttgatatcatgcccagggtcacacagttcacctgtgatagagccgattcagaaaccggaagtctgactccaaagtccagat

SEQ ID NO: 1622 - DNA, 201 bp, Homo sapiens
ccccgagccagaagctcaggccagtacagcttactcccctgccaccagagtgaaggtcagccttcaacacagacacaaggagccccagaaggggaggagaygtcatacctctgtccctccccagatcagtctcctggcaggccaggctctctgattcttatctctagttaccccttgtttttctcaaaagaacaggtccct

SEQ ID NO: 1623 - DNA, 201 bp, Homo sapiens; identical to SEQ ID NO: 1577

SEQ ID NO: 1624 - DNA, 201 bp, Homo sapiens
aggcaagggagaagcaagagaaactcaccccgagccagaagctcaggccagtacagcttactcccctgccaccagagtgaaggtcagccttcaacacagayacaaggagccccagaaggggaggagacgtcatacctctgtccctccccagatcagtctcctggcaggccaggctctctgattcttatctctagttacccc

SEQ ID NO: 1625 - DNA, 201 bp, Homo sapiens
ctgtccttcccccggatgagtgtctccaagtgtactctaggctggtcctccaaagcagccccctgctccccgcatcatcagttttatgtactggggctccrtgtgaggtttcttttgacaggagtgctttccctaaacaaaggtttgggaaacagtctaagactatcgatgtgtgaccagaagacagtgtcattggcctag

SEQ ID NO: 1626 - DNA, 201 bp, Homo sapiens
ggaaagggaagaaggtgatagggactgggtcccacaccagaagggctgagtggcctctctccctgcagctgttcgaagggaacatgcactatgacacccckgacatccgaaggtttgaccccattccggcacagtatgtgcgggtatacccggagaggtggtcgccggcggggattgggatgcggctggaggtgctgggct

SEQ ID NO: 1627 - DNA, 201 bp, Homo sapiens
acagtcgtcatccaactcctgaaatccaataaaacaaatatcgtttgagagattactttgtgccaggcactgtgctaaataccttatttctgactcttttktttgtttgtttgtttgtttttgagatggagtctctgtcacccaggctggagtgcagtggcctgttctcggctcactgcaacctccgcctccagggttcaa

SEQ ID NO: 1628 - DNA, 201 bp, Homo sapiens; identical to SEQ ID NO: 1581

SEQ ID NO: 1629 - DNA, 201 bp, Homo sapiens; identical to SEQ ID NO: 1583

SEQ ID NO: 1630 - DNA, 201 bp, Homo sapiens
tgggatgcggctggaggtgctgggctgtgactggacaggtaagatgacatttcctcctctttgcatctcacccacatggtcctctgaccctggcatcccaygaggccctgggagggctgtggagggggcagccatcccaggagctggaaatgctgcagacccctgccatgttctcctgcctcagaccacgggtactgcagc

SEQ ID NO: 1631 - DNA, 201 bp, Homo sapiens
aaatgattgacattcctgtaggtgccccatagaggtgtggcattgagaaattatgtctggaaaatacagccagtgtagtgaccagctgagttaccatatascctgatgattccccttctgtaacagaaggtgacaacaactttgtgaactttctatatctttatctgatgccccaagtggcatcatctttatgtacatgcc

SEQ ID NO: 1632 - DNA, 201 bp, Homo sapiens; identical to SEQ ID NO: 1570

SEQ ID NO: 1633 - DNA, 201 bp, Homo sapiens
ttgggagagactttcagcattctttcacgatatccagatatgtcccttcagcacacacactcaactttctcatctggttcgtttcatcctcccgaaagaayggtgctctcccactcttactctatttcaaagagctactctgtctcaaccacagcagccctgccaagaaaaggcaagatgaaaggctagagcatgtgctac

SEQ ID NO: 1634 - DNA, 201 bp, Homo sapiens
tactctgtctcaaccacagcagccctgccaagaaaaggcaagatgaaaggctagagcatgtgctaccttgagatttcaagaagtgtcctacctcagctgargatggagaaacggggagtggagaggggatcagcccagggtaccatgtgatgactaatatgccactcattaagggcttttacctcggctgtccacatccag

SEQ ID NO: 1635 - DNA, 201 bp, Homo sapiens; identical to SEQ ID NO: 1571

SEQ ID NO: 1636 - DNA, 201 bp, Homo sapiens
atgttgccttataaaagagaagctcataatgaatgtttagcctttatcagttacatccaatcttggaataagtcatagagaataacaagtctgggactgaygtaggaaaaacagtagtctgtttaagttgagaggaggaggaggtggacgagagaagggaggagagggaagaactgaaatgtctcctcacccagggtggtt

SEQ ID NO: 1637 - DNA, 201 bp, Homo sapiens; identical to SEQ ID NO: 1572

SEQ ID NO: 1638 - DNA, 201 bp, Homo sapiens
tctgtttaagttgagaggaggaggaggtggacgagagaagggaggagagggaagaactgaaatgtctcctcacccagggtggttattgggcccaacttggratggggttgagtacgaaggttaaaaaacatatactttggtattatattggtcattgtaatagcagttgtaaaatatggggggaaaagggatcatttgctt

SEQ ID NO: 1639 - DNA, 201 bp, Homo sapiens
ttcctgctaaaaatccactggggaggtataaaattcactccaaagaagtttgcctgggccaaaagcctccaggttccttctgagaacaaaatactaatgattttttttttttttttggctgcttgggagagactttcagcattctttcacgatatccagatatgtcccttcagcacacacactcaactttctcatctggtt

SEQ ID NO: 1640 - DNA, 201 bp, Homo sapiens; identical to SEQ ID NO: 1574

SEQ ID NO: 1641 - DNA, 201 bp, Homo sapiens; identical to SEQ ID NO: 1575

SEQ ID NO: 1642 - DNA, 201 bp, Homo sapiens; identical to SEQ ID NO: 1577

SEQ ID NO: 1643 - DNA, 201 bp, Homo sapiens; identical to SEQ ID NO: 1578

SEQ ID NO: 1644 - DNA, 201 bp, Homo sapiens
agtttctgtgtgaactctcagacatctctttcccggatccccaaccctgagcactcttatcaatcccaaccatcctccttgggttcattttggtttctggkttttctttttcctttttgttgattccaaaccaacaaacccaactctaatgctgcatcttggactatccgaagagatccacccccaagcactccacaactc

SEQ ID NO: 1645 - DNA, 201 bp, Homo sapiens; identical to SEQ ID NO: 1581

SEQ ID NO: 1646 - DNA, 201 bp, Homo sapiens
taaaattcactccaaagaagtttgcctgggccaaaagcctccaggttccttctgagaacaaaatactaatgattttttttttttttttggctgcttgggasagactttcagcattctttcacgatatccagatatgtcccttcagcacacacactcaactttctcatctggttcgtttcatcctcccgaaagaacggtgct

SEQ ID NO: 1647 - DNA, 201 bp, Homo sapiens; identical to SEQ ID NO: 1583

SEQ ID NO: 1648 - DNA, 201 bp, Homo sapiens
ctggctgggtttctgttggctgtcattgtcatctccaggtacctaaagaaatagaggccacatgggatgcagtgtggcttctcccatccctatccccaacycacctgacccaagagaaggttcccctagcacactcaaacaagacccccttgtcttctggtgtctttgaaatgtcaagataacagccactgggtgtctgcg

SEQ ID NO: 1649 - DNA, 201 bp, Homo sapiens
gctgagttaccatataccctgatgattccccttctgtaacagaaggtgacaacaactttgtgaactttctatatctttatctgatgccccaagtggcatcwtctttatgtacatgccttagttgagaatatgagactgctctaatctttgtgaatgccttcacacttcagctgaggatgtcaccttctctgtcactcccca

SEQ ID NO: 1650 - DNA, 201 bp, Homo sapiens; identical to SEQ ID NO: 1569

SEQ ID NO: 1651 - DNA, 201 bp, Homo sapiens; identical to SEQ ID NO: 1570

SEQ ID NO: 1652 - DNA, 201 bp, Homo sapiens; identical to SEQ ID NO: 1571

SEQ ID NO: 1653 - DNA, 201 bp, Homo sapiens; identical to SEQ ID NO: 1572

SEQ ID NO: 1654 - DNA, 201 bp, Homo sapiens; identical to SEQ ID NO: 1573

SEQ ID NO: 1655 - DNA, 201 bp, Homo sapiens; identical to SEQ ID NO: 1574

SEQ ID NO: 1656 - DNA, 201 bp, Homo sapiens; identical to SEQ ID NO: 1575

SEQ ID NO: 1657 - DNA, 201 bp, Homo sapiens; identical to SEQ ID NO: 1576

SEQ ID NO: 1658 - DNA, 201 bp, Homo sapiens; identical to SEQ ID NO: 1577

SEQ ID NO: 1659 - DNA, 201 bp, Homo sapiens; identical to SEQ ID NO: 1578

SEQ ID NO: 1660 - DNA, 201 bp, Homo sapiens; identical to SEQ ID NO: 1579

SEQ ID NO: 1661 - DNA, 201 bp, Homo sapiens; identical to SEQ ID NO: 1580

SEQ ID NO: 1662 - DNA, 201 bp, Homo sapiens; identical to SEQ ID NO: 1581

SEQ ID NO: 1663 - DNA, 201 bp, Homo sapiens; identical to SEQ ID NO: 1582

SEQ ID NO: 1664 - DNA, 201 bp, Homo sapiens; identical to SEQ ID NO: 1584

SEQ ID NO: 1665 - DNA, 201 bp, Homo sapiens; identical to SEQ ID NO: 1585

SEQ ID NO: 1666 - DNA, 201 bp, Homo sapiens; identical to SEQ ID NO: 1586

SEQ ID NO: 1667 - DNA, 201 bp, Homo sapiens; identical to SEQ ID NO: 1569

SEQ ID NO: 1668 - DNA, 201 bp, Homo sapiens; identical to SEQ ID NO: 1570

SEQ ID NO: 1669 - DNA, 201 bp, Homo sapiens; identical to SEQ ID NO: 1571

SEQ ID NO: 1670 - DNA, 201 bp, Homo sapiens; identical to SEQ ID NO: 1572

SEQ ID NO: 1671 - DNA, 201 bp, Homo sapiens; identical to SEQ ID NO: 1573

SEQ ID NO: 1672 - DNA, 201 bp, Homo sapiens; identical to SEQ ID NO: 1574

SEQ ID NO: 1673 - DNA, 201 bp, Homo sapiens; identical to SEQ ID NO: 1575

SEQ ID NO: 1674 - DNA, 201 bp, Homo sapiens; identical to SEQ ID NO: 1576

SEQ ID NO: 1675 - DNA, 201 bp, Homo sapiens; identical to SEQ ID NO: 1577

SEQ ID NO: 1676 - DNA, 201 bp, Homo sapiens; identical to SEQ ID NO: 1578

SEQ ID NO: 1677 - DNA, 201 bp, Homo sapiens; identical to SEQ ID NO: 1579

SEQ ID NO: 1678 - DNA, 201 bp, Homo sapiens
ccaaaatgcgatctcaagccgtgagctgctcaggctttcaggcggagcaaagcactggcaccctgggagccggcagcgggtggccagggcgaggccaagcyacacctctgactcacccggtgtgcgccggccgggaagggggcctggttcagccgccgccgccggcgacgagaaccaattctgggaaggagcaagatgggg

SEQ ID NO: 1679 - DNA, 201 bp, Homo sapiens; identical to SEQ ID NO: 1580

SEQ ID NO: 1680 - DNA, 201 bp, Homo sapiens; identical to SEQ ID NO: 1581

SEQ ID NO: 1681 - DNA, 201 bp, Homo sapiens; identical to SEQ ID NO: 1582

SEQ ID NO: 1682 - DNA, 201 bp, Homo sapiens; identical to SEQ ID NO: 1584

SEQ ID NO: 1683 - DNA, 201 bp, Homo sapiens; identical to SEQ ID NO: 1585

SEQ ID NO: 1684 - DNA, 201 bp, Homo sapiens; identical to SEQ ID NO: 1586

SEQ ID NO: 1685 - DNA, 201 bp, Homo sapiens
tgttagctccattctcagggcgtttgaatgtgaattaggaccagcgcaatgaatgctcaagttggggttgggcgttagaattcataaaagtctttatatgrtcagattctgcagctccatcctcttcatgattgtgatcgtaaggacagtggaattttgcagttgtctataccttatcttgaagtagaactaaattgttac

SEQ ID NO: 1686 - DNA, 201 bp, Homo sapiens
ctcatgagaagagtaatctgttatgtttttccagatatttaccatttctgttgctcttccttcattattttccaaatttcgttctgcaaatttccacttcytctgatagacgttttttagttcttttagagtggttctgataggtacagattctcttattttttgcttcctctgaggacatctttttctcaccttcattct

SEQ ID NO: 1687 - DNA, 201 bp, Homo sapiens
tcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtct

SEQ ID NO: 1688 - DNA, 201 bp, Homo sapiens
ctgttacccaggctggagtgcagtggtgcgatctcagctcactgcaacctctgcctcctggttcaagcgattattgtgcctcagcctcctgagtagctggrattacaggcatgcaccaccacagcccagctaattttttgtatttttagtagagacagagttttgctatgttggccaggctggttttgaactcctggcctc

SEQ ID NO: 1689 - DNA, 201 bp, Homo sapiens
gatactgaggtgaagccagtggatctccagcttgtagctgcatcagcccctcctcctttctcaggtgcagcctttgtgaaggagaaccaccggcaactccragccaggatgggggacctgaaaggggtgctcgatgatctccaagacaatgaggttcttactgagaatgagaaggagctggtggagcaggaaaagacacgg

SEQ ID NO: 1690 - DNA, 201 bp, Homo sapiens
gacaccatctggttgagtcagttttttttatggtgtattttgaacccattctgatagtctcttttaactggaagatttcaattacttacgttaatgtaatkattaatatgttaggatttatcctcagtcagccagtttgttatgtcttttctattctactgttatcacatttgtaccacttaaagtggaatctaggcactt

SEQ ID NO: 1691 - DNA, 201 bp, Homo sapiens
gtgtcgtcccactgagtgcattcaccaccttttaaattttggtcactgtatgtatcagttctaaaatttccattttgttctctatattttaaatttcttgscttatattctattttcctgcaaatgtgtcagcatttgcttgtttgagctttttttttttcaagacagggtctcaactctgttacccaggctggagtgcag

SEQ ID NO: 1692 - DNA, 201 bp, Homo sapiens
aaggagtgtccagaaaagagtagcagcagtgaggaagagctgccgagacgggtatacagggagctaccctgtgtttctgagaccctttgtgacatctcacmttttttccaagaagatgatgagacagaggcagagccattattgttccgtgctgttcctgagtgtcaactatctgggggggacattcccaggagacatttg

SEQ ID NO: 1693 - DNA, 201 bp, Homo sapiens
tatgctttgctactctaaacctagtttgaaatcaacagtcttgagaatagatgaaaattttgatgaatagtggaattcttttaaatggaaacctcttacaygtgattttccttgccatctagaaataaaccatagtatttatgttgaatcaatcaatattatgttttgtttttttcctcctcttctgagactcttattgtg

SEQ ID NO: 1694 - DNA, 201 bp, Homo sapiens
ctgagaatgagaaggagctggtggagcaggaaaagacacggcagagcaagaatgaggccttgctgagcatggtggagaagaaaggggacctggccctggaygtgctcttcagaagcattagtgaaagggacccttacctcgtgtcctatcttagacagcagaatttgtaaaatgagtcagttaggtagtctggaagagaga

SEQ ID NO: 1695 - DNA, 201 bp, Homo sapiens
caccatgaacagtggctggtgggcggccccttgtttgatgtcactgcagagccagaggaggctgtcgccgaaatccacctcccccacttcatctccctccraggtgaggtggacgtctcctggtttctcgttgcccattttaagaatgaagggatggtcctggagcatccagcccgggtggagcctttctatgctgtcctg

SEQ ID NO: 1696 - DNA, 201 bp, Homo sapiens
ctgcagcctctgtctcccgggctcaagcgattctcttgcctcagcctcctgagtagctaggactacaggtgcatgccaacacgcccggctaattttttttwaaaaatatttttagtagagacagggtttcaccattttggccaggatggtcttgatctcctgacctcatgatccacccgcctcggccttccaaagtgctgg

SEQ ID NO: 1697 - DNA, 201 bp, Homo sapiens
attctacttatttagaacatcttttcattttttccattattctgattgggtaattttaatttgtctattttcaaatttgctggagtgttcacctgttgttrtctgtgtcgtcccactgagtgcattcaccaccttttaaattttggtcactgtatgtatcagttctaaaatttccattttgttctctatattttaaatttc

SEQ ID NO: 1698 - DNA, 201 bp, Homo sapiens
agtgtatcctgttagctccattctcagggcgtttgaatgtgaattaggaccagcgcaatgaatgctcaagttggggttgggcgttagaattcataaaagtytttatatgctcagattctgcagctccatcctcttcatgattgtgatcgtaaggacagtggaattttgcagttgtctataccttatcttgaagtagaacta

SEQ ID NO: 1699 - DNA, 201 bp, Homo sapiens
tctgaggacatctttttctcaccttcattctcagtgatgttttttgcttgtagtatttttagttgacattgttttctgttcagcagtttccttttagcttmcgtatttcctgatgagaaatctgcagtcattcaaattgttgtttccctgtatgtagtgtgtcatttttctgtcagatttcaaggtatttatctttagttt

SEQ ID NO: 1700 - DNA, 201 bp, Homo sapiens
cagcgcaatgaatgctcaagttggggttgggcgttagaattcataaaagtctttatatgctcagattctgcagctccatcctcttcatgattgtgatcgtraggacagtggaattttgcagttgtctataccttatcttgaagtagaactaaattgttacatttgaagaatgtacttcataaatttacaaaaataaaaaaa

SEQ ID NO: 1701 - DNA, 201 bp, Homo sapiens
gaatgagaaggagctggtggagcaggaaaagacacggcagagcaagaatgaggccttgctgagcatggtggagaagaaaggggacctggccctggacgtgstcttcagaagcattagtgaaagggacccttacctcgtgtcctatcttagacagcagaatttgtaaaatgagtcagttaggtagtctggaagagagaatcc

SEQ ID NO: 1702 - DNA, 201 bp, Homo sapiens
aatagtttcctcttatgcttctaaagtctgttttgagatcgaagaagattataaaaatcgtcagtttctggggcctgaaggaaatgtggatgttgagttgrttgataagagcacaaacagatacagcgtttggttccccactgctggctggtatctgtggtcagccacaggcctcggcttcctggtaagggatgaggtcac

SEQ ID NO: 1703 - DNA, 201 bp, Homo sapiens
cagcccctcctcctttctcaggtgcagcctttgtgaaggagaaccaccggcaactccaagccaggatgggggacctgaaaggggtgctcgatgatctccargacaatgaggttcttactgagaatgagaaggagctggtggagcaggaaaagacacggcagagcaagaatgaggccttgctgagcatggtggagaagaaag

SEQ ID NO: 1704 - DNA, 201 bp, Homo sapiens
tattcagtgtttggtgtccactgagttgtcatttgccagacaagtggagatttttgcagctcatccttgtattctcagtagttccgatatgtaccctcgamatgtgaatgttatcttatgagactctgttttatttgtatccaacagaagatgtttattatttatttggctttctgtgaactgaggtcttaatatcagctc

SEQ ID NO: 1705 - DNA, 201 bp, Homo sapiens
tcggccttccaaagtgctgggattacaggcatgagccaccgtgcctggcctcatttgagtatttttataatgtctcttttaaagtctttgtcagataattycactgtacatgttattcagtgtttggtgtccactgagttgtcatttgccagacaagtggagatttttgcagctcatccttgtattctcagtagttccgat

SEQ ID NO: 1706 - DNA, 201 bp, Homo sapiens
gagacgggtatacagggagctaccctgtgtttctgagaccctttgtgacatctcacattttttccaagaagatgatgagacagaggcagagccattattgwtccgtgctgttcctgagtgtcaactatctgggggggacattcccaggagacatttgctcagaagagaatcaaatagtttcctcttatgcttctaaagtct

SEQ ID NO: 1707 - DNA, 201 bp, Homo sapiens
gggtctcaactctgttacccaggctggagtgcagtggtgcgatctcagctcactgcaacctctgcctcctggttcaagcgattattgtgcctcagcctccwgagtagctgggattacaggcatgcaccaccacagcccagctaattttttgtatttttagtagagacagagttttgctatgttggccaggctggttttgaa

SEQ ID NO: 1708 - DNA, 201 bp, Homo sapiens
atgaatagtggaattcttttaaatggaaacctcttacacgtgattttccttgccatctagaaataaaccatagtatttatgttgaatcaatcaatattatrttttgtttttttcctcctcttctgagactcttattgtggaaatgttagacttttatgttttcctaaatgtccctgatattctacttatttagaacatctt

SEQ ID NO: 1709 - DNA, 201 bp, Homo sapiens
gacaaatggaaaaaaaggagtgtccagaaaagagtagcagcagtgaggaagagctgccgagacgggtatacagggagctaccctgtgtttctgagaccctytgtgacatctcacattttttccaagaagatgatgagacagaggcagagccattattgttccgtgctgttcctgagtgtcaactatctgggggggacattc

SEQ ID NO: 1710 - DNA, 201 bp, Homo sapiens; identical to SEQ ID NO: 1685

SEQ ID NO: 1711 - DNA, 201 bp, Homo sapiens; identical to SEQ ID NO: 1686

SEQ ID NO: 1712 - DNA, 201 bp, Homo sapiens; identical to SEQ ID NO: 1687

SEQ ID NO: 1713 - DNA, 201 bp, Homo sapiens; identical to SEQ ID NO: 1688

SEQ ID NO: 1714 - DNA, 201 bp, Homo sapiens; identical to SEQ ID NO: 1689

SEQ ID NO: 1715 - DNA, 201 bp, Homo sapiens; identical to SEQ ID NO: 1690

SEQ ID NO: 1716 - DNA, 201 bp, Homo sapiens; identical to SEQ ID NO: 1691

SEQ ID NO: 1717 - DNA, 201 bp, Homo sapiens; identical to SEQ ID NO: 1692

SEQ ID NO: 1718 - DNA, 201 bp, Homo sapiens; identical to SEQ ID NO: 1693

SEQ ID NO: 1719 - DNA, 201 bp, Homo sapiens; identical to SEQ ID NO: 1694

SEQ ID NO: 1720 - DNA, 201 bp, Homo sapiens; identical to SEQ ID NO: 1695

SEQ ID NO: 1721 - DNA, 201 bp, Homo sapiens; identical to SEQ ID NO: 1696

SEQ ID NO: 1722 - DNA, 201 bp, Homo sapiens; identical to SEQ ID NO: 1697

SEQ ID NO: 1723 - DNA, 201 bp, Homo sapiens; identical to SEQ ID NO: 1698

SEQ ID NO: 1724 - DNA, 201 bp, Homo sapiens; identical to SEQ ID NO: 1699

SEQ ID NO: 1725 - DNA, 201 bp, Homo sapiens; identical to SEQ ID NO: 1700

SEQ ID NO: 1726 - DNA, 201 bp, Homo sapiens
tggcccgtcctcccctaaagtcaccacctgctgcttttctggagcgcttaccagtgaccaagaggaacagaacacagagcagcctggcagtgtccaagcarcaagcctccgctcctccttcctgcaccctggggctcctgaaactcacatgagaaggagggctgtctgagattcgagggaaacaagctctcaggacttccg

SEQ ID NO: 1727 - DNA, 201 bp, Homo sapiens; identical to SEQ ID NO: 1701

SEQ ID NO: 1728 - DNA, 201 bp, Homo sapiens; identical to SEQ ID NO: 1702

SEQ ID NO: 1729 - DNA, 201 bp, Homo sapiens; identical to SEQ ID NO: 1703

SEQ ID NO: 1730 - DNA, 201 bp, Homo sapiens; identical to SEQ ID NO: 1704

SEQ ID NO: 1731 - DNA, 201 bp, Homo sapiens; identical to SEQ ID NO: 1705

SEQ ID NO: 1732 - DNA, 201 bp, Homo sapiens; identical to SEQ ID NO: 1706

SEQ ID NO: 1733 - DNA, 201 bp, Homo sapiens; identical to SEQ ID NO: 1707

SEQ ID NO: 1734 - DNA, 201 bp, Homo sapiens; identical to SEQ ID NO: 1708

SEQ ID NO: 1735 - DNA, 201 bp, Homo sapiens; identical to SEQ ID NO: 1709

SEQ ID NO: 1736 - DNA, 201 bp, Homo sapiens
cctattggctcttctgaaagatatcagaggtggcttcagtacaagtttttctgtttgttatgtaagcgggaatgtatagaggctagaattcttcatcattytaagatgcatatggaagatggaatttacacctgtccagtttgtattaaaaaatttaagagaaaagaaatgtttgttcctcatgtgatggagcatgttaaa

SEQ ID NO: 1737 - DNA, 201 bp, Homo sapiens
ggaaacattcacagccccggtcatttgatttgaagacttacaaacctatgggatttgaatcttcatttctgaaatttattcaggaaagtgaagagaaagadgatgattttgatgattgggagccttcagagcacttaacattaagtaattcttcacagtccagtaatgatttaacagggaatgttgtggcaaataatatgg

SEQ ID NO: 1738 - DNA, 201 bp, Homo sapiens
gctctcaaaagggtatttgtcctaagagcccctctgcaatcccagagcaaaaccattcattgaatgaccaagccaaaggagagtctcatgaatatgtcacrttcagcaaattagaagattgccacctgcaagacagagatttgtatccatgtcccggtacagactgttcccgtgtgtttaagcaatttaaatacttaagtg

SEQ ID NO: 1739 - DNA, 201 bp, Homo sapiens
cagttaagtcatagctcttcagcttcaatgaatgaagagctaattgacacactagatcactctgaaactatgcaggatgtattgttatctaatgagaaagyctttgggccctccagtttaaaagaaaaatgttccagtatggcagtttgttttgacgggactaagtttacctgtggttttgatggctgtggttccacatac

SEQ ID NO: 1740 - DNA, 201 bp, Homo sapiens
gatgtattgttatctaatgagaaagtctttgggccctccagtttaaaagaaaaatgttccagtatggcagtttgttttgacgggactaagtttacctgtgrttttgatggctgtggttccacatacaaaaatgcaagaggaatgcagaaacatttacggaaggttcatccataccatttcaagcccaaaaagataaagacg

SEQ ID NO: 1741 - DNA, 201 bp, Homo sapiens
agacgaaagatctgtttccctctttgggtaatgaacataatcagacaactgaaaagttggatgcagaacctaaaccctgctcagatacaaacagtgactcyccagatgaaggtctagatcacaatattcacattaaatgtaaacgagaacatcaaggttattcctcagaatcctccatttgtgcttctaaaaggccctgta

SEQ ID NO: 1742 - DNA, 201 bp, Homo sapiens
atgatgaaaatgccaagcactacttggatatgaaaaatagaagagagaagtgtacttactgtcgacgacattttatgtctgcttttcaccttcgagagcaygaacaagtgcattgtgggcctcagccttatatgtgtgtatctatagattgctatgctaggtttggatcagtaaatgaactacttaaccataaacaaaagc

SEQ ID NO: 1743 - DNA, 201 bp, Homo sapiens
tgccatgtgaagtctggctaccattccttcagtctctacaggagtcacatgatgcattattggaatttgggaataataacctacaaatattggttcatgtyaccaaggaaggggtgtggaaaaacccagttcttcttaaaattctgtctcaacagccagtagaaacggaggaagtcaataaattgattgcacaagaaggac

SEQ ID NO: 1744 - DNA, 201 bp, Homo sapiens
gaaagggtgcatagaaagcagctcagtatttgatgcagatactctgctctacaggggaactttgaaatgtaatcatagttccaaaaccacttccctagaasagtgtaatatagttcagcctcctcctccttgtaaaatagaaaattccatacctaatcccaatgggactgaaagtgggacttatttcacaagtttccagct

SEQ ID NO: 1745 - DNA, 201 bp, Homo sapiens
accaaaattaaggaggaacccccttctgaagcagatccctgtataaagaaagaagaaaatagaagctgtgaatcagagcgcacagaacacagccattcccygggtgacagtagtgcacccatccagaacactgattgctgtcattcaagtgaaagggatggaggtcagaaagggtgcatagaaagcagctcagtatttgat

SEQ ID NO: 1746 - DNA, 201 bp, Homo sapiens
gtcattcaagtgaaagggatggaggtcagaaagggtgcatagaaagcagctcagtatttgatgcagatactctgctctacaggggaactttgaaatgtaaycatagttccaaaaccacttccctagaacagtgtaatatagttcagcctcctcctccttgtaaaatagaaaattccatacctaatcccaatgggactgaaa

SEQ ID NO: 1747 - DNA, 201 bp, Homo sapiens
cagattatgaaattcattgtgatcttaatggctgtggccagattttcacccatcgcagtaattactcacaacatgtatattaccgacataaagactattaygatgatttgtttagaagccagaaagtagcaaatgagagactactaaggagtgaaaaggtatgtcaaacagctgatactcaggggcatgaacatcagacca

SEQ ID NO: 1748 - DNA, 201 bp, Homo sapiens
tctaaaaaatgtggcttaatcaaagaaaagaaagccccaataagttttaaaaccagagctgaggccctccatatgtgtgtggagcactctgagcacacacwgtacccctgcatggttcaaggatgcttatctgtggtgaagttggagagcagcattgtgaggcattacaaacgcactcatcagatgagtagtgcctattta

SEQ ID NO: 1749 - DNA, 201 bp, Homo sapiens
agtctaaaaaatgtggcttaatcaaagaaaagaaagccccaataagttttaaaaccagagctgaggccctccatatgtgtgtggagcactctgagcacacwcagtacccctgcatggttcaaggatgcttatctgtggtgaagttggagagcagcattgtgaggcattacaaacgcactcatcagatgagtagtgcctatt

SEQ ID NO: 1750 - DNA, 201 bp, Homo sapiens
taagtctaaaaaatgtggcttaatcaaagaaaagaaagccccaataagttttaaaaccagagctgaggccctccatatgtgtgtggagcactctgagcacwcacagtacccctgcatggttcaaggatgcttatctgtggtgaagttggagagcagcattgtgaggcattacaaacgcactcatcagatgagtagtgccta

SEQ ID NO: 1751 - DNA, 201 bp, Homo sapiens
gcaatcccagagcaaaaccattcattgaatgaccaagccaaaggagagtctcatgaatatgtcacattcagcaaattagaagattgccacctgcaagacaragatttgtatccatgtcccggtacagactgttcccgtgtgtttaagcaatttaaatacttaagtgtgcatcttaaagctgaacaccaaaataatgatgaa

SEQ ID NO: 1752 - DNA, 201 bp, Homo sapiens
gctaagtctaaaaaatgtggcttaatcaaagaaaagaaagccccaataagttttaaaaccagagctgaggccctccatatgtgtgtggagcactctgagcwcacacagtacccctgcatggttcaaggatgcttatctgtggtgaagttggagagcagcattgtgaggcattacaaacgcactcatcagatgagtagtgcc

SEQ ID NO: 1753 - DNA, 201 bp, Homo sapiens
tgttgtttgcgttaagtacggtaccaaaattaaggaggaacccccttctgaagcagatccctgtataaagaaagaagaaaatagaagctgtgaatcagagygcacagaacacagccattccccgggtgacagtagtgcacccatccagaacactgattgctgtcattcaagtgaaagggatggaggtcagaaagggtgcat

SEQ ID NO: 1754 - DNA, 201 bp, Homo sapiens
tttgtattaaaaaatttaagagaaaagaaatgtttgttcctcatgtgatggagcatgttaaaatgccaccaagcagaagggaccgctctaaaaagaaattrctgttaaaaggctctcaaaagggtatttgtcctaagagcccctctgcaatcccagagcaaaaccattcattgaatgaccaagccaaaggagagtctcatg

SEQ ID NO: 1755 - DNA, 201 bp, Homo sapiens
ccccccaggcatcaacggcaaggatgggaccccaggcacgcctggcatgaagggcagtgcaggacaggcgggayrgcccggaagtccaggccaccagggcstagcgggtgtgccaggccagcctgggacaaaaggaggccctggagaccagggtgagccrggcccgcagggccttcctggattctctggtccccctgggaa

SEQ ID NO: 1756 - DNA, 201 bp, Homo sapiens
caggacaggcgggacagcccggaagtccaggccaccagggcctagcgggtgtgccaggccagcctgggacaaaaggaggccctggagaccagggtgagccrggcccgcagggccttcctggattctctggtccccctgggaaagagggagagccagggcctcgaggagaaattggtccccagggcatcatgggacagaagg

SEQ ID NO: 1757 - DNA, 201 bp, Homo sapiens
caaaccagccctgacatgcggagcccgttatagccgccgacagacaaggagctgctgttcagtccgccggccgcagctcacagcgaggcctcatccccctyctctcctttcccctccttgtggggtaggaggcgactcaacccctcaccctgcctctggcacatctggacgcttcttcagggtgacaatgggccccctgga

SEQ ID NO: 1758 - DNA, 201 bp, Homo sapiens
gggagagcggggccccccgggtcccccgggaccgccgggagtgcctggatccgacggcatcgacgcggcgccggcccgcaccacaaggacgccgtttgttytgcaaaaacctcaaaccagccctgacatgcggagcccgttatagccgccgacagacaaggagctgctgttcagtccgccggccgcagctcacagcgaggc

SEQ ID NO: 1759 - DNA, 201 bp, Homo sapiens
aagggagatgtgggtgcctctggagagcaaggcatccctggaccaccgggtccccagggcatcaggggctacccaggcatggcagggcccaagggagagaygggccctcatggatataaaggcatggtgggcgctatcggtgccactgggccaccgggtgaggaaggtcctaggggaccgccaggccgagctggggagaag

SEQ ID NO: 1760 - DNA, 201 bp, Homo sapiens
gtggtgtcgatggagtcgaagcgctgaaggaatagggcggctttccttccagcgagcatcattcggctgttaccaaaacaaacatcttaatctgcaccttyctccactggccatcttgtccttgggtcagtgggacatgggcacctcgggaggcccgggccctgcccagctacagttccacccctcagcttgaggaccaat

SEQ ID NO: 1761 - DNA, 201 bp, Homo sapiens
gacagaagggtgaccaaggcgagaggggtccagtggggcaaccaggccctcagggaaggcagggccctaagggggagcagggcccccccggaattccaggrccccaaggcttgccaggcgtcaaaggagacaagggctccccagggaagaccgggccccgcggcaaagtgggtgacccaggggtggccggcctccccggag

SEQ ID NO: 1762 - DNA, 201 bp, Homo sapiens
gatcacaggcccgaaaggagcaacgggccccccaggcatcaacggcaaggatgggaccccaggcacgcctggcatgaagggcagtgcaggacaggcgggayagcccggaagtccaggccaccagggcctagcgggtgtgccaggccagcctgggacaaaaggaggccctggagaccagggtgagccgggcccgcagggcct

SEQ ID NO: 1763 - DNA, 201 bp, Homo sapiens
atcacaggcccgaaaggagcaacgggccccccaggcatcaacggcaaggatgggaccccaggcacgcctggcatgaagggcagtgcaggacaggcgggacrgcccggaagtccaggccaccagggcctagcgggtgtgccaggccagcctgggacaaaaggaggccctggagaccagggtgagccgggcccgcagggcctt

SEQ ID NO: 1764 - DNA, 181 bp, Homo sapiens
gccagaggagaggggagcaaggtgggcgggagctggggagagcctgcagcaagatctgcagagcccgaggtgctctcggcmtgggccctggagaggacgtagggagccccagcccaccctgcccgcgaacagccagcgctggaggagcgccgggagactctgccgtcggtgcgtgcgcgga

SEQ ID NO: 1765 - DNA, 201 bp, Homo sapiens
agccctgggtgcggtgggcatgatgggtcctccaggacctcctgggccccctgggtacccaggcaagcagggcccccatgggcaccctggccctcggggcrttcctggcatcgtgggagccgtgggtcagatcggcaacacggggcccaagggaaaacgtggagagaagggtgatccaggagaagtgggacgggggcaccc

SEQ ID NO: 1766 - DNA, 201 bp, Homo sapiens
cgcggcgccggcccgcaccacaaggacgccgtttgttctgcaaaaacctcaaaccagccctgacatgcggagcccgttatagccgccgacagacaaggagytgctgttcagtccgccggccgcagctcacagcgaggcctcatccccctcctctcctttcccctccttgtggggtaggaggcgactcaacccctcaccctg

SEQ ID NO: 1767 - DNA, 201 bp, Homo sapiens
acggcaaggatggagatcgagggtccccaggggctccaggagaggcaggtcgacctggcctgccaggccccgtggggctgccgggcttctgtgaacctgcygcctgccttggagcttcggcctatgcctctgcccgccttacagagcctggatccatcaaggggccttgagcatcaggcccagacagagcctggcaggcat

SEQ ID NO: 1768 - DNA, 201 bp, Homo sapiens
tggcaggcatcctggcgggaaggaccaggtcccctctgggtggacatgcacccatccccagtccaggaaaccatctcccccaggaccttctgtctgggacycaggagtcctaaggaaaaggaattctaaaacatgggggaaggggaggtagagcactgatgggtgaaaaagtgaggccaacacacagggcaagtggtgtcg

SEQ ID NO: 1769 - DNA, 201 bp, Homo sapiens
cgccggccgcagctcacagcgaggcctcatccccctcctctcctttcccctccttgtggggtaggaggcgactcaacccctcaccctgcctctggcacatytggacgcttcttcagggtgacaatgggccccctggaaaagctggccctccgggacccaagggcgagcctggcaaagctgggccagatgggccagacggga

SEQ ID NO: 1770 - DNA, 201 bp, Homo sapiens
tgttcagtccgccggccgcagctcacagcgaggcctcatccccctcctctcctttcccctccttgtggggtaggaggcgactcaacccctcaccctgcctytggcacatctggacgcttcttcagggtgacaatgggccccctggaaaagctggccctccgggacccaagggcgagcctggcaaagctgggccagatgggc

SEQ ID NO: 1771 - DNA, 201 bp, Homo sapiens; identical to SEQ ID NO: 1755

SEQ ID NO: 1772 - DNA, 201 bp, Homo sapiens; identical to SEQ ID NO: 1756

SEQ ID NO: 1773 - DNA, 201 bp, Homo sapiens; identical to SEQ ID NO: 1757

SEQ ID NO: 1774 - DNA, 201 bp, Homo sapiens; identical to SEQ ID NO: 1758

SEQ ID NO: 1775 - DNA, 201 bp, Homo sapiens; identical to SEQ ID NO: 1759

SEQ ID NO: 1776 - DNA, 201 bp, Homo sapiens; identical to SEQ ID NO: 1763

SEQ ID NO: 1777 - DNA, 201 bp, Homo sapiens; identical to SEQ ID NO: 1765

SEQ ID NO: 1778 - DNA, 201 bp, Homo sapiens
atccagggcggactcctggcgccgccgcccactctcagtgaccatggacccttcacgttctgagccagtttcttcgactgcaaactggggcccgtaatagsgcccgcctcccggttctgagtattctagaggtccaccgggagagcggggccccccgggtcccccgggaccgccgggagtgcctggatccgacggcatcga

SEQ ID NO: 1779 - DNA, 201 bp, Homo sapiens; identical to SEQ ID NO: 1760

SEQ ID NO: 1780 - DNA, 201 bp, Homo sapiens; identical to SEQ ID NO: 1762

SEQ ID NO: 1781 - DNA, 201 bp, Homo sapiens; identical to SEQ ID NO: 1761

SEQ ID NO: 1782 - DNA, 201 bp, Homo sapiens; identical to SEQ ID NO: 1766

SEQ ID NO: 1783 - DNA, 201 bp, Homo sapiens
tggcgccgccgcccactctcagtgaccatggacccttcacgttctgagccagtttcttcgactgcaaactggggcccgtaatagcgcccgcctcccggttytgagtattctagaggtccaccgggagagcggggccccccgggtcccccgggaccgccgggagtgcctggatccgacggcatcgacgcggcgccggcccgc

SEQ ID NO: 1784 - DNA, 201 bp, Homo sapiens; identical to SEQ ID NO: 1767

SEQ ID NO: 1785 - DNA, 201 bp, Homo sapiens; identical to SEQ ID NO: 1768

SEQ ID NO: 1786 - DNA, 201 bp, Homo sapiens
ccgcgcaagggcaaactggcacagtggaaggagtcgggcagatccagggcggactcctggcgccgccgcccactctcagtgaccatggacccttcacgttytgagccagtttcttcgactgcaaactggggcccgtaatagcgcccgcctcccggttctgagtattctagaggtccaccgggagagcggggccccccgggt

SEQ ID NO: 1787 - DNA, 201 bp, Homo sapiens; identical to SEQ ID NO: 1769

SEQ ID NO: 1788 - DNA, 201 bp, Homo sapiens; identical to SEQ ID NO: 1770

SEQ ID NO: 1789 - DNA, 201 bp, Homo sapiens; identical to SEQ ID NO: 1765

SEQ ID NO: 1790 - DNA, 201 bp, Homo sapiens; identical to SEQ ID NO: 1760

SEQ ID NO: 1791 - DNA, 201 bp, Homo sapiens; identical to SEQ ID NO: 1767

SEQ ID NO: 1792 - DNA, 201 bp, Homo sapiens; identical to SEQ ID NO: 1761

SEQ ID NO: 1793 - DNA, 201 bp, Homo sapiens; identical to SEQ ID NO: 1768

SEQ ID NO: 1794 - DNA, 201 bp, Homo sapiens; identical to SEQ ID NO: 1755

SEQ ID NO: 1795 - DNA, 201 bp, Homo sapiens; identical to SEQ ID NO: 1756

SEQ ID NO: 1796 - DNA, 201 bp, Homo sapiens; identical to SEQ ID NO: 1759

SEQ ID NO: 1797 - DNA, 201 bp, Homo sapiens; identical to SEQ ID NO: 1760

SEQ ID NO: 1798 - DNA, 201 bp, Homo sapiens; identical to SEQ ID NO: 1761

SEQ ID NO: 1799 - DNA, 201 bp, Homo sapiens; identical to SEQ ID NO: 1762

SEQ ID NO: 1800 - DNA, 201 bp, Homo sapiens; identical to SEQ ID NO: 1763

SEQ ID NO: 1801 - DNA, 201 bp, Homo sapiens; identical to SEQ ID NO: 1765

SEQ ID NO: 1802 - DNA, 201 bp, Homo sapiens; identical to SEQ ID NO: 1778

SEQ ID NO: 1803 - DNA, 201 bp, Homo sapiens; identical to SEQ ID NO: 1767

SEQ ID NO: 1804 - DNA, 201 bp, Homo sapiens
tggcgccgccgcccactctcagtgaccatggacccttcacgttctgagccagtttcttcgactgcaaactggggcccgtaatagcgcccgcctcccggttytgagtattctagaggtccaccgggagagcggggccccccgggtcccccgggaccgccgggagtgcctggatccgacggcatcgacggtgacaatgggccc

SEQ ID NO: 1805 - DNA, 201 bp, Homo sapiens; identical to SEQ ID NO: 1786

SEQ ID NO: 1806 - DNA, 201 bp, Homo sapiens; identical to SEQ ID NO: 1768

SEQ ID NO: 1807 - DNA, 201 bp, Homo sapiens; identical to SEQ ID NO: 1755

SEQ ID NO: 1808 - DNA, 201 bp, Homo sapiens; identical to SEQ ID NO: 1756

SEQ ID NO: 1809 - DNA, 201 bp, Homo sapiens; identical to SEQ ID NO: 1759

SEQ ID NO: 1810 - DNA, 201 bp, Homo sapiens; identical to SEQ ID NO: 1760

SEQ ID NO: 1811 - DNA, 201 bp, Homo sapiens; identical to SEQ ID NO: 1761

SEQ ID NO: 1812 - DNA, 201 bp, Homo sapiens; identical to SEQ ID NO: 1762

SEQ ID NO: 1813 - DNA, 201 bp, Homo sapiens; identical to SEQ ID NO: 1763

SEQ ID NO: 1814 - DNA, 104 bp, Homo sapiens
ggcmtccctcccggcaaccccgccggtcctctcagagaggtccaccgggagagcggggccccccgggtcccccgggaccgccgggagtgcctggatccgacggc

SEQ ID NO: 1815 - DNA, 201 bp, Homo sapiens; identical to SEQ ID NO: 1765

SEQ ID NO: 1816 - DNA, 201 bp, Homo sapiens; identical to SEQ ID NO: 1767

SEQ ID NO: 1817 - DNA, 201 bp, Homo sapiens; identical to SEQ ID NO: 1768

SEQ ID NO: 1818 - DNA, 122 bp, Homo sapiens
ggcctccctcccggcaaccccsccggtcctctcagagaggtccaccgggagagcggggccccccgggtcccccgggaccgccgggagtgcctggatccgacggcatcgacggtgacaatggg

SEQ ID NO: 1819 - DNA, 201 bp, Homo sapiens; identical to SEQ ID NO: 1755

SEQ ID NO: 1820 - DNA, 201 bp, Homo sapiens; identical to SEQ ID NO: 1756

SEQ ID NO: 1821 - DNA, 201 bp, Homo sapiens; identical to SEQ ID NO: 1759

SEQ ID NO: 1822 - DNA, 201 bp, Homo sapiens; identical to SEQ ID NO: 1760

SEQ ID NO: 1823 - DNA, 201 bp, Homo sapiens; identical to SEQ ID NO: 1761

SEQ ID NO: 1824 - DNA, 201 bp, Homo sapiens; identical to SEQ ID NO: 1762

SEQ ID NO: 1825 - DNA, 201 bp, Homo sapiens; identical to SEQ ID NO: 1763

SEQ ID NO: 1826 - DNA, 181 bp, Homo sapiens; identical to SEQ ID NO: 1764

SEQ ID NO: 1827 - DNA, 201 bp, Homo sapiens; identical to SEQ ID NO: 1765

SEQ ID NO: 1828 - DNA, 201 bp, Homo sapiens; identical to SEQ ID NO: 1767

SEQ ID NO: 1829 - DNA, 201 bp, Homo sapiens; identical to SEQ ID NO: 1768

SEQ ID NO: 1830 - DNA, 201 bp, Homo sapiens; identical to SEQ ID NO: 1755

SEQ ID NO: 1831 - DNA, 201 bp, Homo sapiens; identical to SEQ ID NO: 1756

SEQ ID NO: 1832 - DNA, 201 bp, Homo sapiens; identical to SEQ ID NO: 1759

SEQ ID NO: 1833 - DNA, 201 bp, Homo sapiens; identical to SEQ ID NO: 1760

SEQ ID NO: 1834 - DNA, 201 bp, Homo sapiens; identical to SEQ ID NO: 1761

SEQ ID NO: 1835 - DNA, 201 bp, Homo sapiens; identical to SEQ ID NO: 1762

SEQ ID NO: 1836 - DNA, 201 bp, Homo sapiens; identical to SEQ ID NO: 1763

SEQ ID NO: 1837 - DNA, 201 bp, Homo sapiens; identical to SEQ ID NO: 1765

SEQ ID NO: 1838 - DNA, 201 bp, Homo sapiens; identical to SEQ ID NO: 1767

SEQ ID NO: 1839 - DNA, 201 bp, Homo sapiens; identical to SEQ ID NO: 1768

SEQ ID NO: 1840 - DNA, 201 bp, Homo sapiens
cagcatcagaacactctctttttagactccgatatggggtcctccaagaaagttactctctcagtgctcagccgggagcagtcggaaggggttggagcgasggtccggagaagcattggcagacccgagttaaaaaatctggatccgtttttactgtttgatgaatttaaaggaggtagaccaggaggatttcctgatcat

SEQ ID NO: 1841 - DNA, 201 bp, Homo sapiens
cattcccgagggcggagccccagggcctccgagacccgtagactcccgcctcccgcctcctctaggccgccggccgcgaagcgctgagtcacggtgaggckactggacccacactctcttaacctgccctccctgcactcgctcccggcggctcttcgcgtcacccccgccgctaaggctccaggtgccgctaccgcagcg

SEQ ID NO: 1842 - DNA, 201 bp, Homo sapiens
ggccggggcattctgcacgctgagatgccttgctcagaggagccagcccatggcctacaactgtgggttaatttgaggagctcagagaagatggtggagcytcagtaccaggaactgaaaagtgaagaaatccctaaacccagtaaggatggtgtgacagttgctgtcatttctggagaagccctgggaataaagtccaag

SEQ ID NO: 1843 - DNA, 201 bp, Homo sapiens
tttacacgatatctggagatgtgtatattgggcccgatgatgcacaacaaaaaatagaacctcatcacacagcagtgcttggagaaggtgacagtgtccargtggagaacaaggatcccaagagaagccactttgtcttaattgctggggagccattaagagaaccagttatccaacatggtccatttgtgatgaacacca

SEQ ID NO: 1844 - DNA, 201 bp, Homo sapiens
atggcccatgaagacttctgtggacacactggtaaaatgaacccaggagatttgcagtggatgactgcgggccggggcattctgcacgctgagatgccttkctcagaggagccagcccatggcctacaactgtgggttaatttgaggagctcagagaagatggtggagcctcagtaccaggaactgaaaagtgaagaaatc

SEQ ID NO: 1845 - DNA, 201 bp, Homo sapiens
tacacgatatctggagatgtgtatattgggcccgatgatgcacaacaaaaaatagaacctcatcacacagcagtgcttggagaaggtgacagtgtccaagyggagaacaaggatcccaagagaagccactttgtcttaattgctggggagccattaagagaaccagttatccaacatggtccatttgtgatgaacaccaat

SEQ ID NO: 1846 - DNA, 195 bp, Homo sapiens
agcaggtcttgatgtgtcctagaattttgccatttctgagattgagccattgaaggcattccatttctaaagcttatttagccggtgcttctaaagaattscacactaacgtgataacatggtttttgtaacaataaatgtaggatatttcctggcacatgcaaataaacctaatcattgtttctttaaaaatca

SEQ ID NO: 1847 - DNA, 201 bp, Homo sapiens; identical to SEQ ID NO: 1840

SEQ ID NO: 1848 - DNA, 201 bp, Homo sapiens; identical to SEQ ID NO: 1842

SEQ ID NO: 1849 - DNA, 201 bp, Homo sapiens; identical to SEQ ID NO: 1843

SEQ ID NO: 1850 - DNA, 201 bp, Homo sapiens; identical to SEQ ID NO: 1844

SEQ ID NO: 1851 - DNA, 201 bp, Homo sapiens; identical to SEQ ID NO: 1845

SEQ ID NO: 1852 - DNA, 195 bp, Homo sapiens; identical to SEQ ID NO: 1846

SEQ ID NO: 1853 - DNA, 201 bp, Homo sapiens
tataccaaattcagctgaggaatatggaagtaactttagacttaaacaagacaaaagttttttcactgaagaattgacaagtatttgctccttaaaacaaygcagattagtgaacgtggattcctgctgagggagtgcatcccataatatggcaataattttcagtttctccaacgaaaagatagtgaaggaattaaatct

SEQ ID NO: 1854 - DNA, 201 bp, Homo sapiens
atttattaaattttaaacaggattgtgcaagcttatgagacaattagataaactcatggaggaggcaggtcctcctgttattagatgattttgtgctcttkgggctgacaataatacactcttgggaagtgatggtagagactgatgggaatagtctttctgcctggttgcaagtcccaaatttttaagggttaatggaag

SEQ ID NO: 1855 - DNA, 201 bp, Homo sapiens
aaagaaagtaaagtgtgttctgttcttatctttttaatgactaagctttaaacagtttattttgggtaagactagaactttcagccatttgttctaatatstgtgttattagatgcaatagaatttatgaaaagaagaatgacaaaggtatctgattagaaaatttgatcttacgcatgaatccatgtcatggccagccac

SEQ ID NO: 1856 - DNA, 201 bp, Homo sapiens
ttttctcctacctaaaaaaaagaaagtaaagtgtgttctgttcttatctttttaatgactaagctttaaacagtttattttgggtaagactagaactttcrgccatttgttctaatatctgtgttattagatgcaatagaatttatgaaaagaagaatgacaaaggtatctgattagaaaatttgatcttacgcatgaatc

SEQ ID NO: 1857 - DNA, 201 bp, Homo sapiens
gggagccggctggggttgccggcaccatggagtcaccttttagcccgggactctttcacaggctggatgaagattgggattctgctctctttgctgaactyggttatttcacagacactgatgagctgcaattggaagcagcaaatgagacgtatgaaaacaattttgataatcttgattttgatttggatttgatgcctt

SEQ ID NO: 1858 - DNA, 201 bp, Homo sapiens
ttcttcaactcagcatgttcctgaggagttggatttgtcttctagttctcagatgtctcccctttccttatatggtgaaaactctaatagtctctcttcascggagccactgaaggaagataagcctgtcactggtcctaggaacaagactgaaaatggactgactccaaagaaaaaaattcaggtgaattcaaaaccttc

SEQ ID NO: 1859 - DNA, 201 bp, Homo sapiens
  misc_feature (1)...(201): n = A,T,C or G, or insertion/deletion polymorphism (see Tables 1-2)
tgaactcggttatttcacagacactgatgagctgcaattggaagcagcaaatgagacgtatgaaaacaattttgataatcttgattttgatttggatttgntgccttgggagtcagacatttgggacatcaacaaccaaatctgtacagttaaagatattaaggcagaacctcagccactttctccagcctcctcaagtta

SEQ ID NO: 1860 - DNA, 201 bp, Homo sapiens
atgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgtta

SEQ ID NO: 1861 - DNA, 201 bp, Homo sapiens
atcaacaaccaaatctgtacagttaaagatattaaggcagaacctcagccactttctccagcctcctcaagttattcagtctcgtctcctcggtcagtggrctcttattcttcaactcagcatgttcctgaggagttggatttgtcttctagttctcagatgtctcccctttccttatatggtgaaaactctaatagtctc

SEQ ID NO: 1862 - DNA, 201 bp, Homo sapiens
cagatattaatcacggagttccagggagaaggaacttgtgaaatgggggagccggctggggttgccggcaccatggagtcaccttttagcccgggactctytcacaggctggatgaagattgggattctgctctctttgctgaactcggttatttcacagacactgatgagctgcaattggaagcagcaaatgagacgtat

SEQ ID NO: 1863 - DNA, 201 bp, Homo sapiens
tggtggggtttggagagaggagatagctccattaatacacatgtttaaaagatggaaagttcacgcctgtaatcccagcactttgggaggccgaggcgggyggatcacgaggtcaggagatcaagaccatcccggctaaaacggtgaaaccccgtctctactaaaaatacaaaaaattagccgggcgtagtgacgggcgcc

SEQ ID NO: 1864 - DNA, 201 bp, Homo sapiens
tgtaaggtgccgcctagagcagcctgggagctttgccttcttttgtctctcactagcccttctactctttgtcattgcctgttcttgagtggatctttgaratgaggggacaggattctcctaagggtagagtttcaggaaatgagtgaaaggcaattgacaaatgcaaagaagtagtcactttttaaattgctggcaaag

SEQ ID NO: 1865 - DNA, 201 bp, Homo sapiens
tctttgagatgaggggacaggattctcctaagggtagagtttcaggaaatgagtgaaaggcaattgacaaatgcaaagaagtagtcactttttaaattgcyggcaaagctataattaatccctaggcacaattgtagtttttattttaatgtttgtatgcacaaggccctttaggaaatgagaagttgccatgccagatta

SEQ ID NO: 1866 - DNA, 201 bp, Homo sapiens
gacagaatcacaggagaaggacccatctcgtggccttcttgttcttagcgcttcacttttacttcatccctcgattcccagctttttctatcatcattttrccaactcctcagatgcaagactttggttatgtcatactcaccaacgttagtccctctcttccaggtgaaaaggtgggtagcggttgggagggagtctcca

SEQ ID NO: 1867 - DNA, 201 bp, Homo sapiens
gtgcaagcttatgagacaattagataaactcatggaggaggcaggtcctcctgttattagatgattttgtgctctttgggctgacaataatacactcttgrgaagtgatggtagagactgatgggaatagtctttctgcctggttgcaagtcccaaatttttaagggttaatggaagtaagtggatgtttcctcatgttaa

SEQ ID NO: 1868 - DNA, 201 bp, Homo sapiens
gtcttctagttctcagatgtctcccctttccttatatggtgaaaactctaatagtctctcttcagcggagccactgaaggaagataagcctgtcactggtyctaggaacaagactgaaaatggactgactccaaagaaaaaaattcaggtgaattcaaaaccttcaattcagcccaagcctttattgcttccagcagcacc

SEQ ID NO: 1869 - DNA, 201 bp, Homo sapiens
ctttattgttgtgttacctgggagtctggagtttgaaaagtgctaattaaccttcctctttttccacattacaaacctttttaagcagcgcagcactcccyttagatttggctatcctgggtgattttcagacaagaaccattttctctggggaccattcttctgctgggtgccaaggaatataaggcaaatgcccagaag

SEQ ID NO: 1870 - DNA, 201 bp, Homo sapiens
ctgagcgtgggaccctgccagactgaagagcaggtgagcaaaatgctgctttctgccttggtggcaggcagagaactgtctcgtactagaattcaaggagraaagaagaagaaataaaagaagctgctccatttttcatcatctacccatctatttggaaagcactggaattcagatgcaagagaacaatgtttcttcagt

SEQ ID NO: 1871 - DNA, 201 bp, Homo sapiens
cttcccattctgtaatgtgaattagccacaccagaggctgtgaccatggctagtagacagtggcaacatagtcatccccaagatgctaatcttctgctggractgtcatacgttatcatggtcaatgtaaacctggtttgtgtggggtgattataaatagagtttccctcctctctgtgacagaatcacaggagaaggacc

SEQ ID NO: 1872 - DNA, 201 bp, Homo sapiens
aaaactctcaagctctttgccactttcctactattttttgattcttgccattttaccaagcttaggttgtgaaacttgacagaaatgtattacaggaaaarcttataattgtatttgactttctaacacattgcaaagtttcaaagtgactttcactttcaacaacatattagaagtaaccacttttgctttcacagcctg

SEQ ID NO: 1873 - DNA, 201 bp, Homo sapiens
acagatatgatcattctgtttcaaatgacaaagccctgatggtgctaactgaagaaccattgctttacattcctccacctccttgtcagcccctaattaayacaacagagtctctcaggttaaatcatgaacttcgaggatgggttcatagacatgaagtagaaaggaccaagtcaagaagaatgacaaataatcaacaga

SEQ ID NO: 1874 - DNA, 201 bp, Homo sapiens
gacttatgcccagcagtacagggacacagcttcattagagtgttagtgtaaactaactccaaagttaggagttaatgtgaaaggatcatccttgaaacaartctgctgtttgccatgcttgtagtacagaaacttcacatggagttttgggtgggatttgtgttttcacaagtaaaaaatccctcacgattataaaactca

SEQ ID NO: 1875 - DNA, 201 bp, Homo sapiens
gcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagagaaccagaggcttaaagtccctagtccaaagcgaag

SEQ ID NO: 1876 - DNA, 201 bp, Homo sapiens
cacctccttgtcagcccctaattaacacaacagagtctctcaggttaaatcatgaacttcgaggatgggttcatagacatgaagtagaaaggaccaagtcwagaagaatgacaaataatcaacagaaaacccgtattcttcagggtgctctggaacagggctcaaattctcagctgatggctgttcaatacacagaaacca

SEQ ID NO: 1877 - DNA, 201 bp, Homo sapiens
ttgtgctctttgggctgacaataatacactcttgggaagtgatggtagagactgatgggaatagtctttctgcctggttgcaagtcccaaatttttaaggsttaatggaagtaagtggatgtttcctcatgttaactactgaatcagatgttaggagcttgtccctttggggttgacttatgcccagcagtacagggacac

SEQ ID NO: 1878 - DNA, 121 bp, Homo sapiens
gcaaaagtagtttgtctttamtaggccaccgtctcgtcagcgttacggagtattttgtccgcctgccgccgccgtcccagatattaatcacggagttccagggagaaggaacttgtgaaat

SEQ ID NO: 1879 - DNA, 201 bp, Homo sapiens
acataaatgagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatcc

SEQ ID NO: 1880 - DNA, 201 bp, Homo sapiens
caaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctatgccacacatgcatgttca

SEQ ID NO: 1881 - DNA, 104 bp, Homo sapiens
gcaraagtagtttgtctttactaggccaccgtctcgtcagcgttacggagtattttgtccgcctgccgccgccgtcccagatattaatcacggagttccaggga

SEQ ID NO: 1882 - DNA, 201 bp, Homo sapiens
ttgataatcttgattttgatttggatttgatgccttgggagtcagacatttgggacatcaacaaccaaatctgtacagttaaagatattaaggcagaaccycagccactttctccagcctcctcaagttattcagtctcgtctcctcggtcagtggactcttattcttcaactcagcatgttcctgaggagttggatttgt

SEQ ID NO: 1883 - DNA, 201 bp, Homo sapiens
agtcagacatttgggacatcaacaaccaaatctgtacagttaaagatattaaggcagaacctcagccactttctccagcctcctcaagttattcagtctcrtctcctcggtcagtggactcttattcttcaactcagcatgttcctgaggagttggatttgtcttctagttctcagatgtctcccctttccttatatggtg

SEQ ID NO: 1884 - DNA, 201 bp, Homo sapiens
gcttctgtcctctgggctggggtggccagcctgctcctccccccggccatgacccagcagctcagaggggatgggctgggcttcagaaaccggaacaacarcactggagtcgccgggctctccgaggaggcatcagcagagcttcgccaccacctccacagccctagagaccatccagatgagaacaaggatgtttccaca

SEQ ID NO: 1885 - DNA, 201 bp, Homo sapiens
aagggacaaagaccccaacgtttgtccacattgccgcagaggcagctggagccagtgctgcctgtccgtccccatgggccaccataggccatggctgcacrcttctgtcctctgggctggggtggccagcctgctcctccccccggccatgacccagcagctcagaggggatgggctgggcttcagaaaccggaacaacaa

SEQ ID NO: 1886 - DNA, 201 bp, Homo sapiens
gccaccataggccatggctgcacgcttctgtcctctgggctggggtggccagcctgctcctccccccggccatgacccagcagctcagaggggatgggctrggcttcagaaaccggaacaacaacactggagtcgccgggctctccgaggaggcatcagcagagcttcgccaccacctccacagccctagagaccatccag

SEQ ID NO: 1887 - DNA, 201 bp, Homo sapiens
agctggagccagtgctgcctgtccgtccccatgggccaccataggccatggctgcacgcttctgtcctctgggctggggtggccagcctgctcctcccccyggccatgacccagcagctcagaggggatgggctgggcttcagaaaccggaacaacaacactggagtcgccgggctctccgaggaggcatcagcagagctt

SEQ ID NO: 1888 - DNA, 201 bp, Homo sapiens
ggaagaggaggaggaggaggggctggaggaagatgagccccgcttcaccatcatccccaacccactggacaggagagaggaggctggaggtgcctccagcraggaggaaagcggtgaggacacaggtccacaggatgctcaggagtatgggaactaccagccagggtccctgtgtggctactgctccttctgcaatcgatg

SEQ ID NO: 1889 - DNA, 201 bp, Homo sapiens
cagccctagagaccatccagatgagaacaaggatgtttccacagagaatgggcatcatttctggagccacccagaccgtgaaaaggaggatgaagatgtckccaaggaatatgggcacctactcccaggccacaggtcccaagaccacaaagtcggagatgagggtgtctcaggtgaggaggtctttgcagagcatggtgg

SEQ ID NO: 1890 - DNA, 201 bp, Homo sapiens
atgaggatgtgtccactgaacgttggcaccagggtccccaacatgtccaccatggccttgtagatgaggaagaggaagaagaggagatcacagtccagttyggccactatgttgcaagccaccaacctcgaggccacaagagtgatgaagaggacttccaagatgagtataaaacagaagtccctcaccatcaccaccaca

SEQ ID NO: 1891 - DNA, 201 bp, Homo sapiens
caggccacaggtcccaagaccacaaagtcggagatgagggtgtctcaggtgaggaggtctttgcagagcatggtgggcaggcccgtgggcacagaggccaygggagtgaagacacggaagactcagctgagcacaggcaccacctccccagccacaggagccacagccatcaagacgaggatgaggatgaagttgtgtcca

SEQ ID NO: 1892 - DNA, 201 bp, Homo sapiens
accttcaagcgggagaacaagaaccttcaggaggaaatctcggaccttactgagcagctaggagaaggaggaaagaatgtgcatgagctggagaaggtcckcaaacagctggaggtggagaagctggagctgcagtcagccctggaggaggcagaggcctccctggagcacgaggagggcaagatcctccgggcccagcta

SEQ ID NO: 1893 - DNA, 201 bp, Homo sapiens
acctcaaggagcgctacgcggcctggatgatatatacctactcgggcctcttctgtgtcactgtcaacccctacaagtggctgccggtgtacaatgccgargtggtggccgcctaccggggcaagaagaggagtgaggccccgccccacatcttctccatctccgacaacgcctatcagtacatgctgacagatcgggaga

SEQ ID NO: 1894 - DNA, 201 bp, Homo sapiens
tcaccaaggggcagagcgtgcagcaggtgtactactccatcggggctctggccaaggcagtgtatgagaagatgttcaactggatggtgacgcgcatcaaygccaccctggagaccaagcagccacgccagtacttcataggagtcctggacatcgctggcttcgagatcttcgacttcaacagctttgagcagctctgca

SEQ ID NO: 1895 - DNA, 201 bp, Homo sapiens
atcctccgggcccagctagagttcaaccagatcaaggcagagatcgagcggaagctggcagagaaggacgaggagatggaacaggccaagcgcaaccaccwgcgggtggtggactcgctgcagacctccctggatgcagagacacgcagccgcaacgaggtcctgagggtgaagaagaagatggaaggagacctcaatgag

SEQ ID NO: 1896 - DNA, 201 bp, Homo sapiens
cgcggcctggatgatatatacctactcgggcctcttctgtgtcactgtcaacccctacaagtggctgccggtgtacaatgccgaggtggtggccgcctacmggggcaagaagaggagtgaggccccgccccacatcttctccatctccgacaacgcctatcagtacatgctgacagatcgggagaaccagtccatcctcat

SEQ ID NO: 1897 - DNA, 201 bp, Homo sapiens
ctcgctccctcagcacagagctcttcaagctcaagaacgcctacgaggagtccctggagcacctagagaccttcaagcgggagaacaagaaccttcaggargaaatctcggaccttactgagcagctaggagaaggaggaaagaatgtgcatgagctggagaaggtccgcaaacagctggaggtggagaagctggagctgc

SEQ ID NO: 1898 - DNA, 201 bp, Homo sapiens
cccagaacaccagcctcatcaaccagaagaagaagatggagtcggatctgacccagctccagtcggaagtggaggaggcagtgcaggagtgcagaaacgcygaggagaaggccaagaaggccatcacggatgccgccatgatggcagaggagctgaagaaggagcaggacaccagcgcccacctggagcgcatgaagaaga

SEQ ID NO: 1899 - DNA, 201 bp, Homo sapiens
agctggcggagcaggagctgattgagaccagcgagcgggtgcagctgctgcattcccagaacaccagcctcatcaaccagaagaagaagatggagtcggayctgacccagctccagtcggaagtggaggaggcagtgcaggagtgcagaaacgccgaggagaaggccaagaaggccatcacggatgccgccatgatggcag

SEQ ID NO: 1900 - DNA, 201 bp, Homo sapiens
gcgtctagaggcccagacccggccctttgacattcgcactgagtgcttcgtgcccgatgacaaggaagagtttgtcaaagccaagattttgtcccgggagrgaggcaaggtcattgctgaaaccgagaatgggaagacggtgactgtgaaggaggaccaggtgttgcagcagaacccacccaagttcgacaagattgagga

SEQ ID NO: 1901 - DNA, 201 bp, Homo sapiens
caaaaacaagattcagctggaggccaaagtaaaggagatgaatgagaggctggaggatgaggaggagatgaacgcggagctcactgccaagaagcgcaagytggaagacgagtgctcagagctcaagaaggacattgatgacctggagctgacactggccaaggtggagaaggagaagcatgcaacagagaacaaggtgaa

SEQ ID NO: 1902 - DNA, 201 bp, Homo sapiens
ccgtggaggctgttaatgccaagtgctcctcactggagaagaccaagcaccggctacagaatgagatagaggacttgatggtggacgtagagcgctccaaygctgctgctgcagccctggacaagaagcagagaaactttgacaagatcctggccgagtggaagcagaagtatgaggagtcgcagtctgagctggagtcct

SEQ ID NO: 1903 - DNA, 201 bp, Homo sapiens
ccgcgtgaagctagaagaggcccaacgctccctcaatgatttcaccacccagcgagccaagctgcagaccgagaatggagagttggcccggcagctagagsaaaaggaggcgctaatctcgcagctgacccgggggaagctctcttatacccagcaaatggaggacctcaaaaggcagctggaggaggagggcaaggcgaa

SEQ ID NO: 1904 - DNA, 201 bp, Homo sapiens
cagagacacgcagccgcaacgaggtcctgagggtgaagaagaagatggaaggagacctcaatgagatggagatccagctcagccacgccaaccgcatggcygccgaggcccagaagcaagtcaagagcctccagagcttgctgaaggacacccagatccagctggacgatgcggtccgtgccaacgacgacctgaaggaga

SEQ ID NO: 1905 - DNA, 201 bp, Homo sapiens
tggaggctgttaatgccaagtgctcctcactggagaagaccaagcaccggctacagaatgagatagaggacttgatggtggacgtagagcgctccaatgcygctgctgcagccctggacaagaagcagagaaactttgacaagatcctggccgagtggaagcagaagtatgaggagtcgcagtctgagctggagtcctcac

SEQ ID NO: 1906 - DNA, 201 bp, Homo sapiens
agcccgcggtgcttttcaacctcaaggagcgctacgcggcctggatgatatatacctactcgggcctcttctgtgtcactgtcaacccctacaagtggctrccggtgtacaatgccgaggtggtggccgcctaccggggcaagaagaggagtgaggccccgccccacatcttctccatctccgacaacgcctatcagtaca

SEQ ID NO: 1907 - DNA, 201 bp, Homo sapiens
atcatggacctggaaaatgataaactgcagctggaagaaaagcttaagaagaaggagtttgacattaatcagcagaacagtaagattgaggatgagcaggygctggcccttcaactacagaagaaactgaaggaaaaccaggcacgcatcgaggagctggaggaggagctggaggccgagcgcaccgccagggctaaggtg

SEQ ID NO: 1908 - DNA, 201 bp, Homo sapiens
ctctctggacattgatcacaaccagtacaagtttggccacaccaaggtgttcttcaaggcagggctgcttgggctgctggaggagatgcgggatgagaggmtgagccgcatcatcacgcgcatgcaggcccaagcccggggccagctcatgcgcattgagttcaagaagatagtggaacgcagggatgccctgctggtaat

SEQ ID NO: 1909 - DNA, 201 bp, Homo sapiens
tgaggatgagcaggtgctggcccttcaactacagaagaaactgaaggaaaaccaggcacgcatcgaggagctggaggaggagctggaggccgagcgcaccrccagggctaaggtggagaagctgcgctcagacctgtctcgggagctggaggagatcagcgagcggctggaagaggccggcggggccacgtccgtgcagat

SEQ ID NO: 1910 - DNA, 201 bp, Homo sapiens
ggaagctggcggagcaggagctgattgagaccagcgagcgggtgcagctgctgcattcccagaacaccagcctcatcaaccagaagaagaagatggagtckgatctgacccagctccagtcggaagtggaggaggcagtgcaggagtgcagaaacgccgaggagaaggccaagaaggccatcacggatgccgccatgatgg

SEQ ID NO: 1911 - DNA, 201 bp, Homo sapiens
cacaccaaggtgttcttcaaggcagggctgcttgggctgctggaggagatgcgggatgagaggctgagccgcatcatcacgcgcatgcaggcccaagcccrgggccagctcatgcgcattgagttcaagaagatagtggaacgcagggatgccctgctggtaatccagtggaacattcgggccttcatgggggtcaagaat

SEQ ID NO: 1912 - DNA, 201 bp, Homo sapiens
cccttcaactacagaagaaactgaaggaaaaccaggcacgcatcgaggagctggaggaggagctggaggccgagcgcaccgccagggctaaggtggagaarctgcgctcagacctgtctcgggagctggaggagatcagcgagcggctggaagaggccggcggggccacgtccgtgcagatcgagatgaacaagaagcgcg

SEQ ID NO: 1913 - DNA, 201 bp, Homo sapiens
ggagggaggcaaggtcattgctgaaaccgagaatgggaagacggtgactgtgaaggaggaccaggtgttgcagcagaacccacccaagttcgacaagattsaggacatggccatgctgaccttcctgcacgagcccgcggtgcttttcaacctcaaggagcgctacgcggcctggatgatatatacctactcgggcctctt

SEQ ID NO: 1914 - DNA, 201 bp, Homo sapiens
cccgggggaagctctcttatacccagcaaatggaggacctcaaaaggcagctggaggaggagggcaaggcgaagaacgccctggcccatgcactgcagtcrgcccggcatgactgcgacctgctgcgggagcagtacgaggaggagacagaggccaaggccgagctgcagcgcgtcctgtccaaggccaactcggaggtgg

SEQ ID NO: 1915 - DNA, 201 bp, Homo sapiens
actcagctgacctgctcaaggggctgtgccaccctcgggtgaaagtgggcaacgagtatgtcaccaaggggcagagcgtgcagcaggtgtactactccatyggggctctggccaaggcagtgtatgagaagatgttcaactggatggtgacgcgcatcaacgccaccctggagaccaagcagccacgccagtacttcatag

SEQ ID NO: 1916 - DNA, 201 bp, Homo sapiens
cagaggagaaagctggcgtctacaagctgacgggagccatcatgcactacgggaacatgaagttcaagcagaagcagcgggaggagcaggcggagccagasggcaccgaagatgctgacaagtcggcctacctcatggggctgaactcagctgacctgctcaaggggctgtgccaccctcgggtgaaagtgggcaacgagt

SEQ ID NO: 1917 - DNA, 201 bp, Homo sapiens
ctacaggacctggtggacaagctgcaactgaaggtcaaggcctacaagcgccaggccgaggaggcggaggagcaagccaacaccaacctgtccaagttccrcaaggtgcagcatgagctggatgaggcagaggagcgggcggacatcgctgagtcccaggtcaacaagcttcgagccaagagccgtgacattggtgccaag

SEQ ID NO: 1918 - DNA, 201 bp, Homo sapiens
tccggaacgacaactcctcccgctttgggaaattcattaggatccactttggggccactggaaagctggcttctgcagacatagagacctacctgctggaraagtcccgggtgatcttccagctgaaagctgagagaaactaccacatcttctaccagattctgtccaacaagaagccggagttgctggacatgctgctgg

SEQ ID NO: 1919 - DNA, 201 bp, Homo sapiens
acttcagaggagaaagctggcgtctacaagctgacgggagccatcatgcactacgggaacatgaagttcaagcagaagcagcgggaggagcaggcggagcmagacggcaccgaagatgctgacaagtcggcctacctcatggggctgaactcagctgacctgctcaaggggctgtgccaccctcgggtgaaagtgggcaac

SEQ ID NO: 1920 - DNA, 201 bp, Homo sapiens
tggagatccagctcagccacgccaaccgcatggctgccgaggcccagaagcaagtcaagagcctccagagcttgctgaaggacacccagatccagctggaygatgcggtccgtgccaacgacgacctgaaggagaacatcgccatcgtggagcggcgcaacaacctgctgcaggctgagctggaggagctgcgtgccgtgg

SEQ ID NO: 1921 - DNA, 201 bp, Homo sapiens
gagaaggacgaggagatggaacaggccaagcgcaaccaccagcgggtggtggactcgctgcagacctccctggatgcagagacacgcagccgcaacgaggycctgagggtgaagaagaagatggaaggagacctcaatgagatggagatccagctcagccacgccaaccgcatggctgccgaggcccagaagcaagtcaag

SEQ ID NO: 1922 - DNA, 201 bp, Homo sapiens
agacctccctggatgcagagacacgcagccgcaacgaggtcctgagggtgaagaagaagatggaaggagacctcaatgagatggagatccagctcagccaygccaaccgcatggctgccgaggcccagaagcaagtcaagagcctccagagcttgctgaaggacacccagatccagctggacgatgcggtccgtgccaacg

SEQ ID NO: 1923 - DNA, 201 bp, Homo sapiens
cttcagaggagaaagctggcgtctacaagctgacgggagccatcatgcactacgggaacatgaagttcaagcagaagcagcgggaggagcaggcggagccmgacggcaccgaagatgctgacaagtcggcctacctcatggggctgaactcagctgacctgctcaaggggctgtgccaccctcgggtgaaagtgggcaacg

SEQ ID NO: 1924 - DNA, 201 bp, Homo sapiens
ggcggagcaggagctgattgagaccagcgagcgggtgcagctgctgcattcccagaacaccagcctcatcaaccagaagaagaagatggagtcggatctgwcccagctccagtcggaagtggaggaggcagtgcaggagtgcagaaacgccgaggagaaggccaagaaggccatcacggatgccgccatgatggcagagga

SEQ ID NO: 1925 - DNA, 201 bp, Homo sapiens
tctactgtggtgttggagcaggacaataaagtccactagaaatgcaccccagaaccagctgccgtgtccatcttgtcttgaggggcttggtggtggaaccygttctcactccagtctgttccaatttttgctttatttggaaataattgggtatttttcttggctgtgaataagaacaaatgctctctacctcagcgtctg

SEQ ID NO: 1926 - DNA, 201 bp, Homo sapiens
gttggcagggtgctggttcactctgcccagccctgaatgtgtgccttaaaggccccctacaaggggccccatacgacagagcttttaactggtgccttccstgtacccgcagcagccacaagtgggcccagactattgcagcctcccataaacatgtgagcatgttctgagtgtgccatgatgtgagtggacctggctgga

SEQ ID NO: 1927 - DNA, 201 bp, Homo sapiens
gcttgggtccagtggaggaagaaggaaggagaggcttggaaagccttgtgtcttgggaacaaaaggcctttgagcatatgggtccagccactcagaagtgyaggggccatgccttggtgttccaataagtgaatggaagcagtggtggtagctacactgggcagagttggcagggtgctggttcactctgcccagccctga

SEQ ID NO: 1928 - DNA, 201 bp, Homo sapiens
agctcctcccagtactgccgccccatctccacccagagcatcaccagcacagactcaggagacagcgaagagaactatgtccctatgcaaaacccagtgtstgcatctcccgttcccagtggcacgaacagtcctgcccctaagaagagcaccggcagcgttgattatctggccctggacttccagccgagctccccaagc

SEQ ID NO: 1929 - DNA, 201 bp, Homo sapiens
agaaggggatgagtcagatttttacagaggaggagggcagggcttgggtccagtggaggaagaaggaaggagaggcttggaaagccttgtgtcttgggaamaaaaggcctttgagcatatgggtccagccactcagaagtgcaggggccatgccttggtgttccaataagtgaatggaagcagtggtggtagctacactgg

SEQ ID NO: 1930 - DNA, 201 bp, Homo sapiens
aaggacaaggacatgagacagtggtgatggccatcagacagagacttcaaatgctgatggagggcagaggaagtacttagggaggttggtgtcagaggcasgagtgggggatcagggaaggtggattctaggaaaagggagtgcctgaggtaggccttagaaggggatgagtcagatttttacagaggaggagggcagggc

SEQ ID NO: 1931 - DNA, 201 bp, Homo sapiens
tggggtcgggaagtgagtttctttgcagtgagcagtgcagtggaagtcgggcacagaggtagcagacagatgtgaagcagtggtgaaggccatgtagcaastggggaaatacatccaaagggcctgggagttggggggtgcccaacgcaatccttgggggtgcagggtggagcagaaagtgaaggagggacacgtgcaaga

SEQ ID NO: 1932 - DNA, 201 bp, Homo sapiens
gtagacaatatggatgttccggccaccccactctcagcctaccagatccctaggacattcactctggacaaaaaccacaatgccatgacagtggccactcytggggactcagccatagctcccccaccccgcccccccaagccaagtcaggcagaaacacctcgatggggcagtcctcagcagagaccgccaatcagtgaa

SEQ ID NO: 1933 - DNA, 201 bp, Homo sapiens
aagcccagtcttgagttcttgtcttgttaccatttaaaattgacatttaattttcaaatcactgttggtgcctaatcacttaagttattaatttattctgwtgtattcttttttttaaattgtaacatatttatccggtgggtgggacaggagtgtgttcaagtgggtcatgtttttgctgtggtgacacatggtacaggc

SEQ ID NO: 1934 - DNA, 201 bp, Homo sapiens
ttctccctgaacttaagatagccacaatcagaaaaaggacaaggacatgagacagtggtgatggccatcagacagagacttcaaatgctgatggagggcasaggaagtacttagggaggttggtgtcagaggcaggagtgggggatcagggaaggtggattctaggaaaagggagtgcctgaggtaggccttagaagggga

SEQ ID NO: 1935 - DNA, 201 bp, Homo sapiens
ctaaggacacaagaatcaatcagaccttctccctgaacttaagatagccacaatcagaaaaaggacaaggacatgagacagtggtgatggccatcagacasagacttcaaatgctgatggagggcagaggaagtacttagggaggttggtgtcagaggcaggagtgggggatcagggaaggtggattctaggaaaagggag

SEQ ID NO: 1936 - DNA, 201 bp, Homo sapiens
cccattcccctttcagctcccatgagcatgcatagttcaccagaccaatggcctagccattctctaagtcccatcctggaagaagttatttcttcaagagstgcacctctcctcctagcattagtttagatcaactcaaggagtatttattaatggctgctgtctccagtttctggggttaagcactaaggacacaagaat

SEQ ID NO: 1937 - DNA, 201 bp, Homo sapiens
ggttccttctcttaaactaagggtgggggatctgaatgtttttatgttgactgttcttgactaaattttcaagagtttcagaagcaacaggacagaccagrcgtttcattctaccctggggcgaacagaacttcttcctcccaaacaatgacttcctgccatgtttgatggggacagctaccactgtcctctgcccccatt

SEQ ID NO: 1938 - DNA, 166 bp, Homo sapiens
ggcctcccgcgagctgcgcaccgccggccgctgccccagctgcccgagcccgcgccctcgtccgcrcgacccggcggggggctccaggccggcagcatgagcggcggcggcgacgtggtgtgcaccggctggctgaggaaatcgcctcccgagaagaagttgaggc

SEQ ID NO: 1939 - DNA, 201 bp, Homo sapiens
agagcatctgccagatctgtggcttcaatcaggctgaggagagcacagactccctgagaaatgtttcctcagccggtcatggcccccgctcttctccagcygagctcagcagctctagccagcaccttctccgagagcgcaagtcctcagccccatcacactccagccagccaactctgttcacgtttgaaccccctgtgt

SEQ ID NO: 1940 - DNA, 201 bp, Homo sapiens
aatgcaggggaagccagactggtctcaggagcgctaaagcccttccgtggggggtcgtctttctgggactagccctgctgtttaggacctgggaccacaayggggtacctgccgagggggtccccaagagatccaggctgtcatgtgatttatggtggcatgtgttgtgtatttgttggctacttgtgtcttgaaatctag

SEQ ID NO: 1941 - DNA, 201 bp, Homo sapiens
gtgggtcatgtttttgctgtggtgacacatggtacaggcttggagcttgcaggtccctttctactgtggtgttggagcaggacaataaagtccactagaartgcaccccagaaccagctgccgtgtccatcttgtcttgaggggcttggtggtggaacccgttctcactccagtctgttccaatttttgctttatttggaa

SEQ ID NO: 1942 - DNA, 201 bp, Homo sapiens
tcacctctgatgagaaggtggactacgttcaggtggacaaggagaagacccaggccctgcagaacaccatgcaggagtggacagacgtgcggcagtcctcrgagccttccaagggtgccaagctgtgatgagagggccaccgcagagcccaggaggcagcatctccagagctggcccttcccatctcccctctcccctctc

SEQ ID NO: 1943 - DNA, 201 bp, Homo sapiens
tcccaaacaatgacttcctgccatgtttgatggggacagctaccactgtcctctgcccccattcccctttcagctcccatgagcatgcatagttcaccagmccaatggcctagccattctctaagtcccatcctggaagaagttatttcttcaagagctgcacctctcctcctagcattagtttagatcaactcaaggagt

SEQ ID NO: 1944 - DNA, 201 bp, Homo sapiens
gggacagctaccactgtcctctgcccccattcccctttcagctcccatgagcatgcatagttcaccagaccaatggcctagccattctctaagtcccatcstggaagaagttatttcttcaagagctgcacctctcctcctagcattagtttagatcaactcaaggagtatttattaatggctgctgtctccagtttctgg

SEQ ID NO: 1945 - DNA, 201 bp, Homo sapiens
cccagatgttctggaatactacaagaacgatcactccaagaagcctctgcggatcatcaacctgaacttctgtgagcaggtagatgcaggcctgacctttracaagaaggagctgcaggatagttttgtgtttgacatcaagaccagtgaacgcaccttttacctggtggctgagacagaagaggacatgaataagtgggt

SEQ ID NO: 1946 - DNA, 201 bp, Homo sapiens
cctcccatggccacaccaagggcagcctcacaggctccgagacagataatgaggatgtgtacaccttcaagacgcccagcaacaccctgtgcagggagttyggggacctcctggtagacaatatggatgttccggccaccccactctcagcctaccagatccctaggacattcactctggacaaaaaccacaatgccatga

SEQ ID NO: 1947 - DNA, 201 bp, Homo sapiens
gaatgggaggttggattagctgcgctgaggtcccatccacagctggtgctcagctgcttgaaggggagactccctcctctgtaacttctttctgggggatyggggtgggcagtacctatccccagtcccctcctagcttgactttagtggtttccaatgtagaagttaacaaagtatgccccattcctgtgacaaaagcac

SEQ ID NO: 1948 - DNA, 201 bp, Homo sapiens
ccagccccctattctggtaactaccaaaatccctcgggtgcaagtgtaggggtagagatggaaggatgagaggtgaaattgaccttttgaaagcaaagctstggctcacaggccccaaactaccagccgtatctagcatatccccaccctccacccactacctcctccaacaaaggagtcaactcagttgaaaaaactggt

SEQ ID NO: 1949 - DNA, 201 bp, Homo sapiens
tcggagagcgactgaggtgttcaaatcgaatctcccaggaggcttccttccagccccctattctggtaactaccaggaggcttccttccagccccctattstggtaactaccaaaatccctcgggtgcaagtgtaggggtagagatggaaggatgagaggtgaaattgaccttttgaaagcaaagctctggctcacaggcc

SEQ ID NO: 1950 - DNA, 201 bp, Homo sapiens
tccgagagcgcaagtcctcagccccatcacactccagccagccaactctgttcacgtttgaaccccctgtgtcaaaccacatgcagcccaccttgtccacyagcgcacctcaggagtatctctacttgcaccagtgcataagccgaagagcagaaaatgcaaggagtgccagcttctctcagggcaccagagcctcttttc

SEQ ID NO: 1951 - DNA, 201 bp, Homo sapiens
cccaaggttccttctcttaaactaagggtgggggatctgaatgtttttatgttgactgttcttgactaaattttcaagagtttcagaagcaacaggacagmccagacgtttcattctaccctggggcgaacagaacttcttcctcccaaacaatgacttcctgccatgtttgatggggacagctaccactgtcctctgccc

SEQ ID NO: 1952 - DNA, 201 bp, Homo sapiens
gagcttgcaggtccctttctactgtggtgttggagcaggacaataaagtccactagaaatgcaccccagaaccagctgccgtgtccatcttgtcttgaggrgcttggtggtggaacccgttctcactccagtctgttccaatttttgctttatttggaaataattgggtatttttcttggctgtgaataagaacaaatgct

SEQ ID NO: 1953 - DNA, 201 bp, Homo sapiens
cctccccaggtttgaaaggccatcagattagcagggacggggtgtagggcatcacccaaggttccttctcttaaactaagggtgggggatctgaatgtttwtatgttgactgttcttgactaaattttcaagagtttcagaagcaacaggacagaccagacgtttcattctaccctggggcgaacagaacttcttcctccc

SEQ ID NO: 1954 - DNA, 201 bp, Homo sapiens
cattccaggagccatcttggactctcctccccaggtttgaaaggccatcagattagcagggacggggtgtagggcatcacccaaggttccttctcttaaamtaagggtgggggatctgaatgtttttatgttgactgttcttgactaaattttcaagagtttcagaagcaacaggacagaccagacgtttcattctaccct

SEQ ID NO: 1955 - DNA, 201 bp, Homo sapiens
gagcagggcttggagctcgggtggtggagatgacaaggacactgtggggtctgggtccccagaactctggagctacaggccactctaggcccaagggctaktcctcttccccagtcccctcagaggcccccgccagccccaccttgaaagcagcatacaggggaaggcttggaccaagctgggcgaccaagcacatggggc

SEQ ID NO: 1956 - DNA, 201 bp, Homo sapiens
ctagagcagcaaggagcagggcttggagctcgggtggtggagatgacaaggacactgtggggtctgggtccccagaactctggagctacaggccactctakgcccaagggctagtcctcttccccagtcccctcagaggcccccgccagccccaccttgaaagcagcatacaggggaaggcttggaccaagctgggcgacc

SEQ ID NO: 1957 - DNA, 201 bp, Homo sapiens
tccggccactgggctacctctccttcagtcccagaagacaagtctcaccaacccagggagtcaaggaccagcaaaccaaagtggataatggactttttcaytcctgtttttcttggcaggagagaagcaaggccactaaaagaggagatggtggagacggaggctcagcagtggtcttgaggggtaaaggacttagatgcc

SEQ ID NO: 1958 - DNA, 201 bp, Homo sapiens
aaccacaccttcaactccagctcctcccagtactgccgccccatctccacccagagcatcaccagcacagactcaggagacagcgaagagaactatgtccmtatgcaaaacccagtgtctgcatctcccgttcccagtggcacgaacagtcctgcccctaagaagagcaccggcagcgttgattatctggccctggacttc

SEQ ID NO: 1959 - DNA, 201 bp, Homo sapiens
cacagccctcagctatcttccctccggccactgggctacctctccttcagtcccagaagacaagtctcaccaacccagggagtcaaggaccagcaaaccaragtggataatggactttttcattcctgtttttcttggcaggagagaagcaaggccactaaaagaggagatggtggagacggaggctcagcagtggtcttg

SEQ ID NO: 1960 - DNA, 201 bp, Homo sapiens
ttcagccaccccctgtcaaccgcaacctcaaacctgatcggaaagcaaagccaacaccacttgacctgaggaacaacaccgtcatcgatgaactccccttyaagtcacctatcaccaagtcttggtctagggccaaccacaccttcaactccagctcctcccagtactgccgccccatctccacccagagcatcaccagca

SEQ ID NO: 1961 - DNA, 201 bp, Homo sapiens
ttcctcccatccacctcctctctactctgccagtctcagccttcaaagcacttgacatcagggaccctgaacccttcccctgggaggtgagggcctgatcraggcacctcctctgcccactcggggcccagctgtgatttttatcagtaatggccatgcctccacccaccttagttaggagctacttccaaaaagcatcct

SEQ ID NO: 1962 - DNA, 201 bp, Homo sapiens
cctcaaacctgatcggaaagcaaagccaacaccacttgacctgaggaacaacaccgtcatcgatgaactccccttcaagtcacctatcaccaagtcttggkctagggccaaccacaccttcaactccagctcctcccagtactgccgccccatctccacccagagcatcaccagcacagactcaggagacagcgaagagaa

SEQ ID NO: 1963 - DNA, 201 bp, Homo sapiens
acagccgacttcaccgagcttcttcctgtgagacctacgagtacccacagcgtggtggagagagtgcaggccggtctgctgaatccatgagtgatggagtyggctctttcctgccagggaaaatgattgtgggccgatcggacagcaccaattctgaagacaactatgtgcccatgaatccaggttcttccaccctgttgg

SEQ ID NO: 1964 - DNA, 201 bp, Homo sapiens
ttgacctgaggaacaacaccgtcatcgatgaactccccttcaagtcacctatcaccaagtcttggtctagggccaaccacaccttcaactccagctcctcmcagtactgccgccccatctccacccagagcatcaccagcacagactcaggagacagcgaagagaactatgtccctatgcaaaacccagtgtctgcatctc

SEQ ID NO: 1965 - DNA, 201 bp, Homo sapiens; identical to SEQ ID NO: 1925

SEQ ID NO: 1966 - DNA, 201 bp, Homo sapiens; identical to SEQ ID NO: 1926

SEQ ID NO: 1967 - DNA, 201 bp, Homo sapiens; identical to SEQ ID NO: 1927

SEQ ID NO: 1968 - DNA, 201 bp, Homo sapiens; identical to SEQ ID NO: 1928

SEQ ID NO: 1969 - DNA, 201 bp, Homo sapiens; identical to SEQ ID NO: 1929

SEQ ID NO: 1970 - DNA, 201 bp, Homo sapiens; identical to SEQ ID NO: 1930

SEQ ID NO: 1971 - DNA, 201 bp, Homo sapiens; identical to SEQ ID NO: 1931

SEQ ID NO: 1972 - DNA, 201 bp, Homo sapiens; identical to SEQ ID NO: 1932

SEQ ID NO: 1973 - DNA, 201 bp, Homo sapiens; identical to SEQ ID NO: 1933

SEQ ID NO: 1974 - DNA, 201 bp, Homo sapiens; identical to SEQ ID NO: 1934

SEQ ID NO: 1975 - DNA, 201 bp, Homo sapiens; identical to SEQ ID NO: 1935

SEQ ID NO: 1976 - DNA, 201 bp, Homo sapiens; identical to SEQ ID NO: 1936

SEQ ID NO: 1977 - DNA, 201 bp, Homo sapiens; identical to SEQ ID NO: 1937

SEQ ID NO: 1978 - DNA, 201 bp, Homo sapiens; identical to SEQ ID NO: 1939

SEQ ID NO: 1979 - DNA, 201 bp, Homo sapiens; identical to SEQ ID NO: 1940

SEQ ID NO: 1980 - DNA, 201 bp, Homo sapiens; identical to SEQ ID NO: 1941

SEQ ID NO: 1981 - DNA, 201 bp, Homo sapiens; identical to SEQ ID NO: 1942

SEQ ID NO: 1982 - DNA, 201 bp, Homo sapiens; identical to SEQ ID NO: 1943

SEQ ID NO: 1983 - DNA, 201 bp, Homo sapiens; identical to SEQ ID NO: 1944

SEQ ID NO: 1984 - DNA, 201 bp, Homo sapiens; identical to SEQ ID NO: 1945

SEQ ID NO: 1985 - DNA, 201 bp, Homo sapiens; identical to SEQ ID NO: 1946

SEQ ID NO: 1986 - DNA, 201 bp, Homo sapiens; identical to SEQ ID NO: 1947

SEQ ID NO: 1987 - DNA, 201 bp, Homo sapiens; identical to SEQ ID NO: 1948

SEQ ID NO: 1988 - DNA, 201 bp, Homo sapiens; identical to SEQ ID NO: 1949

SEQ ID NO: 1989 - DNA, 163 bp, Homo sapiens
gaaattttgagaagtggtgggatgaagaagatccctgaagagaggagtaactgagacaaaggmgaggctagcaatagagagacaagtgagggaattagacctttggtatcatcatgaaaaggcctggaagaaacgctggtttatcctgcggagtggccggatg

SEQ ID NO: 1990 - DNA, 201 bp, Homo sapiens; identical to SEQ ID NO: 1951

SEQ ID NO: 1991 - DNA, 201 bp, Homo sapiens; identical to SEQ ID NO: 1950

SEQ ID NO: 1992 - DNA, 201 bp, Homo sapiens; identical to SEQ ID NO: 1953

SEQ ID NO: 1993 - DNA, 201 bp, Homo sapiens; identical to SEQ ID NO: 1952

SEQ ID NO: 1994 - DNA, 201 bp, Homo sapiens; identical to SEQ ID NO: 1954

SEQ ID NO: 1995 - DNA, 201 bp, Homo sapiens; identical to SEQ ID NO: 1955

SEQ ID NO: 1996 - DNA, 201 bp, Homo sapiens; identical to SEQ ID NO: 1956

SEQ ID NO: 1997 - DNA, 201 bp, Homo sapiens; identical to SEQ ID NO: 1957

SEQ ID NO: 1998 - DNA, 201 bp, Homo sapiens; identical to SEQ ID NO: 1958

SEQ ID NO: 1999 - DNA, 201 bp, Homo sapiens; identical to SEQ ID NO: 1959

SEQ ID NO: 2000 - DNA, 201 bp, Homo sapiens; identical to SEQ ID NO: 1960

SEQ ID NO: 2001 - DNA, 201 bp, Homo sapiens; identical to SEQ ID NO: 1961

SEQ ID NO: 2002 - DNA, 201 bp, Homo sapiens; identical to SEQ ID NO: 1962

SEQ ID NO: 2003 - DNA, 201 bp, Homo sapiens; identical to SEQ ID NO: 1963

SEQ ID NO: 2004 - DNA, 145 bp, Homo sapiens
gaaattttgagaagtggtgggatgaagaagatccctgaagagagsagtaactgagacaaaggcgaggctagcaatagagagacaagtgagggaattagacctttggtatcatcatgaaaaggcctggaagaaacgctggtttatc

SEQ ID NO: 2005 - DNA, 201 bp, Homo sapiens; identical to SEQ ID NO: 1964

SEQ ID NO: 2006 - DNA, 201 bp, Homo sapiens
ggctgtggtcagttccatgccccactatgccgacgcgtcgggacgcaacatgcttaccggcttctcctcagcccacatgggcagtcacattcccagccccrgagccagggtcatcacactgtccaaccccatggcgcccttgccctccagatggactgcaccccgaagtaagtggggcagtgtccagaccagcgggcgcag

SEQ ID NO: 2007 - DNA, 201 bp, Homo sapiens
ctggagcccagcacgctgaccccggcctcagctctgaagccctcagacggcatgaccatcagcagcctggtggaagaggcttgctgccgcaactagcagtrcctcgggctgggcaccctgagcagcagcctgagctgggccaaagctcttccgcatttctctggacaaccgcatgttgaccaccaactgctgcagctaccc

SEQ ID NO: 2008 - DNA, 201 bp, Homo sapiens
tcacactgtccaaccccatggcgcccttgccctccagatggactgcaccccgaagtaagtggggcagtgtccagaccagcgggcgcagcagtgggcttggygccaatatgggctcctggttagttggcagagacgtgctggccccaccccaggcaacagggccccctcgcccacccgggcttcctgcggctgcagcgagta

SEQ ID NO: 2009 - DNA, 201 bp, Homo sapiens
ggctcctggttagttggcagagacgtgctggccccaccccaggcaacagggccccctcgcccacccgggcttcctgcggctgcagcgagtagccctctacrtcctcgggaacaaagcccagctcaagggtgtgcggccagactccctgcagcagtgggagctggtgcccattgaggtattcgaggaacagcaggtgaaggc

SEQ ID NO: 2010 - DNA, 201 bp, Homo sapiens
ctgtatgaggagaagggggaacgcaggggccagctgctgtgcaggtctttgtgggagtgtgtggaccggctgagcaagaggacgcccatgttctacaattmcatgcatgcacccgaggacacagagctcccgcagccctacagcaacgtgtccaacctgaaggtgtgggatttctacactgaggagatactggccaagggc

SEQ ID NO: 2011 - DNA, 201 bp, Homo sapiens
actttgcgtttacaacatctgtgcccaggatatgcccttggcccagcagtgggtggacgggatccagagctgcctgtcagacacctgagcctcccggcccygcccagctgctctgcttccggtcgttactgaccactaggggtgggcagggctgccccagccatctttactgccccagccctcaacaatattgaggccctg

SEQ ID NO: 2012 - DNA, 141 bp, Homo sapiens
gcagggctgccccagccatctttactgccccagccctcaacaatattgaggccctgagcccccagcacatggtgcatacagcccctgccccatcccgcccygccccacccagctggccctaacttattttggggtcacagc

SEQ ID NO: 2013 - DNA, 126 bp, Homo sapiens
ttccgcaggcagctgcataagctgcrgtaccgccggacgtcagagccaccttggcgttcaccctgggctctgcctatacacttggctggccaccccgagtcaccaaggacaagggtccttccctca

SEQ ID NO: 2014 - DNA, 201 bp, Homo sapiens
tcccgcagccctacagcaacgtgtccaacctgaaggtgtgggatttctacactgaggagatactggccaagggccctccctatgactgggaactggcccargggccccctgggcccctggaggaagaacggtctgacggaggtgctccccagtgcaggcaccgcgtggcgtggccctgctacgacagctgcccctgacccc

SEQ ID NO: 2015 - DNA, 201 bp, Homo sapiens
ccagcacgctgaccccggcctcagctctgaagccctcagacggcatgaccatcagcagcctggtggaagaggcttgctgccgcaactagcagtacctcggrctgggcaccctgagcagcagcctgagctgggccaaagctcttccgcatttctctggacaaccgcatgttgaccaccaactgctgcagctacccggggctg

SEQ ID NO: 2016 - DNA, 201 bp, Homo sapiens
ggccaaagctcttccgcatttctctggacaaccgcatgttgaccaccaactgctgcagctacccggggctgctgatcgtgccccagggtgtccaggacaaygccctgcagtgggtgtcccactgctactaccagaactgcttccccgtaatctgctggtgcagcgggtggtccaaggcagtgctgctgcgctctggggcct

SEQ ID NO: 2017 - DNA, 201 bp, Homo sapiens
cagcacgctgaccccggcctcagctctgaagccctcagacggcatgaccatcagcagcctggtggaagaggcttgctgccgcaactagcagtacctcgggmtgggcaccctgagcagcagcctgagctgggccaaagctcttccgcatttctctggacaaccgcatgttgaccaccaactgctgcagctacccggggctgc

SEQ ID NO: 2018 - DNA, 201 bp, Homo sapiens
caatccacaagctgctgcaggtgccagtgctggtggtggagcccctggattcagactcctctgtgctggtgggcctggaggatggctgggacatcacctcycaggtggtatccttggtgcagctgctctcagaccccttctattgcacgctggagagcttccgcctgccagtggagaagaagtggttgtccttcagtcatc

SEQ ID NO: 2019 - DNA, 201 bp, Homo sapiens
tcagaaccctgtcccacaacctggtcaaaaactccaagaagaccatcaggcaccagcatgtcactcttaagaagtacaacccccccaagctggcagcaccrgggccagctgccccctgaagaccaaggggacgagatctcagtgtcagaggagctggagcccagcacgctgaccccggcctcagctctgaagccctcagac

SEQ ID NO: 2020 - DNA, 201 bp, Homo sapiens
gtgcagcgggtggtccaaggcagtgctgctgcgctctggggcctgcagggcagaggtgtcctcggcctcttcaaggcccagaacgcaccttctccaggccmgtcccaggtggactcgagtagcctggagcaggagaagtacctgcaggctgtggtcagttccatgccccactatgccgacgcgtcgggacgcaacatgctt

SEQ ID NO: 2021 - DNA, 201 bp, Homo sapiens
tacccggggctgctgatcgtgccccagggtgtccaggacaatgccctgcagtgggtgtcccactgctactaccagaactgcttccccgtaatctgctggtrcagcgggtggtccaaggcagtgctgctgcgctctggggcctgcagggcagaggtgtcctcggcctcttcaaggcccagaacgcaccttctccaggccagt

SEQ ID NO: 2022 - DNA, 201 bp, Homo sapiens
tctattgcacgctggagagcttccgcctgccagtggagaagaagtggttgtccttcagtcatcccttcagccaccgtggagcccacaccctggctgggcaragcagcggcttcacacctgccttcctgtagttcctggactgtgtaacaccaggtccatctgcagttctccatggagtttgagttcagccagttctacctc

SEQ ID NO: 2023 - DNA, 201 bp, Homo sapiens
cgggtccaacgagggcactctgtagaagaaggaggccttcatgaagccttggaaggcccgctggttcatgttggacaagaccagcaccagctgtgctactrcaaccactgtgtggacacagagtgcaagggtgtcatcgactggcggaggtggaggctgtggcaggggcacgccctaagaccatggatgagaaggctttct

SEQ ID NO: 2024 - DNA, 201 bp, Homo sapiens
tggttagttggcagagacgtgctggccccaccccaggcaacagggccccctcgcccacccgggcttcctgcggctgcagcgagtagccctctacatcctcrggaacaaagcccagctcaagggtgtgcggccagactccctgcagcagtgggagctggtgcccattgaggtattcgaggaacagcaggtgaaggccaactt

SEQ ID NO: 2025 - DNA, 201 bp, Homo sapiens
ctgggtagaaaatacagcattttcacagaaaaggacgagatcttgtctgatgtggcatctagactttggtttacatacaggaaaaactttccagccattgraggttgtcgggacatttcactctccagtaaatgtggcccttggcgttactgagtcctaagaggggggacaggccccacctcggacacaggctggggctgc

SEQ ID NO: 2026 - DNA, 201 bp, Homo sapiens
acctggtggcatttccagaacctcagccccgattccagcacccaccaccgcctgaccctgtgtaacctgctgtcccgggtcccagagtgcactctgccccrctgctctgctgcctgtcctgggaaagtagctttgccccactaggaaatgtaaacaggagggcttggggagcgtgggcacttttctcatgagcagctactg

SEQ ID NO: 2027 - DNA, 201 bp, Homo sapiens
gggaagcagggaaggctggtgcgatctccattccttgggctccgcgtccgagttcatggtgcgccgctgtgctgggagctgcagtgggaatgtgtgggacmccttgaccaaaggggagctttgtctcgtgtgttttgaaaaaggcttaatgaagagaatgttgttcattcttagtagtatagtttgcaattcttaatggca

SEQ ID NO: 2028 - DNA, 201 bp, Homo sapiens
tctgctgcctgtcctgggaaagtagctttgccccactaggaaatgtaaacaggagggcttggggagcgtgggcacttttctcatgagcagctactgcggcrttggcaggactcgctgctgctgctgctgcttgtgtaggtcggggagccggagatccccgaggacgcgcgccggacagtcggcactgaccggcccacctgg

SEQ ID NO: 2029 - DNA, 201 bp, Homo sapiens
tggagcctgccctcagagtgtccctttccagtgctgtggcattctgtggcagcttccccaggtgtggtgacggggggggcggggcctccacctgtgacagycaggcttgagggtggacggcgtgcctctcccaggagccttccccatgtccttgccttgctgagaattgccctcccatgccgctgaggtgttaggtggttt

SEQ ID NO: 2030 - DNA, 201 bp, Homo sapiens
gaggaacgaaggcgaggttcctccttgctttggggagaaaagtattcaggaagtgggtgtgtgggaaacctgaagatggcgtgcacaggacacagcgtggkcggcctgggcagaagggcggctggctgtcctggagctgctgctggagcctgccctcagagtgtccctttccagtgctgtggcattctgtggcagcttccc

SEQ ID NO: 2031 - DNA, 201 bp, Homo sapiens
acatgaatttctggggcgctccctgagtcagagtctcagaagacctgtgcaggctggcgtgagaggagcggcagccacactgcggccccacgcccaaggaytgggctgctctcgaggggggcgcgcccaccgctgtgtcctctctgcccagcctggcttaccaagggctacctcagtgggagatgaggttggaggaacgaa

SEQ ID NO: 2032 - DNA, 201 bp, Homo sapiens
gcatcgcggagcttgacccgtccatcgctgtggggtttttctgtaagactgaagatgacttcaatgattggtgccagcaagtcaaaaagctgtctctgctyggaggtgccctgcccatgtttgagctggtggagcagcagccttcacatctggcctgccccgacgtcctgaacctgtccctaggtgagagctgccaagtcc

SEQ ID NO: 2033 - DNA, 201 bp, Homo sapiens
cccgggaggccttactgcttggtgtcagactgcccagctcagagtgcccgtcagggcctgtgcatccgcacgcggagccgtctgttaggagcttccagagygttctctcgacactgccagccccgtgttagcacctgggcctcagtcccacttgctcccaggcgccggttctgtggttggtttggaattaaagtcctgttt

SEQ ID NO: 2034 - DNA, 201 bp, Homo sapiens
caggctggggctgcatgctgcggtgtggacagatgatctttgcccaagccctggtgtgccggcacctaggccgagattggaggtggacacaaaggaagagrcagccagacagctacttcagcgtcctcaacgcattcatcgacaggaaggacagttactactccattcaccagatagcgcaaatgggagttggcgaaggca

SEQ ID NO: 2035 - DNA, 201 bp, Homo sapiens
gcacctgggcctcagtcccacttgctcccaggcgccggttctgtggttggtttggaattaaagtcctgtttgaagttgtcagacacagacatgaatttctkgggcgctccctgagtcagagtctcagaagacctgtgcaggctggcgtgagaggagcggcagccacactgcggccccacgcccaaggactgggctgctctc

SEQ ID NO: 2036 - DNA, 201 bp, Homo sapiens
tttgaagttgtcagacacagacatgaatttctggggcgctccctgagtcagagtctcagaagacctgtgcaggctggcgtgagaggagcggcagccacacygcggccccacgcccaaggactgggctgctctcgaggggggcgcgcccaccgctgtgtcctctctgcccagcctggcttaccaagggctacctcagtggga

SEQ ID NO: 2037 - DNA, 201 bp, Homo sapiens
agggcggctggctgtcctggagctgctgctggagcctgccctcagagtgtccctttccagtgctgtggcattctgtggcagcttccccaggtgtggtgacggggggggcggggcctccacctgtgacagtcaggcttgagggtggacggcgtgcctctcccaggagccttccccatgtccttgccttgctgagaattgccc

SEQ ID NO: 2038 - DNA, 201 bp, Homo sapiens
acaggagggcttggggagcgtgggcacttttctcatgagcagctactgcggcgttggcaggactcgctgctgctgctgctgcttgtgtaggtcggggagcyggagatccccgaggacgcgcgccggacagtcggcactgaccggcccacctggtagcagaggacacccccagccccccaagcattgaagacatagtgtatt

SEQ ID NO: 2039 - DNA, 201 bp, Homo sapiens
gccgcatgagcatcgcggagcttgacccgtccatcgctgtggggtttttctgtaagactgaagatgacttcaatgattggtgccagcaagtcaaaaagctrtctctgcttggaggtgccctgcccatgtttgagctggtggagcagcagccttcacatctggcctgccccgacgtcctgaacctgtccctaggtgagagct

SEQ ID NO: 2040 - DNA, 201 bp, Homo sapiens
tttttctgtaagactgaagatgacttcaatgattggtgccagcaagtcaaaaagctgtctctgcttggaggtgccctgcccatgtttgagctggtggagcwgcagccttcacatctggcctgccccgacgtcctgaacctgtccctaggtgagagctgccaagtccaggtggggtccctcggagattcttctgatgtagag

SEQ ID NO: 2041 - DNA, 201 bp, Homo sapiens
gagagcttccactgccagcacccgccgtgccgcatgagcatcgcggagcttgacccgtccatcgctgtggggtttttctgtaagactgaagatgacttcartgattggtgccagcaagtcaaaaagctgtctctgcttggaggtgccctgcccatgtttgagctggtggagcagcagccttcacatctggcctgccccgac

SEQ ID NO: 2042 - DNA, 201 bp, Homo sapiens
gaagcttgctgtcttcgatacgtggagctccttggcggtccacattgcaatggacaacactgttgtgatggaggaaatcagaaggttgtgcaggaccagcrttccctgtgcaggcgccactgcgtttcctgcagattccgaccggcactgcaacggattccctgccggagctgaggtcaccaacaggccgtcgccatggag

SEQ ID NO: 2043 - DNA, 201 bp, Homo sapiens
acaacactgttgtgatggaggaaatcagaaggttgtgcaggaccagcgttccctgtgcaggcgccactgcgtttcctgcagattccgaccggcactgcaayggattccctgccggagctgaggtcaccaacaggccgtcgccatggagacccctggtacttctcattcccctgcgcctggggctcacggacatcaacgagg

SEQ ID NO: 2044 - DNA, 201 bp, Homo sapiens
cattgaagacatagtgtatttcctcgtatcctttctcccttgggtgtagttggggtggggaagcagggaaggctggtgcgatctccattccttgggctccrcgtccgagttcatggtgcgccgctgtgctgggagctgcagtgggaatgtgtgggacaccttgaccaaaggggagctttgtctcgtgtgttttgaaaaagg

SEQ ID NO: 2045 - DNA, 201 bp, Homo sapiens
caggagggcttggggagcgtgggcacttttctcatgagcagctactgcggcgttggcaggactcgctgctgctgctgctgcttgtgtaggtcggggagccrgagatccccgaggacgcgcgccggacagtcggcactgaccggcccacctggtagcagaggacacccccagccccccaagcattgaagacatagtgtattt

SEQ ID NO: 2046 - DNA, 201 bp, Homo sapiens
tgtagttggggtggggaagcagggaaggctggtgcgatctccattccttgggctccgcgtccgagttcatggtgcgccgctgtgctgggagctgcagtggkaatgtgtgggacaccttgaccaaaggggagctttgtctcgtgtgttttgaaaaaggcttaatgaagagaatgttgttcattcttagtagtatagtttgca

SEQ ID NO: 2047 - DNA, 201 bp, Homo sapiens
cgattccagcacccaccaccgcctgaccctgtgtaacctgctgtcccgggtcccagagtgcactctgccccactgctctgctgcctgtcctgggaaagtakctttgccccactaggaaatgtaaacaggagggcttggggagcgtgggcacttttctcatgagcagctactgcggcgttggcaggactcgctgctgctgct

SEQ ID NO: 2048 - DNA, 201 bp, Homo sapiens; identical to SEQ ID NO: 2026

SEQ ID NO: 2049 - DNA, 201 bp, Homo sapiens; identical to SEQ ID NO: 2027

SEQ ID NO: 2050 - DNA, 201 bp, Homo sapiens; identical to SEQ ID NO: 2028

SEQ ID NO: 2051 - DNA, 201 bp, Homo sapiens; identical to SEQ ID NO: 2029

SEQ ID NO: 2052 - DNA, 201 bp, Homo sapiens; identical to SEQ ID NO: 2030

SEQ ID NO: 2053 - DNA, 201 bp, Homo sapiens; identical to SEQ ID NO: 2031

SEQ ID NO: 2054 - DNA, 201 bp, Homo sapiens
gcatcgcggagcttgacccgtccatcgctgtggggtttttctgtaagactgaagatgacttcaatgattggtgccagcaagtcaaaaagctgtctctgctyggaggtgccctgcccatgtttgagctggtggagcagcagccttcacatctggcctgccccgacgtcctgaacctgtccctagattcttctgatgtagagc

SEQ ID NO: 2055 - DNA, 201 bp, Homo sapiens; identical to SEQ ID NO: 2033

SEQ ID NO: 2056 - DNA, 201 bp, Homo sapiens; identical to SEQ ID NO: 2034

SEQ ID NO: 2057 - DNA, 201 bp, Homo sapiens; identical to SEQ ID NO: 2035

SEQ ID NO: 2058 - DNA, 201 bp, Homo sapiens; identical to SEQ ID NO: 2036

SEQ ID NO: 2059 - DNA, 201 bp, Homo sapiens; identical to SEQ ID NO: 2037

SEQ ID NO: 2060 - DNA, 201 bp, Homo sapiens; identical to SEQ ID NO: 2038

SEQ ID NO: 2061 - DNA, 201 bp, Homo sapiens
gccgcatgagcatcgcggagcttgacccgtccatcgctgtggggtttttctgtaagactgaagatgacttcaatgattggtgccagcaagtcaaaaagctrtctctgcttggaggtgccctgcccatgtttgagctggtggagcagcagccttcacatctggcctgccccgacgtcctgaacctgtccctagattcttctg

SEQ ID NO: 2062 - DNA, 201 bp, Homo sapiens
tttttctgtaagactgaagatgacttcaatgattggtgccagcaagtcaaaaagctgtctctgcttggaggtgccctgcccatgtttgagctggtggagcwgcagccttcacatctggcctgccccgacgtcctgaacctgtccctagattcttctgatgtagagcgactggaaagattcttcgactcagaagatgaagac

SEQ ID NO: 2063 - DNA, 201 bp, Homo sapiens; identical to SEQ ID NO: 2041

SEQ ID NO: 2064 - DNA, 201 bp, Homo sapiens; identical to SEQ ID NO: 2042

SEQ ID NO: 2065 - DNA, 201 bp, Homo sapiens; identical to SEQ ID NO: 2043

SEQ ID NO: 2066 - DNA, 201 bp, Homo sapiens; identical to SEQ ID NO: 2044

SEQ ID NO: 2067 - DNA, 201 bp, Homo sapiens; identical to SEQ ID NO: 2045

SEQ ID NO: 2068 - DNA, 201 bp, Homo sapiens; identical to SEQ ID NO: 2046

SEQ ID NO: 2069 - DNA, 201 bp, Homo sapiens; identical to SEQ ID NO: 2047

SEQ ID NO: 2070 - DNA, 201 bp, Homo sapiens; identical to SEQ ID NO: 2026

SEQ ID NO: 2071 - DNA, 201 bp, Homo sapiens; identical to SEQ ID NO: 2027

SEQ ID NO: 2072 - DNA, 201 bp, Homo sapiens; identical to SEQ ID NO: 2028

SEQ ID NO: 2073 - DNA, 201 bp, Homo sapiens; identical to SEQ ID NO: 2029

SEQ ID NO: 2074 - DNA, 201 bp, Homo sapiens; identical to SEQ ID NO: 2030

SEQ ID NO: 2075 - DNA, 201 bp, Homo sapiens; identical to SEQ ID NO: 2031

SEQ ID NO: 2076 - DNA, 201 bp, Homo sapiens; identical to SEQ ID NO: 2054

SEQ ID NO: 2077 - DNA, 201 bp, Homo sapiens; identical to SEQ ID NO: 2033

SEQ ID NO: 2078 - DNA, 201 bp, Homo sapiens; identical to SEQ ID NO: 2034

SEQ ID NO: 2079 - DNA, 201 bp, Homo sapiens; identical to SEQ ID NO: 2035

SEQ ID NO: 2080 - DNA, 201 bp, Homo sapiens; identical to SEQ ID NO: 2036

SEQ ID NO: 2081 - DNA, 201 bp, Homo sapiens; identical to SEQ ID NO: 2037

SEQ ID NO: 2082 - DNA, 201 bp, Homo sapiens; identical to SEQ ID NO: 2038

SEQ ID NO: 2083 - DNA, 201 bp, Homo sapiens; identical to SEQ ID NO: 2061

SEQ ID NO: 2084 - DNA, 201 bp, Homo sapiens; identical to SEQ ID NO: 2062

SEQ ID NO: 2085 - DNA, 201 bp, Homo sapiens; identical to SEQ ID NO: 2041

SEQ ID NO: 2086 - DNA, 201 bp, Homo sapiens; identical to SEQ ID NO: 2042

SEQ ID NO: 2087 - DNA, 201 bp, Homo sapiens; identical to SEQ ID NO: 2043

SEQ ID NO: 2088 - DNA, 201 bp, Homo sapiens; identical to SEQ ID NO: 2044

SEQ ID NO: 2089 - DNA, 201 bp, Homo sapiens; identical to SEQ ID NO: 2045

SEQ ID NO: 2090 - DNA, 201 bp, Homo sapiens; identical to SEQ ID NO: 2046

SEQ ID NO: 2091 - DNA, 201 bp, Homo sapiens; identical to SEQ ID NO: 2047

SEQ ID NO: 2092 - DNA, 201 bp, Homo sapiens; identical to SEQ ID NO: 2042

SEQ ID NO: 2093 - DNA, 201 bp, Homo sapiens; identical to SEQ ID NO: 2043

SEQ ID NO: 2094 - DNA, 102 bp, Homo sapiens
cgtggcggccacctgagcacacaggcatttggtgctgaatgctgtttgggaatgacgaggaaaactttcggatttttgcgttttttttttcagcatgttgsg

SEQ ID NO: 2095 - DNA, 201 bp, Homo sapiens; identical to SEQ ID NO: 2034

SEQ ID NO: 2096 - DNA, 201 bp, Homo sapiens; identical to SEQ ID NO: 2032

SEQ ID NO: 2097 - DNA, 186 bp, Homo sapiens
cccgggaggccttactgcttggtgtcagactgcccagctcagagtgcccgtcagggcctgtgcatccgcacgcggagccgtctgttaggagcttccagagygttctctcgacactgccagccccgtgttagcacctgggcctcagtcccacttgctcccaggcgccggttctgtggttggtttgga

SEQ ID NO: 2098 - DNA, 201 bp, Homo sapiens; identical to SEQ ID NO: 2034

SEQ ID NO: 2099 - DNA, 201 bp, Homo sapiens
cttcacatctggcctgccccgacgtcctgaacctgtccctaggtgagagctgccaagtccaggtggggtccctcggaggtacgatctgtgcccttgcttcyccagtcctggcccccttggttttgaccattaaggtgtgtgtgagcctgagccgtgagcacttggcagtggttcgcctgtgagaccaggtatggagtggag

SEQ ID NO: 2100 - DNA, 201 bp, Homo sapiens; identical to SEQ ID NO: 2039

SEQ ID NO: 2101 - DNA, 201 bp, Homo sapiens
tttttctgtaagactgaagatgacttcaatgattggtgccagcaagtcaaaaagctgtctctgcttggaggtgccctgcccatgtttgagctggtggagcwgcagccttcacatctggcctgccccgacgtcctgaacctgtccctaggtgagagctgccaagtccaggtggggtccctcggaggtacgatctgtgccctt

SEQ ID NO: 2102 - DNA, 201 bp, Homo sapiens
ttcgcctgtgagaccaggtatggagtggagcgtcccctcctccaagcttgcgcccagcagcccaggacccacctcgtcttccccaccagcgctgcctgccsgggcgctgtggagctgggcgtgctaccatggagtcctcaggggtctggagcagacagaacatgcaggctctgtggtgacgcagtcctgggtgggggactg

SEQ ID NO: 2103 - DNA, 201 bp, Homo sapiens; identical to SEQ ID NO: 2041

SEQ ID NO: 2104 - DNA, 201 bp, Homo sapiens; identical to SEQ ID NO: 2042

SEQ ID NO: 2105 - DNA, 201 bp, Homo sapiens; identical to SEQ ID NO: 2043

SEQ ID NO: 2106 - DNA, 201 bp, Homo sapiens
ggtctgcacaacccccggacctgttcacacccgcatggggacagctgtctgtgggctgcagagcaggcactgctcagtctgccccacgccaagggcccttractcacacccaggtggcccacccaagatgcctgatgcgctatgtcctgttccttctagattcttctgatgtagagcgactggaaagattcttcgactcag

SEQ ID NO: 2107 - DNA, 201 bp, Homo sapiens
cccctcggaccatggccagcgtgccgcaggagccggcctgggctcgtgcagtgaagtgagtggccgtgagcgcgtcctcctcatctctgtctccctgtggraaactctacaaacaaggcaatggcaatggaaccactcctgatgaccacgagggtcagacgcgggacagaggcccctcaggcctgagattgtgccggccgc

SEQ ID NO: 2108 - DNA, 201 bp, Homo sapiens
catgggtggcgtagacccctcggaccatggccagcgtgccgcaggagccggcctgggctcgtgcagtgaagtgagtggccgtgagcgcgtcctcctcatcyctgtctccctgtgggaaactctacaaacaaggcaatggcaatggaaccactcctgatgaccacgagggtcagacgcgggacagaggcccctcaggcctga

SEQ ID NO: 2109 - DNA, 201 bp, Homo sapiens
caaaggagttggcattagtgttcttgaaatgagtcacaggccatcagattttgccaagattattaacgatacagagaatcttgtgcgggaattgccagccrttccagacagctataaggtgatttttgtgcaaggaagtgggtctggccagttcggtgctgtccccttaaacctgattggcttgaaagcaggaagatgtgc

SEQ ID NO: 2110 - DNA, 201 bp, Homo sapiens
tcacgtgttcggtcctccttagctgactcgccgccctcgctgccgcaccatggacgccccgaggcacgtggtcaacttcgggcctggtcccgccaagctgyctcactcagtgttgttagagataaaaaaggaattattagactacaaaggagttggcattagtgttcttgaaatgagtcacaggccatcagattttgccaa

SEQ ID NO: 2111 - DNA, 201 bp, Homo sapiens
catcagattttgccaagattattaacgatacagagaatcttgtgcgggaattgccagccgttccagacagctataaggtgatttttgtgcaaggaagtggrtctggccagttcggtgctgtccccttaaacctgattggcttgaaagcaggaagatgtgcggactatgtggtgacagggacttggtcagctaaggccgcag

SEQ ID NO: 2112 - DNA, 201 bp, Homo sapiens
ggaagatgtgcggactatgtggtgacagggacttggtcagctaaggccgcagaagaagccaagaagtttgggactataaatatcattcaccctaaacttgrgagttatacaaaaattccagatccaagcacctggaacctcaacccggatgcctcctatgtgtattattgcgcaaatgaggtggtgcatggtgtggagttt

SEQ ID NO: 2113 - DNA, 201 bp, Homo sapiens
ccaagcacctggaacctcaacccggatgcctcctatgtgtattattgcgcaaatgaggtggtgcatggtgtggagtttgactttataccctatgtcaaggkagcagtactggtttgtgacatgtcctcaaacttcctgtccaagccagtggatgtccaagtttggtgtgatttttgctggtgcccagacgaatgttggctt

SEQ ID NO: 2114 - DNA, 201 bp, Homo sapiens
attagtgttcttgaaatgagtcacaggccatcagattttgccaagattattaacgatacagagaatcttgtgcgggaattgccagccgttccagacagctrtaaggtgatttttgtgcaaggaagtgggtctggccagttcggtgctgtccccttaaacctgattggcttgaaagcaggaagatgtgcggactatgtggtg

SEQ ID NO: 2115 - DNA, 201 bp, Homo sapiens
gactacaaaggagttggcattagtgttcttgaaatgagtcacaggccatcagattttgccaagattattaacgatacagagaatcttgtgcgggaattgcyagccgttccagacagctataaggtgatttttgtgcaaggaagtgggtctggccagttcggtgctgtccccttaaacctgattggcttgaaagcaggaaga

SEQ ID NO: 2116 - DNA, 201 bp, Homo sapiens
ctaacacctcagctctgatcctggagggcctgggattcaacctcacagaaacccctgaagccgacatccaccagggcttccggagcctcctccacaccctkgccctgcccagccccaaactcgaactaaaagtaggaaactccctgttcctagacaagcgactaaagcctcggcagcactatttggacagcatcaaggagc

SEQ ID NO: 2117 - DNA, 201 bp, Homo sapiens
gggaaggttgtagacataatccaaggccttgaccttctgacggccatggttctggtgaaccacattttctttaaagccaagtgggaaaagccctttcaccytgaatatacaagaaagaacttcccattcctggtgggcgagcaggtcactgtgcatgtccccatgatgcaccagaaagagcagttcgcttttggggtggat

SEQ ID NO: 2118 - DNA, 201 bp, Homo sapiens
ccaccagggcttccggagcctcctccacacccttgccctgcccagccccaaactcgaactaaaagtaggaaactccctgttcctagacaagcgactaaagyctcggcagcactatttggacagcatcaaggagctttatggagcttttgctttttctgccaacttcacagattctgttacaactgggaggcagattaatga

SEQ ID NO: 2119 - DNA, 201 bp, Homo sapiens
ctgcagatggattacaagggagatgccgtggccttctttgtcctccctagcaagggcaagatgaggcaactggaacaggccttgtcagccagaacactgakaaagtggagccactcactccagaaaaggtggatagaggtgttcatccccagattttccatttctgcctcctacaatctggaaaccatcctcccgaagatg

SEQ ID NO: 2120 - DNA, 201 bp, Homo sapiens
acttcactgtctccttcaataggaccttcctgatgatgattacaaataaagccacagacgttcccagaattgacctgacaaatattgaccaggttgctgtsatcttcaaacaccattttcctgtgggtagaggtgatgcagtgctgaagacctgggcccctgctcagtgcctttgctctagaatgggtccagcttggcttt

SEQ ID NO: 2121 - DNA, 201 bp, Homo sapiens
aggagctgcagctgcaggcaaatttcttgggcaatgtcaagaggctgtatgaagcagaagtcttttctacagatttctccaacccctccattgcccaggcraggatcaacagccatgtgaaaaagaagacccaagggaaggttgtagacataatccaaggccttgaccttctgacggccatggttctggtgaaccacattt

SEQ ID NO: 2122 - DNA, 201 bp, Homo sapiens
ccgcccttcctccacaaagagcacccctgcctcacaggtgtattccctcaacaccgactttgccttccgcctataccgcaggctggttttggagaccccgrgtcagaacatcttcttctcccctgtgagtgtctccacttccctggccatgctctcccttggggcccactcagtcaccaagacccagattctccagggcct

SEQ ID NO: 2123 - DNA, 201 bp, Homo sapiens
tgaaccacattttctttaaagccaagtgggaaaagccctttcaccctgaatatacaagaaagaacttcccattcctggtgggcgagcaggtcactgtgcawgtccccatgatgcaccagaaagagcagttcgcttttggggtggatacagagctgaactgctttgtgctgcagatggattacaagggagatgccgtggcct

SEQ ID NO: 2124 - DNA, 133 bp, Homo sapiens
atggaggccagtaccatcgatgactcaggacayttactagccaactccccgacttcagacatattttgttccaaaatggcatcttacctttatggagtactctttgctgttggcctctgtgctccaatctact

SEQ ID NO: 2125 - DNA, 201 bp, Homo sapiens
tccccgacttcagacatattttgttccaaaatggcatcttacctttatggagtactctttgctgttggcctctgtgctccaatctactgtgtgtccccggycaatgcccccagtgcatacccccgcccttcctccacaaagagcacccctgcctcacaggtgtattccctcaacaccgactttgccttccgcctataccgc

SEQ ID NO: 2126 - DNA, 201 bp, Homo sapiens
tttctaaagcaacccacaaggctgtgctggatgtcagtgaagagggcactgaggccacagcagctaccaccaccaagttcatagtccgatcgaaggatggyccctcttacttcactgtctccttcaataggaccttcctgatgatgattacaaataaagccacagacgttcccagaattgacctgacaaatattgaccagg

SEQ ID NO: 2127 - DNA, 127 bp, Homo sapiens
atggaggccagtaccatcgatgactcrggacatttactagccaactccccgacttcagacatattttgttccaaaatggcatcttacctttatggagtactctttgctgttggcctctgtgctccaa

SEQ ID NO: 2128 - DNA, 201 bp, Homo sapiens
tcactccagaaaaggtggatagaggtgttcatccccagattttccatttctgcctcctacaatctggaaaccatcctcccgaagatgggcatccaaaatgyctttgacaaaaatgctgatttttctggaattgcaaagagagactccctgcaggtttctaaagcaacccacaaggctgtgctggatgtcagtgaagagggc

SEQ ID NO: 2129 - DNA, 201 bp, Homo sapiens
ggttttggagaccccgagtcagaacatcttcttctcccctgtgagtgtctccacttccctggccatgctctcccttggggcccactcagtcaccaagaccsagattctccagggcctgggcttcaacctcacacacacaccagagtctgccatccaccagggcttccagcacctggttcactcactgactgttcccagcaa

SEQ ID NO: 2130 - DNA, 201 bp, Homo sapiens
cccaggcgaggatcaacagccatgtgaaaaagaagacccaagggaaggttgtagacataatccaaggccttgaccttctgacggccatggttctggtgaaycacattttctttaaagccaagtgggaaaagccctttcaccctgaatatacaagaaagaacttcccattcctggtgggcgagcaggtcactgtgcatgtcc

SEQ ID NO: 2131 - DNA, 201 bp, Homo sapiens
aaaagaagacccaagggaaggttgtagacataatccaaggccttgaccttctgacggccatggttctggtgaaccacattttctttaaagccaagtgggaraagccctttcaccctgaatatacaagaaagaacttcccattcctggtgggcgagcaggtcactgtgcatgtccccatgatgcaccagaaagagcagttcg

SEQ ID NO: 2132 - DNA, 201 bp, Homo sapiens
tatggagtactctttgctgttggcctctgtgctccaatctactgtgtgtccccggccaatgcccccagtgcatacccccgcccttcctccacaaagagcayccctgcctcacaggtgtattccctcaacaccgactttgccttccgcctataccgcaggctggttttggagaccccgagtcagaacatcttcttctcccct

SEQ ID NO: 2133 - DNA, 201 bp, Homo sapiens
aagacccagattctccagggcctgggcttcaacctcacacacacaccagagtctgccatccaccagggcttccagcacctggttcactcactgactgttcycagcaaagacctgaccttgaagatgggaagtgccctcttcgtcaagaaggagctgcagctgcaggcaaatttcttgggcaatgtcaagaggctgtatgaa

SEQ ID NO: 2134 - DNA, 201 bp, Homo sapiens
accagagtctgccatccaccagggcttccagcacctggttcactcactgactgttcccagcaaagacctgaccttgaagatgggaagtgccctcttcgtcmagaaggagctgcagctgcaggcaaatttcttgggcaatgtcaagaggctgtatgaagcagaagtcttttctacagatttctccaacccctccattgccca

SEQ ID NO: 2135 - DNA, 201 bp, Homo sapiens
ccggagttcagccaggacacgttcatggttcttgccaattacatcttcttcaaagccaagtggaagcaccctttcagtcgctaccagacccagaagcaggmaagtttctttgtggatgagaggacttctctccaggtccccatgatgcaccaaaaggaaatgcacagattcctctatgaccaggatttggcttgcaccgtc

SEQ ID NO: 2136 - DNA, 201 bp, Homo sapiens
gggatgattatccagcagctgtttgacagtagcagtatctacaaccctgaagtgcttgacatcacataggaaactgcattctcacctcctggagggtgtcygcaatgttgccagtgtttgcctgcagattggttacccaactgttgcatcagtacctcattctaccatcaatgggtacaagcaagtcctggctttgtctgt

SEQ ID NO: 2137 - DNA, 201 bp, Homo sapiens
cagcagctgtttgacagtagcagtatctacaaccctgaagtgcttgacatcacataggaaactgcattctcacctcctggagggtgtccgcaatgttgccrgtgtttgcctgcagattggttacccaactgttgcatcagtacctcattctaccatcaatgggtacaagcaagtcctggctttgtctgtggaaactgattg

SEQ ID NO: 2138 - DNA, 175 bp, Homo sapiens
ctttgtggctgctgcccctggggccactgccaccactgctgctcctgctgcagctccagccaaggctgaagccaagaagagttggaggagttggatgagamtatgggatttggcctatttgactaatcaccaaaaggcaaccaactcagccagctttatttgcaaaacaaagaaa

SEQ ID NO: 2139 - DNA, 201 bp, Homo sapiens
aatcattatctgaaatgtttcattgtagaagcagcaatgtgggctccaagtagatgcagcagatccacatgtccctctgagggaaagccatggtgccaatrggcaagaacaccatgatgtgcaaggccatccaagggcacctggaaaacaacccagctctggaaaaactgttgcctcatatccagggaaatgtgggctttg

SEQ ID NO: 2140 - DNA, 163 bp, Homo sapiens
ctgcccagggaatacagggcaacctggaagtccaactacttccttcagatcatccaatttttyaatcattatctgaaatgtttcattgtagaagcagcaatgtgggctccaagtagatgcagcagatccacatgtccctctgagggaaagccatggtgccaat

SEQ ID NO: 2141 - DNA, 201 bp, Homo sapiens
catgtccctctgagggaaagccatggtgccaatgggcaagaacaccatgatgtgcaaggccatccaagggcacctggaaaacaacccagctctggaaaaaytgttgcctcatatccagggaaatgtgggctttgcgttcaccaaggaagacctcactaagttcagggacatgctgctgaatagtaaggtgccagctgccac

SEQ ID NO: 2142 - DNA, 201 bp, Homo sapiens
aagtcactgtcccaggccagaacaccggtctggagcctaagaagacctcctttttccaggctttaagcatcaccactgaaatcctgagtgatgtgcagctratcaagactggtgacaaagtgggagccagtgaagccacactgctgaacatgctgaatgaacatctctcccttctcctttgggatgattatccagcagctg

SEQ ID NO: 2143 - DNA, 201 bp, Homo sapiens
ggatcaatcgggaggacgcccgctgcagtccccagaatcaaaggatgatgtggcgcatctatgtttctttggagagtgttgtaggtctggatttgtatggscaatgtgtttgtgcttcgtgcgtgagttgttactggccagggctaggacaagagccctcgaccctggggccaacgccctgcgtccttggttcccccagag

SEQ ID NO: 2144 - DNA, 201 bp, Homo sapiens
ctctggctcttctttcagcgttttcggccacccaggcacggaaaggcttctgggactacttcagccagaccagcggggacaaaggcagggtggagcagatmcatcagcagaagatggctcgcgagcccgcgtgagtgcccaggggaaggggtgtaggcgaagggaggagacagctgggccatgccatgatgacctgcctct

SEQ ID NO: 2145 - DNA, 201 bp, Homo sapiens
tggctgccgtgctcacctgggctctggctcttctttcagcgttttcggccacccaggcacggaaaggcttctgggactacttcagccagaccagcggggamaaaggcagggtggagcagatccatcagcagaagatggctcgcgagcccgcgtgagtgcccaggggaaggggtgtaggcgaagggaggagacagctgggcc

SEQ ID NO: 2146 - DNA, 189 bp, Homo sapiens
ggcctccctccacctgtcttctcagagcagataatggcaagcatggctgccgtgctcacctgggctctggctcttctttcagcgttttsggccacccaggcacggaaaggcttctgggactacttcagccagaccagcggggacaaaggcagggtggagcagatccatcagcagaagatggctcgcgag

SEQ ID NO: 2147 - DNA, 201 bp, Homo sapiens
ctggaatttggagggcttgcggcagcaactgaagccctacacgatggatctgatggagcaggtggccctgcgcgtgcaggagctgcaggagcagttgcgcrtggtgggggaagacaccaaggcccagttgctggggggcgtggacgaggcttgggctttgctgcagggactgcagagccgcgtggtgcaccacaccggccg

SEQ ID NO: 2148 - DNA, 201 bp, Homo sapiens
catgcatgtgggtgattatctgcaagcctgtttgccgtgatgctggaagcctgtgccactacatcctggagtttggctctagtcacttctggctgcctggyggccactgctacagctggtccacagagaggagcacttgtctccccagggctgccatggcagctatcaggggaatagaagggagaaagagaatatcatggg

SEQ ID NO: 2149 - DNA, 201 bp, Homo sapiens
agagcctttgcaggcactgggactgaggaaggggccggcccggacccccagatgctctccgaggaggtgcgccagcgacttcaggctttccgccaggacayctacctgcagatagctgccttcactcgcgccatcgaccaggagactgaggaggtccagcagcagctggcgccacctccaccaggccacagtgccttcgcc

SEQ ID NO: 2150 - DNA, 201 bp, Homo sapiens
tcgcgccatcgaccaggagactgaggaggtccagcagcagctggcgccacctccaccaggccacagtgccttcgccccagagtttcaacaaacagacagtrgcaaggttctgagcaagctgcaggcccgtctggatgacctgtgggaagacatcactcacagccttcatgaccagggccacagccatctgggggacccctg

SEQ ID NO: 2151 - DNA, 201 bp, Homo sapiens
agccttcatgaccagggccacagccatctgggggacccctgaggatctacctgcccaggcccattcccagctccttgtctggggagccttggctctgagcmtctagcatggttcagtccttgaaagtggcctgttgggtggagggtggaaggtcctgtgcaggacagggaggccaccaaaggggctgctgtctcctgcata

SEQ ID NO: 2152 - DNA, 201 bp, Homo sapiens
aggaggtccagcagcagctggcgccacctccaccaggccacagtgccttcgccccagagtttcaacaaacagacagtggcaaggttctgagcaagctgcasgcccgtctggatgacctgtgggaagacatcactcacagccttcatgaccagggccacagccatctgggggacccctgaggatctacctgcccaggcccat

SEQ ID NO: 2153 - DNA, 201 bp, Homo sapiens
gggctaggacaagagccctcgaccctggggccaacgccctgcgtccttggttcccccagaggatcagtgcgcgatgacttggggacaaaggagatgatggrggctagcagtctgacggcctggatatctgtccccttctccaggaccctgaaagacagccttgagcaagacctcaacaatatgaacaagttcctggaaaag

SEQ ID NO: 2154 - DNA, 201 bp, Homo sapiens
cagtccttgaaagtggcctgttgggtggagggtggaaggtcctgtgcaggacagggaggccaccaaaggggctgctgtctcctgcatatccagcctcctgygactccccaatctggatgcattacattcaccaggctttgcaaacccagcctcccagtgctcatttgggaatgctcatgagttactccattcaagggtgag

SEQ ID NO: 2155 - DNA, 201 bp, Homo sapiens
  misc_feature (1)...(201): n = A,T,C or G, or insertion/deletion polymorphism (see Tables 1-2)
cctctagcatggttcagtccttgaaagtggcctgttgggtggagggtggaaggtcctgtgcaggacagggaggccaccaaaggggctgctgtctcctgcanatccagcctcctgcgactccccaatctggatgcattacattcaccaggctttgcaaacccagcctcccagtgctcatttgggaatgctcatgagttactc

SEQ ID NO: 2156 - DNA, 201 bp, Homo sapiens
gcgcgtggtgggggaagacaccaaggcccagttgctggggggcgtggacgaggcttgggctttgctgcagggactgcagagccgcgtggtgcaccacacckgccgcttcaaagagctcttccacccatacgccgagagcctggtgagcggcatcgggcgccacgtgcaggagctgcaccgcagtgtggctccgcacgcccc

SEQ ID NO: 2157 - DNA, 201 bp, Homo sapiens
ggatgacctgtgggaagacatcactcacagccttcatgaccagggccacagccatctgggggacccctgaggatctacctgcccaggcccattcccagctycttgtctggggagccttggctctgagcctctagcatggttcagtccttgaaagtggcctgttgggtggagggtggaaggtcctgtgcaggacagggaggc

SEQ ID NO: 2158 - DNA, 131 bp, Homo sapiens
ggcctccctccacctgtcttctcagagcagrtaatggcaagcatggctgccgtgctcacctgggctctggctcttctttcagcgttttcggccacccaggcacggaaaggcttctgggactacttcagcca

SEQ ID NO: 2159 - DNA, 201 bp, Homo sapiens; identical to SEQ ID NO: 2154

SEQ ID NO: 2160 - DNA, 201 bp, Homo sapiens
ctctggctcttctttcagcgttttcggccacccaggcacggaaaggcttctgggactacttcagccagaccagcggggacaaaggcagggtggagcagatmcatcagcagaagatggctcgcgagcccgcgaccctgaaagacagccttgagcaagacctcaacaatatgaacaagttcctggaaaagctgaggcctctga

SEQ ID NO: 2161 - DNA, 201 bp, Homo sapiens; identical to SEQ ID NO: 2155
  misc_feature (1)...(201): n = A,T,C or G, or insertion/deletion polymorphism (see Tables 1-2)

SEQ ID NO: 2162 - DNA, 201 bp, Homo sapiens
tggctgccgtgctcacctgggctctggctcttctttcagcgttttcggccacccaggcacggaaaggcttctgggactacttcagccagaccagcggggamaaaggcagggtggagcagatccatcagcagaagatggctcgcgagcccgcgaccctgaaagacagccttgagcaagacctcaacaatatgaacaagttcc

SEQ ID NO: 2163 - DNA, 189 bp, Homo sapiens; identical to SEQ ID NO: 2146

SEQ ID NO: 2164 - DNA, 201 bp, Homo sapiens; identical to SEQ ID NO: 2156

SEQ ID NO: 2165 - DNA, 201 bp, Homo sapiens; identical to SEQ ID NO: 2147

SEQ ID NO: 2166 - DNA, 201 bp, Homo sapiens; identical to SEQ ID NO: 2148

SEQ ID NO: 2167 - DNA, 201 bp, Homo sapiens; identical to SEQ ID NO: 2149

SEQ ID NO: 2168 - DNA, 201 bp, Homo sapiens; identical to SEQ ID NO: 2150

SEQ ID NO: 2169 - DNA, 201 bp, Homo sapiens; identical to SEQ ID NO: 2151

SEQ ID NO: 2170 - DNA, 201 bp, Homo sapiens; identical to SEQ ID NO: 2152

SEQ ID NO: 2171 - DNA, 201 bp, Homo sapiens; identical to SEQ ID NO: 2157

SEQ ID NO: 2172 - DNA, 131 bp, Homo sapiens; identical to SEQ ID NO: 2158

SEQ ID NO: 2173 - DNA, 201 bp, Homo sapiens
ctcgcctccgctctctccgcaccatagctgtggtgctgactgtctttgctgtctgcttcgtgcctttccacatcacccgcaccatttactacctggccagyctgttggaagctgactgccgagtactgaacattgtcaacgtggtctataaagtgactcggcccctggccagtgccaacagctgcctggatcctgtgctct

SEQ ID NO: 2174 - DNA, 201 bp, Homo sapiens
cacaaccactggccctttggcactgagatctgcaagttcgtccgctttcttttctattggaacctctactgcagtgtccttttcctcacctgcatcagcgygcaccgctacctgggcatctgccacccacttcgggcactacgctggggccgccctcgcctcgcaggccttctctgcctggcagtttggttggtcgtagcc

SEQ ID NO: 2175 - DNA, 201 bp, Homo sapiens
gtgctgtcgctgcccaccctcatctactattatgcagcccacaaccactggccctttggcactgagatctgcaagttcgtccgctttcttttctattggamcctctactgcagtgtccttttcctcacctgcatcagcgtgcaccgctacctgggcatctgccacccacttcgggcactacgctggggccgccctcgcctc

SEQ ID NO: 2176 - DNA, 201 bp, Homo sapiens
gttccacctggcattgtcagacaccttgtatgtgctgtcgctgcccaccctcatctactattatgcagcccacaaccactggccctttggcactgagatcrgcaagttcgtccgctttcttttctattggaacctctactgcagtgtccttttcctcacctgcatcagcgtgcaccgctacctgggcatctgccacccact

SEQ ID NO: 2177 - DNA, 201 bp, Homo sapiens
aagggagcttgggtaggggccaggctagcctgagtgcacccagatgcgcttctgtcagctctccctagtgcttcaaccactgctctccctgctctactttrtttgctccagctcagggatgggggtgggcagggaaatcctgccaccctcacttctccccttcccatctccaggggggccatggccagtacagagtcctcc

SEQ ID NO: 2178 - DNA, 201 bp, Homo sapiens
acttcgggcactacgctggggccgccctcgcctcgcaggccttctctgcctggcagtttggttggtcgtagccggctgcctcgtgcccaacctgttctttktcacaaccagcaacaaagggaccaccgtcctgtgccatgacaccactcggcctgaagagtttgaccactatgtgcacttcagctcggcggtcatggggct

SEQ ID NO: 2179 - DNA, 201 bp, Homo sapiens
cgtcgcctgtatcagcccttgccaggctctgcacagtcgtcttctcgcctccgctctctccgcaccatagctgtggtgctgactgtctttgctgtctgctrcgtgcctttccacatcacccgcaccatttactacctggccaggctgttggaagctgactgccgagtactgaacattgtcaacgtggtctataaagtgact

SEQ ID NO: 2180 - DNA, 201 bp, Homo sapiens
ctcgcctcgcaggccttctctgcctggcagtttggttggtcgtagccggctgcctcgtgcccaacctgttctttgtcacaaccagcaacaaagggaccacmgtcctgtgccatgacaccactcggcctgaagagtttgaccactatgtgcacttcagctcggcggtcatggggctgctctttggcgtgccctgcctggtca

SEQ ID NO: 2181 - DNA, 201 bp, Homo sapiens
gctgtctgcttcgtgcctttccacatcacccgcaccatttactacctggccaggctgttggaagctgactgccgagtactgaacattgtcaacgtggtctrtaaagtgactcggcccctggccagtgccaacagctgcctggatcctgtgctctacttgctcactggggacaaatatcgacgtcagctccgtcagctctgt

SEQ ID NO: 2182 - DNA, 201 bp, Homo sapiens
cctttccacatcacccgcaccatttactacctggccaggctgttggaagctgactgccgagtactgaacattgtcaacgtggtctataaagtgactcggcrcctggccagtgccaacagctgcctggatcctgtgctctacttgctcactggggacaaatatcgacgtcagctccgtcagctctgtggtggtggcaagccc

SEQ ID NO: 2183 - DNA, 201 bp, Homo sapiens
ccttctctgcctggcagtttggttggtcgtagccggctgcctcgtgcccaacctgttctttgtcacaaccagcaacaaagggaccaccgtcctgtgccatracaccactcggcctgaagagtttgaccactatgtgcacttcagctcggcggtcatggggctgctctttggcgtgccctgcctggtcactcttgtttgcta

SEQ ID NO: 2184 - DNA, 201 bp, Homo sapiens
ctggggatgggatttgggggcagcccaggaggtggctctctaggtattctctcgggcaatgatggaggccttctttctggatcagaaaaagaaactatgcmaaatcttaatgatagattagcttcctacctggataaggtgcgagctctagaagaggctaatactgagctagaaaataaaattcgagaatggtatgaaaca

SEQ ID NO: 2185 - DNA, 201 bp, Homo sapiens
gatttgggggcagcccaggaggtggctctctaggtattctctcgggcaatgatggaggccttctttctggatcagaaaaagaaactatgcaaaatcttaakgatagattagcttcctacctggataaggtgcgagctctagaagaggctaatactgagctagaaaataaaattcgagaatggtatgaaacacgaggaactg

SEQ ID NO: 2186 - DNA, 201 bp, Homo sapiens
ttaggaacaagaaatttacaagtagaaattattcctttcagagtaacatgctgtattacttcaatccctatttttgtctgttccattttctttggattccytattcacattgaatcctttttgcccttctgaaacaatattcagtcacaagtcattttggtcatgttggtctttgtaacaaatcaaaattaccttatatcc

SEQ ID NO: 2187 - DNA, 201 bp, Homo sapiens
ggtggctctctaggtattctctcgggcaatgatggaggccttctttctggatcagaaaaagaaactatgcaaaatcttaatgatagattagcttcctacckggataaggtgcgagctctagaagaggctaatactgagctagaaaataaaattcgagaatggtatgaaacacgaggaactgggactgcagatgcttcacag

SEQ ID NO: 2188 - DNA, 201 bp, Homo sapiens
gggctggggatgggatttgggggcagcccaggaggtggctctctaggtattctctcgggcaatgatggaggccttctttctggatcagaaaaagaaactaygcaaaatcttaatgatagattagcttcctacctggataaggtgcgagctctagaagaggctaatactgagctagaaaataaaattcgagaatggtatgaa

SEQ ID NO: 2189 - DNA, 201 bp, Homo sapiens
caacctggaggcacagctgctccaggtgcgcgcggacgcagagcgccagaacgtggaccaccagcggctgctgaatgtcaaggcccgcctggagctggagrttgagacctaccgccgcctgctggacggggaggcccaaggtgatggtttggaggaaagtttatttgtgacagactccaaatcacaagcacagtcaactga

SEQ ID NO: 2190 - DNA, 201 bp, Homo sapiens
gctgctgaggacttcaggatgaagtatgagaatgaactggccctgcgccagggcgtagaggccgacatcaatggcctgcgccgggtgctggacgagctgaycctgaccaggaccgacctggagatgcagatcgagagcctgaacgaggagctggcctacatgaagaagaaccacgaggatgagctccaaagcttccgggtg

SEQ ID NO: 2191 - DNA, 201 bp, Homo sapiens
tcaggatgaagtatgagaatgaactggccctgcgccagggcgtagaggccgacatcaatggcctgcgccgggtgctggacgagctgaccctgaccaggacygacctggagatgcagatcgagagcctgaacgaggagctggcctacatgaagaagaaccacgaggatgagctccaaagcttccgggtgggcggcccaggcg

SEQ ID NO: 2192 - DNA, 167 bp, Homo sapiens
agttgtggccaccttccccaggccatggatctctccaacaacaccatgtcactctcagtgcgcaccyccggactgtcccggcggctctcctcgcagagtgtgataggcagacccaggggcatgtctgcttccagtgttggaagtggttatgggggaagtgcctttgg

SEQ ID NO: 2193 - DNA, 201 bp, Homo sapiens
gggggcagcccaggaggtggctctctaggtattctctcgggcaatgatggaggccttctttctggatcagaaaaagaaactatgcaaaatcttaatgatabattagcttcctacctggataaggtgcgagctctagaagaggctaatactgagctagaaaataaaattcgagaatggtatgaaacacgaggaactgggact

SEQ ID NO: 2194 - DNA, 201 bp, Homo sapiens
tctaggtattctctcgggcaatgatggaggccttctttctggatcagaaaaagaaactatgcaaaatcttaatgatagattagcttcctacctggataagstgcgagctctagaagaggctaatactgagctagaaaataaaattcgagaatggtatgaaacacgaggaactgggactgcagatgcttcacagagcgatta

SEQ ID NO: 2195 - DNA, 201 bp, Homo sapiens
tgggggcagcccaggaggtggctctctaggtattctctcgggcaatgatggaggccttctttctggatcagaaaaagaaactatgcaaaatcttaatgatrgattagcttcctacctggataaggtgcgagctctagaagaggctaatactgagctagaaaataaaattcgagaatggtatgaaacacgaggaactgggac

SEQ ID NO: 2196 - DNA, 182 bp, Homo sapiens
agttgtggccaccttccccaggccatggatctctccaacaacaccatgtcactctcagtgcgcacccccggactgtcccggyggctctcctcgcagagtgtgataggcagacccaggggcatgtctgcttccagtgttggaagtggttatgggggaagtgcctttggctttggagccagctg

SEQ ID NO: 2197 - DNA, 201 bp, Homo sapiens
gtggcctttgctggagaatgaggaaggccatgttgttgtttcatgtagagtaaatatttcttgagacacacctggagagaatgagctcctctcatgaggcygtcctgtggtctctgcaccttcactctgctgggtgtggaaagctgtggatatttttggaggtagagaactgggggagagtgctgttgacagagtgtctga

SEQ ID NO: 2198 - DNA, 201 bp, Homo sapiens
tatggtgggtgcgtcctgaggaacaatttctgagggcgagtgcccactggctgtgaaggaagaacctggggtggtgactgtcttggtgtcagtcatggggkagacggacctcgtggtttgtgattcttgtgtggtctgcggggcttgagtgtgacccctttgggaaacagctggtgattcctgaggagaggtgcttgtgga

SEQ ID NO: 2199 - DNA, 201 bp, Homo sapiens
cctggtgttgacactacagagttggccagagtaagggcacctgttttggaaagtgacgtgcctcctgagggccccagggtggcatcatggctgctgggtgytgcctgcagtgctgtggtcggggcctgggttgtgtgaccatccccggtgggagctggggcaaaggttgttgctgcacttatggtgggtgcgtcctgagga

SEQ ID NO: 2200 - DNA, 201 bp, Homo sapiens
aggaagaggggtggcgttgctgatgagggccgtggtgaaggttttaccagaccctgaaggtgacagagtgtgggtctgggtttgtggagatgtaagcccastggatgtgatcgatggaggtgtgggtgggactgttgagaaggtgtcggttgcctgggacgccaggctgatagtgtcagaccctctgctggttcttgtcct

SEQ ID NO: 2201 - DNA, 201 bp, Homo sapiens
gatgaagctgatatgtcctgattagaggtccttgaagaagctgcagttgattgtccctctagtgtcgctgttgttgagcctgttgaggtgactggggcagsagttttacttccagttattaatgtgtcctctgtggttcctggaaccacatgcggaaggaggcagagacacaggcagctcagggacacccaggggaccctc

SEQ ID NO: 2202 - DNA, 201 bp, Homo sapiens
gacacacctggagagaatgagctcctctcatgaggccgtcctgtggtctctgcaccttcactctgctgggtgtggaaagctgtggatatttttggaggtaragaactgggggagagtgctgttgacagagtgtctgaccaccatatggttgaaactttggaagtgattgcagaaatggttccacttacagatagtgatgtc

SEQ ID NO: 2203 - DNA, 201 bp, Homo sapiens
tgaccaccatatggttgaaactttggaagtgattgcagaaatggttccacttacagatagtgatgtctcctctgtgtttccaagagtagagtctctggagrttggcattctgaacacctttgatgttaccaggaatgtattgctgacactggaaggggatgagatggttgtttcaccagaagggaatgtctcctgagaaac

SEQ ID NO: 2204 - DNA, 201 bp, Homo sapiens
gagtgtgacccctttgggaaacagctggtgattcctgaggagaggtgcttgtggaatgtattgttgaatgatttgttgatggtgccgttgtaatttgttgkgatgtgtgtctatccagcataggtgaagaagatggggatgtggccgtttttatcatctgagtcacactgtagcttgggctgctgagaagagcctctccag

SEQ ID NO: 2205 - DNA, 201 bp, Homo sapiens
tgtctcctctgtgtttccaagagtagagtctctggagattggcattctgaacacctttgatgttaccaggaatgtattgctgacactggaaggggatgagrtggttgtttcaccagaagggaatgtctcctgagaaactgttccacttgggttgaatccacttggtgaggataaaacagttgatgttgtaaccggtgtgag

SEQ ID NO: 2206 - DNA, 201 bp, Homo sapiens
tagggtgctggtttgagattccctggtggtctgcgtgctccgagtccagtggttctgagaagaagctgatgtgtcttggatagaggtcctccaggaagttkttcgtgattgtccttcctgtccagctgttattgagactgctgaggtcactggggtagaactttcagttcctgctgttgatgtctcttctgtgtttccaag

SEQ ID NO: 2207 - DNA, 201 bp, Homo sapiens
gtggtctccacgctctgagtctggtggttcttagaaaaagctgttgtgtcctgagtagaagtccttgagaaagttgctggtgattgtccttctggatcaamtgttactaaggctgctgaggtgactggcataagacttccagtaacaggtactgatgatgtctcccctgggtttccaagagtggagcctgtggaggttgtc

SEQ ID NO: 2208 - DNA, 201 bp, Homo sapiens
gtaaccggtgtgagggtgttgagggtgttgatttgagatactctggtggtctccacgctctgagtctggtggttcttagaaaaagctgttgtgtcctgagkagaagtccttgagaaagttgctggtgattgtccttctggatcaactgttactaaggctgctgaggtgactggcataagacttccagtaacaggtactgat

SEQ ID NO: 2209 - DNA, 201 bp, Homo sapiens
gtttttgggagagttgtgctgtgggaggagtatgtggtgggctctcctggttcccctattgctgagaccttagaggggacccttggaatagtgccagctgyccctgtagatggatttcctgtgacaagcctagtggcagcacctgttgatgttgagggcagttctgtttgtgaccaagttgtgtggcctttgctggagaat

SEQ ID NO: 2210 - DNA, 201 bp, Homo sapiens
atgtccattgtggggtccagaaaagaaatgccacttttacaggaaaatagccatcaagcaacatcggcctctgagtctgcaacccttgacagatcatttakaaacctgaaaaagaaagaccgtggggtaggcagcactttattttgccaggatggtagattgctgcattcggaatgttcagagcctcctggaaatatgaga

SEQ ID NO: 2211 - DNA, 135 bp, Homo sapiens
gtccagcctcaaactctgcaacaccatataataagaacagaagatatcagcagtgacatatttagaagaagatatgcaacacccgcttcagccttggcagragaaagtcttgagaagcgtttaacaaatgaatca

SEQ ID NO: 2212 - DNA, 201 bp, Homo sapiens
gataaaggtcatgtccattgtggggtccagaaaagaaatgccacttttacaggaaaatagccatcaagcaacatcggcctctgagtctgcaacccttgacrgatcatttagaaacctgaaaaagaaagaccgtggggtaggcagcactttattttgccaggatggtagattgctgcattcggaatgttcagagcctcctgg

SEQ ID NO: 2213 - DNA, 201 bp, Homo sapiens
cctctattgagagcacaaacctgtctctcttgtttaatcttgccctgctctccctaagcagaaatggtatcgaggatgttcaggaagatgccctgcatggscttacgatgttgcggaccttgttgctggagcacaaccaaatatccagctcttcgctcactgatcacaccttcagcaagcttcacagcctgcaggtactgg

SEQ ID NO: 2214 - DNA, 201 bp, Homo sapiens
ttcgatgaacccctgtgtgctcatgaggcaagaaattaccacactaagggatactgcaactgccacttaactcaggaaaacgagataaaggtcatgtccaytgtggggtccagaaaagaaatgccacttttacaggaaaatagccatcaagcaacatcggcctctgagtctgcaacccttgacagatcatttagaaacctg

SEQ ID NO: 2215 - DNA, 201 bp, Homo sapiens
cacaaccaaatatccagctcttcgctcactgatcacaccttcagcaagcttcacagcctgcaggtactggtgctgagcaataatgctctccgcaccctacragggtcttggttccgaaacacaagcggcctgacccggctccagctggatgggaatcagattactaatctcacagacagttctttcggaggcacgaatctc

SEQ ID NO: 2216 - DNA, 201 bp, Homo sapiens
accctacgagggtcttggttccgaaacacaagcggcctgacccggctccagctggatgggaatcagattactaatctcacagacagttctttcggaggcasgaatctccacagtctcaggtatctggatttatccaacaattttatttcctacattgggaaagatgccttccggcccctgcctcaactacaggaagtggac

SEQ ID NO: 2217 - DNA, 154 bp, Homo sapiens
gaatcttgagcctggagaagtccagcctcaaactctgcaacaccatataataagaacagaagatatcagcagtgacatatttagaagaagatatgcaacamccgcttcagccttggcaggagaaagtcttgagaagcgtttaacaaatgaatca

SEQ ID NO: 2218 - DNA, 201 bp, Homo sapiens
tactgcaactgccacttaactcaggaaaacgagataaaggtcatgtccattgtggggtccagaaaagaaatgccacttttacaggaaaatagccatcaagyaacatcggcctctgagtctgcaacccttgacagatcatttagaaacctgaaaaagaaagaccgtggggtaggcagcactttattttgccaggatggtaga

SEQ ID NO: 2219 - DNA, 201 bp, Homo sapiens
tccggcccctgcctcaactacaggaagtggacctttcccgaaataggttagcccacatgccggatgtgtttactccactgaagcagttaatccttctgagyttagataagaaccagtggagctgcacttgtgatctccatccccttgctcggtttttaagaaactacattaagtcttctgctcacacgctcaggaatgcca

SEQ ID NO: 2220 - DNA, 201 bp, Homo sapiens
agaaacctgaaaaagaaagaccgtggggtaggcagcactttattttgccaggatggtagattgctgcattcggaatgttcagagcctcctggaaatatgasagcttttaatgaagcaggcttacttacaacatataatccaaggaaagttcaaaagctatggaatcttgagcctggagaagtccagcctcaaactctgcaa

SEQ ID NO: 2221 - DNA, 201 bp, Homo sapiens
ccacagtctcaggtatctggatttatccaacaattttatttcctacattgggaaagatgccttccggcccctgcctcaactacaggaagtggacctttccygaaataggttagcccacatgccggatgtgtttactccactgaagcagttaatccttctgagcttagataagaaccagtggagctgcacttgtgatctcca

SEQ ID NO: 2222 - DNA, 190 bp, Homo sapiens
aatggggccatcctctaaagtttattttagcttatttatccccccttcctgtcatcttctgtgaatcttcacaacccagtggagtaaackgcaggtgtgaactgttgagacacaggctcccacaatggagcattactgagggttgggaagtaatccagtcaaatcaagctgaaagacaaaaactcacgta

SEQ ID NO: 2223 - DNA, 201 bp, Homo sapiens
aacggcaggtgtgaactgttgagacacaggctcccacaatggagcattactgagggttgggaagtaatccagtcaaatcaagctgaaagacaaaaactcasgtacagttgtatcaaaatcttgtgttgcaattgacatttgatgttcatgaagttttctgaatgcttcttatttgcctttaactcaagaacataaactttt

SEQ ID NO: 2224 - DNA, 160 bp, Homo sapiens
aatggggccatcctctaaagtttattttagcttatttatccccccttcctgtcatcttcygtgaatcttcacaacccagtggagtaaacggcaggtgtgaactgttgagacacaggctcccacaatggagcattactgagggttgggaagtaatccagtc

SEQ ID NO: 2225 - DNA, 201 bp, Homo sapiens
atcctgctgctcacgctggtgtccttcctcattttcatactcttcatcatagtccagctcttcatcatgaagctgaggaaagcacatgtgatatggaagaragaaaacgaagtttcagaacacacactagaaagttacagatcaaggtcaaataatgaagaaacatcatctgaagagaaaaatggccaatcttcccaccct

SEQ ID NO: 2226 - DNA, 201 bp, Homo sapiens
atgtgctccaccatgagaagcaagccccctccgcagataacctggctacttgggaatagcatggaagtgtccggtggaacgctccatgaatttgaaactgrtgggaagaaatgtaatactaccagcactctcataatccacacttatggcaaaaattcaacggtggactgcattatccgacacagaggcctgcaagggaga

SEQ ID NO: 2227 - DNA, 201 bp, Homo sapiens
tggaagtgtccggtggaacgctccatgaatttgaaactgatgggaagaaatgtaatactaccagcactctcataatccacacttatggcaaaaattcaacrgtggactgcattatccgacacagaggcctgcaagggagaaaactagtagcacccttccggtttgaagatttggttactgatgaagagacagcttcagatg

SEQ ID NO: 2228 - DNA, 201 bp, Homo sapiens
tcaaggtcaaataatgaagaaacatcatctgaagagaaaaatggccaatcttcccaccctatgcgttgcatgaactacatcacaaagttgtactcagaagsaaaaacaaagaggaaggaaaatgtacaacattcaaaattagaagaaaagcacatccaagtaccagagagtattgtgtagtgctctctgcaatggaacatg

SEQ ID NO: 2229 - DNA, 147 bp, Homo sapiens
atgtggtggagagttctcagcttgctggcatggttccccttgcaagmggcctctctgactaaccacacagaaaccatcaccgtggaggaaggccagacgctcactctaaagtgtgtcacttctctgaggaagaactcctccctccag

SEQ ID NO: 2230 - DNA, 201 bp, Homo sapiens
catcatctgaagagaaaaatggccaatcttcccaccctatgcgttgcatgaactacatcacaaagttgtactcagaagcaaaaacaaagaggaaggaaaaygtacaacattcaaaattagaagaaaagcacatccaagtaccagagagtattgtgtagtgctctctgcaatggaacatgtgatttcagggttgccgcagtg

SEQ ID NO: 2231 - DNA, 201 bp, Homo sapiens
aactcctccctccagtggctgaccccctcagggttcaccatttttttaaatgagtatcctgctttaaaaaattccaaataccagcttcttcatcactcggmcaatcagctctccatcactgtgcctaacgtaaccctgcaagatgaaggcgtgtacaagtgcttacattacagcgactctgtaagcacaaaggaagtgaaa

SEQ ID NO: 2232 - DNA, 201 bp, Homo sapiens
cccaccctatgcgttgcatgaactacatcacaaagttgtactcagaagcaaaaacaaagaggaaggaaaatgtacaacattcaaaattagaagaaaagcamatccaagtaccagagagtattgtgtagtgctctctgcaatggaacatgtgatttcagggttgccgcagtgtcacctcagtggaccagcctgggggaagga

SEQ ID NO: 2233 - DNA, 201 bp, Homo sapiens
taattatgcctgacactacttcagagcaggaggattctacgaagccttggggatcagggtcagtgtgagcagctaacatcctacctcaaatggaacaggaktttttgatgctttgctctaatggaactgttttaaaaatttttttttctttttaatattttcttctggtcacaaaataaagaaatttgggatgcaaagtac

SEQ ID NO: 2234 - DNA, 201 bp, Homo sapiens
caacattcaaaattagaagaaaagcacatccaagtaccagagagtattgtgtagtgctctctgcaatggaacatgtgatttcagggttgccgcagtgtcamctcagtggaccagcctgggggaaggagcttaattgctgagacattaataatgacctcttagtgcaatgcaagatggtgtcctcggataatgatctgcccc

SEQ ID NO: 2235 - DNA, 201 bp, Homo sapiens
tgctggcaactccgttcaagccaatcctggaagcttcagttatcagaaagcaaaatggagaagaacatgttgtactcatgtgctccaccatgagaagcaarccccctccgcagataacctggctacttgggaatagcatggaagtgtccggtggaacgctccatgaatttgaaactgatgggaagaaatgtaatactacca

SEQ ID NO: 2236 - DNA, 201 bp, Homo sapiens
actctcattttgaatggcaataaactggagacactttctttagtaagttgctttgctaacaacacacccttggaacacttggatctgagtcaaaatctatyacaacataaaaatgatgaaaattgctcatggccagaaactgtggtcaatatgaatctgtcatacaataaattgtctgattctgtcttcaggtgcttgccc

SEQ ID NO: 2237 - DNA, 201 bp, Homo sapiens
gaaactgtggtcaatatgaatctgtcatacaataaattgtctgattctgtcttcaggtgcttgcccaaaagtattcaaatacttgacctaaataataaccyaatccaaactgtacctaaagagactattcatctgatggccttacgagaactaaatattgcatttaattttctaactgatctccctggatgcagtcatttc

SEQ ID NO: 2238 - DNA, 201 bp, Homo sapiens
ggcccaaggataggcgtaaatgtgggcttttctgggcaaaccttcgagctgctattaatgttaatgtattagccaccagagaaatgtatgaactgcagacyttcacagagttaaatgaagagtctcgaggttctacaatctctctgatgagaacagattgtctataaaatcccacagtccttgggaagttggggaccacat

SEQ ID NO: 2239 - DNA, 201 bp, Homo sapiens
ctctaagaaaggttcccgcagacttgaccccagccacaacgacactggatttatcctataacctcctttttcaactccagagttcagattttcattctgtrtccaaactgagagttttgattctatgccataacagaattcaacagctggatctcaaaacctttgaattcaacaaggagttaagatatttagatttgtcta

SEQ ID NO: 2240 - DNA, 201 bp, Homo sapiens
tgatcatataattcttatcttactggaacccattccattctattgcattcccaccaggtatcataaactgaaagctctcctggaaaaaaaagcatacttgraatggcccaaggataggcgtaaatgtgggcttttctgggcaaaccttcgagctgctattaatgttaatgtattagccaccagagaaatgtatgaactgca

SEQ ID NO: 2241 - DNA, 201 bp, Homo sapiens
tgtaacttggtatttactggcaggtctcaggtatttagatctttcttttaatgactttgacaccatgcctatctgtgaggaagctggcaacatgtcacacktggaaatcctaggtttgagtggggcaaaaatacaaaaatcagatttccagaaaattgctcatctgcatctaaatactgtcttcttaggattcagaactct

SEQ ID NO: 2242 - DNA, 48 bp, Homo sapiens
atcgagccactgcactccagcctggtgacagagcgagactccatctcm

SEQ ID NO: 2243 - DNA, 201 bp, Homo sapiens
ttgaccctggcaaaagcattagtgaaaatattgtaagcttcattgagaaaagctataagtccatctttgttttgtctcccaactttgtccagaatgagtgytgccattatgaattctactttgcccaccacaatctcttccatgaaaattctgatcatataattcttatcttactggaacccattccattctattgcattc

SEQ ID NO: 2244 - DNA, 201 bp, Homo sapiens
aagttgatttactctgggacgaccttttccttatcttacaatttgtttggcatacatcagtggaacactttcagatccgaaatgtgacttttggtggtaargcttatcttgaccacaattcatttgactactcaaatactgtaatgagaactataaaattggagcatgtacatttcagagtgttttacattcaacaggata

SEQ ID NO: 2245 - DNA, 201 bp, Homo sapiens
ggataaaatctatttgcttttgaccaaaatggacatagaaaacctgacaatatcaaatgcacaaatgccacacatgcttttcccgaattatcctacgaaamtccaatatttaaattttgccaataatatcttaacagacgagttgtttaaaagaactatccaactgcctcacttgaaaactctcattttgaatggcaataa

SEQ ID NO: 2246 - DNA, 90 bp, Homo sapiens
gaatcgcttgaacccgggaggtggcagttgcagtgagctgagatcgagccactgcactccagcctggtgacagagcgagactccatctcr

SEQ ID NO: 2247 - DNA, 201 bp, Homo sapiens
gctctcctggaaaaaaaagcatacttggaatggcccaaggataggcgtaaatgtgggcttttctgggcaaaccttcgagctgctattaatgttaatgtatragccaccagagaaatgtatgaactgcagacattcacagagttaaatgaagagtctcgaggttctacaatctctctgatgagaacagattgtctataaaat

SEQ ID NO: 2248 - DNA, 201 bp, Homo sapiens
ttgactactcaaatactgtaatgagaactataaaattggagcatgtacatttcagagtgttttacattcaacaggataaaatctatttgcttttgaccaakatggacatagaaaacctgacaatatcaaatgcacaaatgccacacatgcttttcccgaattatcctacgaaattccaatatttaaattttgccaataata

SEQ ID NO: 2249 - DNA, 201 bp, Homo sapiens
aaacacaacaaaactgcacattgttttaccaatggacacaaatttctgggttcttttgcgtgatggaatcaagacttcaaaaatattagaaatgacaaatmtagatggcaaaagccaatttgtaagttatgaaatgcaacgaaatcttagtttagaaaatgctaagacatcggttctattgcttaataaagttgatttact

SEQ ID NO: 2250 - DNA, 201 bp, Homo sapiens
atacaatgagactcatcagaaacatttacatattttgtagtattgttatgacagcagagggtgatgctccagagctgccagaagaaagggaactgatgacraactgctccaacatgtctctaagaaaggttcccgcagacttgaccccagccacaacgacactggatttatcctataacctcctttttcaactccagagtt

SEQ ID NO: 2251 - DNA, 201 bp, Homo sapiens
ggttctattgcttaataaagttgatttactctgggacgaccttttccttatcttacaatttgtttggcatacatcagtggaacactttcagatccgaaatrtgacttttggtggtaaggcttatcttgaccacaattcatttgactactcaaatactgtaatgagaactataaaattggagcatgtacatttcagagtgtt

SEQ ID NO: 2252 - DNA, 201 bp, Homo sapiens
tttcagatccgaaatgtgacttttggtggtaaggcttatcttgaccacaattcatttgactactcaaatactgtaatgagaactataaaattggagcatgyacatttcagagtgttttacattcaacaggataaaatctatttgcttttgaccaaaatggacatagaaaacctgacaatatcaaatgcacaaatgccacac

SEQ ID NO: 2253 - DNA, 201 bp, Homo sapiens
taaaatctatttgcttttgaccaaaatggacatagaaaacctgacaatatcaaatgcacaaatgccacacatgcttttcccgaattatcctacgaaattcyaatatttaaattttgccaataatatcttaacagacgagttgtttaaaagaactatccaactgcctcacttgaaaactctcattttgaatggcaataaact

SEQ ID NO: 2254 - DNA, 201 bp, Homo sapiens
gaaaacctgacaatatcaaatgcacaaatgccacacatgcttttcccgaattatcctacgaaattccaatatttaaattttgccaataatatcttaacagrcgagttgtttaaaagaactatccaactgcctcacttgaaaactctcattttgaatggcaataaactggagacactttctttagtaagttgctttgctaac

SEQ ID NO: 2255 - DNA, 201 bp, Homo sapiens
gtttttcaacattaatactattatttggcagtaatccagattgcttttgccaccaacctgaagacatatagaggcagaaggacaggaataattctatttgmttcctgttttgaaacttccatctgtaaggctatcaaaaggagatgtgagagagggtattgagtctggcctgacaatgcagttcttaaaccaaaggtccat

SEQ ID NO: 2256 - DNA, 201 bp, Homo sapiens
aacaacacacccttggaacacttggatctgagtcaaaatctattacaacataaaaatgatgaaaattgctcatggccagaaactgtggtcaatatgaatcygtcatacaataaattgtctgattctgtcttcaggtgcttgcccaaaagtattcaaatacttgacctaaataataaccaaatccaaactgtacctaaagag

SEQ ID NO: 2257 - DNA, 201 bp, Homo sapiens
tgcttgcccaaaagtattcaaatacttgacctaaataataaccaaatccaaactgtacctaaagagactattcatctgatggccttacgagaactaaataytgcatttaattttctaactgatctccctggatgcagtcatttcagtagactttcagttctgaacattgaaatgaacttcattctcagcccatctctggat

SEQ ID NO: 2258 - DNA, 201 bp, Homo sapiens
atgttaatgtattagccaccagagaaatgtatgaactgcagacattcacagagttaaatgaagagtctcgaggttctacaatctctctgatgagaacagaytgtctataaaatcccacagtccttgggaagttggggaccacatacactgttgggatgtacattgatacaacctttatgatggcaatttgacaatatttat

SEQ ID NO: 2259 - DNA, 201 bp, Homo sapiens
ataacctcctttttcaactccagagttcagattttcattctgtctccaaactgagagttttgattctatgccataacagaattcaacagctggatctcaaracctttgaattcaacaaggagttaagatatttagatttgtctaataacagactgaagagtgtaacttggtatttactggcaggtctcaggtatttagatc

SEQ ID NO: 2260 - DNA, 201 bp, Homo sapiens
gtatcataaactgaaagctctcctggaaaaaaaagcatacttggaatggcccaaggataggcgtaaatgtgggcttttctgggcaaaccttcgagctgctrttaatgttaatgtattagccaccagagaaatgtatgaactgcagacattcacagagttaaatgaagagtctcgaggttctacaatctctctgatgagaac

SEQ ID NO: 2261 - DNA, 201 bp, Homo sapiens
tgacaccatgcctatctgtgaggaagctggcaacatgtcacacctggaaatcctaggtttgagtggggcaaaaatacaaaaatcagatttccagaaaattkctcatctgcatctaaatactgtcttcttaggattcagaactcttcctcattatgaagaaggtagcctgcccatcttaaacacaacaaaactgcacattgt

SEQ ID NO: 2262 - DNA, 201 bp, Homo sapiens
agtccatctttgttttgtctcccaactttgtccagaatgagtggtgccattatgaattctactttgcccaccacaatctcttccatgaaaattctgatcayataattcttatcttactggaacccattccattctattgcattcccaccaggtatcataaactgaaagctctcctggaaaaaaaagcatacttggaatggc

SEQ ID NO: 2263 - DNA, 201 bp, Homo sapiens
cagtggaacactttcagatccgaaatgtgacttttggtggtaaggcttatcttgaccacaattcatttgactactcaaatactgtaatgagaactataaarttggagcatgtacatttcagagtgttttacattcaacaggataaaatctatttgcttttgaccaaaatggacatagaaaacctgacaatatcaaatgcac

SEQ ID NO: 2264 - DNA, 201 bp, Homo sapiens
tgcacaaatgccacacatgcttttcccgaattatcctacgaaattccaatatttaaattttgccaataatatcttaacagacgagttgtttaaaagaactmtccaactgcctcacttgaaaactctcattttgaatggcaataaactggagacactttctttagtaagttgctttgctaacaacacacccttggaacactt

SEQ ID NO: 2265 - DNA, 33 bp, Homo sapiens
tccagcctggtgacagagcgagactccatctcr

SEQ ID NO: 2266 - DNA, 201 bp, Homo sapiens
cttttctgggcaaaccttcgagctgctattaatgttaatgtattagccaccagagaaatgtatgaactgcagacattcacagagttaaatgaagagtctcraggttctacaatctctctgatgagaacagattgtctataaaatcccacagtccttgggaagttggggaccacatacactgttgggatgtacattgataca

SEQ ID NO: 2267 - DNA, 201 bp, Homo sapiens
tgttttacattcaacaggataaaatctatttgcttttgaccaaaatggacatagaaaacctgacaatatcaaatgcacaaatgccacacatgcttttccckaattatcctacgaaattccaatatttaaattttgccaataatatcttaacagacgagttgtttaaaagaactatccaactgcctcacttgaaaactctca

SEQ ID NO: 2268 - DNA, 201 bp, Homo sapiens
gcgtgatggaatcaagacttcaaaaatattagaaatgacaaatatagatggcaaaagccaatttgtaagttatgaaatgcaacgaaatcttagtttagaamatgctaagacatcggttctattgcttaataaagttgatttactctgggacgaccttttccttatcttacaatttgtttggcatacatcagtggaacactt

SEQ ID NO: 2269 - DNA, 201 bp, Homo sapiens
agggtgatgctccagagctgccagaagaaagggaactgatgaccaactgctccaacatgtctctaagaaaggttcccgcagacttgaccccagccacaacracactggatttatcctataacctcctttttcaactccagagttcagattttcattctgtctccaaactgagagttttgattctatgccataacagaattc

SEQ ID NO: 2270 - DNA, 201 bp, Homo sapiens
atttgtttggcatacatcagtggaacactttcagatccgaaatgtgacttttggtggtaaggcttatcttgaccacaattcatttgactactcaaatactrtaatgagaactataaaattggagcatgtacatttcagagtgttttacattcaacaggataaaatctatttgcttttgaccaaaatggacatagaaaacct

SEQ ID NO: 2271 - DNA, 201 bp, Homo sapiens
gactactcaaatactgtaatgagaactataaaattggagcatgtacatttcagagtgttttacattcaacaggataaaatctatttgcttttgaccaaaayggacatagaaaacctgacaatatcaaatgcacaaatgccacacatgcttttcccgaattatcctacgaaattccaatatttaaattttgccaataatatc

SEQ ID NO: 2272 - DNA, 201 bp, Homo sapiens
acaaatgccacacatgcttttcccgaattatcctacgaaattccaatatttaaattttgccaataatatcttaacagacgagttgtttaaaagaactatcyaactgcctcacttgaaaactctcattttgaatggcaataaactggagacactttctttagtaagttgctttgctaacaacacacccttggaacacttgga

SEQ ID NO: 2273 - DNA, 201 bp, Homo sapiens
acgaaattccaatatttaaattttgccaataatatcttaacagacgagttgtttaaaagaactatccaactgcctcacttgaaaactctcattttgaatgrcaataaactggagacactttctttagtaagttgctttgctaacaacacacccttggaacacttggatctgagtcaaaatctattacaacataaaaatgat

SEQ ID NO: 2274 - DNA, 201 bp, Homo sapiens
ctggagaaaagccatacaaatgtgagaagtgtggaaagggctacaatagtaagtttaatcttgatatgcaccagaaggtccacacaggagagagaccatayaattgtaaggaatgtgggaagagttttggctgggcctcgtgtcttttgaaacatcagagactgcacagtggagaaaaaccattcaaatgtgaagagtgtg

SEQ ID NO: 2275 - DNA, 201 bp, Homo sapiens
agaagtgtggaaagggctacaatagtaagtttaatcttgatatgcaccagaaggtccacacaggagagagaccatacaattgtaaggaatgtgggaagagytttggctgggcctcgtgtcttttgaaacatcagagactgcacagtggagaaaaaccattcaaatgtgaagagtgtgggaaaagatttactcagaattcac

SEQ ID NO: 2276 - DNA, 201 bp, Homo sapiens
ttcattcccatcagagagttcacactggagaaaagccatacaaatgtgagaagtgtggaaagggctacaatagtaagtttaatcttgatatgcaccagaasgtccacacaggagagagaccatacaattgtaaggaatgtgggaagagttttggctgggcctcgtgtcttttgaaacatcagagactgcacagtggagaaa

SEQ ID NO: 2277 - DNA, 201 bp, Homo sapiens
agaaggtccacacaggagagagaccatacaattgtaaggaatgtgggaagagttttggctgggcctcgtgtcttttgaaacatcagagactgcacagtggrgaaaaaccattcaaatgtgaagagtgtgggaaaagatttactcagaattcacagcttcattctcatcaaagagtgcacactggagaaaagccatacaaat

SEQ ID NO: 2278 - DNA, 201 bp, Homo sapiens
tcttcattcccatcagagagttcacactggagaaaagccatacaaatgtgagaagtgtggaaagggctacaatagtaagtttaatcttgatatgcaccagmaggtccacacaggagagagaccatacaattgtaaggaatgtgggaagagttttggctgggcctcgtgtcttttgaaacatcagagactgcacagtggaga

SEQ ID NO: 2279 - DNA, 201 bp, Homo sapiens
acacaggagagagaccatacaattgtaaggaatgtgggaagagttttggctgggcctcgtgtcttttgaaacatcagagactgcacagtggagaaaaaccwttcaaatgtgaagagtgtgggaaaagatttactcagaattcacagcttcattctcatcaaagagtgcacactggagaaaagccatacaaatgtgatgagt

SEQ ID NO: 2280 - DNA, 201 bp, Homo sapiens
atttactcaaaattcacatcttcattcccatcagagagttcacactggagaaaagccatacaaatgtgagaagtgtggaaagggctacaatagtaagtttratcttgatatgcaccagaaggtccacacaggagagagaccatacaattgtaaggaatgtgggaagagttttggctgggcctcgtgtcttttgaaacatca

SEQ ID NO: 2281 - DNA, 201 bp, Homo sapiens
ggaagagatttactcaaaattcacatcttcattcccatcagagagttcacactggagaaaagccatacaaatgtgagaagtgtggaaagggctacaatagkaagtttaatcttgatatgcaccagaaggtccacacaggagagagaccatacaattgtaaggaatgtgggaagagttttggctgggcctcgtgtcttttga

SEQ ID NO: 2282 - DNA, 201 bp, Homo sapiens
gctttatttgtaggcgagatctttatacgcatcatatggtccacacgggagaaaagccatataattgtaaagagtgtgggaagagcttcagatgggcctcrtgtcttttgaaacatcagcgagtccacagtggagaaaaaccattcaaatgtgaagaatgtgggaaaggattttacacaaattcacaatgctattcccacc

SEQ ID NO: 2283 - DNA, 201 bp, Homo sapiens
agacagaaatcttcccagggcaatggatataaaccatccttcagtgatgtctcccactttgattttcatcaacaattacactcaggagagaaatctcataygtgtgatgagtgtggaaagaacttttgttacatctcagcccttcgtattcatcagagagtccacatgggagagaaatgctataagtgtgacgtgtgtggt

SEQ ID NO: 2284 - DNA, 201 bp, Homo sapiens
gaaacatgagagactccacagtggagaaaaaccattccaatgtgaagagtgtgggaagagatttactcaaaattcacatcttcattcccatcagagagttsacactggagaaaagccatacaaatgtgagaagtgtggaaagggctacaatagtaagtttaatcttgatatgcaccagaaggtccacacaggagagagacc

SEQ ID NO: 2285 - DNA, 201 bp, Homo sapiens
gcccacgtaccaggggctgtcttggcacaattctgctttcccaggaactgcatcactcaggactctgcaagtttccagaagtaagagggaaaatgaccacrttcaaggaggcaatgaccttcaaggacgtggctgtggtcttcactgaggaagagctggggctgctggaccttgctcagaggaagctgtatcgagatgtga

SEQ ID NO: 2286 - DNA, 201 bp, Homo sapiens
agtgtggaaagggctacaatagtaagtttaatcttgatatgcaccagaaggtccacacaggagagagaccatacaattgtaaggaatgtgggaagagtttwggctgggcctcgtgtcttttgaaacatcagagactgcacagtggagaaaaaccattcaaatgtgaagagtgtgggaaaagatttactcagaattcacagc

SEQ ID NO: 2287 - DNA, 201 bp, Homo sapiens
cttcattcccatcagagagttcacactggagaaaagccatacaaatgtgagaagtgtggaaagggctacaatagtaagtttaatcttgatatgcaccagarggtccacacaggagagagaccatacaattgtaaggaatgtgggaagagttttggctgggcctcgtgtcttttgaaacatcagagactgcacagtggagaa

SEQ ID NO: 2288 - DNA, 201 bp, Homo sapiens
acactggagaaaagccatacaaatgtgagaagtgtggaaagggctacaatagtaagtttaatcttgatatgcaccagaaggtccacacaggagagagaccrtacaattgtaaggaatgtgggaagagttttggctgggcctcgtgtcttttgaaacatcagagactgcacagtggagaaaaaccattcaaatgtgaagagt

SEQ ID NO: 2289 - DNA, 201 bp, Homo sapiens
ctggtcctcaactcgtctgacccatcagagacgccacagcagagaaacacctctcaaatgtgagcagcatgggaagaacattgtacagaattcattctctraagtgcaagaaaaagttcacagtgtagaaaagccatacaaatgtgaggactgtgggaagggctacaacaggcgcttgaatcttgatatgcatcagagggt

SEQ ID NO: 2290 - DNA, 201 bp, Homo sapiens
catcagcgagtccacagtggagaaaaaccattcaaatgtgaagaatgtgggaaaggattttacacaaattcacaatgctattcccaccagagatcccatastggagaaaaaccatacaaatgtgtggagtgtgggaagggctacaaaaggaggttggatcttgactttcaccagcgcgtccatacaggagagaaactgtat

SEQ ID NO: 2291 - DNA, 201 bp, Homo sapiens
acagctatcattcaggagacaggccttagaaagagtaagagttcatgaatttaccagactaatggtggacatgtccaaattgatgtccactagaatgtaarctacatgtgtctttgctgctaagtcgtcacagccttaacattgattagcactttgtatgtgttcagtacttgtttgttaaatcaatgaaaggataaaaca

SEQ ID NO: 2292 - DNA, 201 bp, Homo sapiens
tgagatggagactgtttcagaagcaggaacacatcaagagtggtccttccagcaaatctgggaaaaaattgcaagtgatttaaccaggtctcaagacttgrtgataaatagctctcagttctccaaagaaggtgatttcccctgccagactgaggcaggactatctgtaattcacacaagacagaaatcttcccagggcaa

SEQ ID NO: 2293 - DNA, 201 bp, Homo sapiens
gttcacactggagaaaagccatacaaatgtgagaagtgtggaaagggctacaatagtaagtttaatcttgatatgcaccagaaggtccacacaggagagaraccatacaattgtaaggaatgtgggaagagttttggctgggcctcgtgtcttttgaaacatcagagactgcacagtggagaaaaaccattcaaatgtgaa

SEQ ID NO: 2294 - DNA, 201 bp, Homo sapiens
atctgcaaactcatcagagagtccacactggagagaaaccgttcaaatgtgtggaatgtgggaaaggcttcagtcgtagatcagcacttaatgttcatcayaaattacacacaggagagaaaccttataattgtgaggaatgcgggaaggccttcattcacgattcccagcttcaagaacatcagagaatccatacggggg

SEQ ID NO: 2295 - DNA, 201 bp, Homo sapiens
ggctacaatagtaagtttaatcttgatatgcaccagaaggtccacacaggagagagaccatacaattgtaaggaatgtgggaagagttttggctgggcctygtgtcttttgaaacatcagagactgcacagtggagaaaaaccattcaaatgtgaagagtgtgggaaaagatttactcagaattcacagcttcattctcat

SEQ ID NO: 2296 - DNA, 201 bp, Homo sapiens
ggcagagaaaccattccgatgtgatacgtgtgataagagctttcgtcagagatcagcacttaatagtcatcgcatgatccacacaggagagaaaccatacraatgtgaggagtgtggaaaaggctttatttgtaggcgagatctttatacgcatcatatggtccacacgggagaaaagccatataattgtaaagagtgtgg

SEQ ID NO: 2297 - DNA, 201 bp, Homo sapiens
atcataaattacacacaggagagaaaccttataattgtgaggaatgcgggaaggccttcattcacgattcccagcttcaagaacatcagagaatccatackggggagaagccattcaaatgtgatatatgtggtaagagcttctgtggtagatcaagacttaataggcattccatggttcacacggcagagaaaccattcc

SEQ ID NO: 2298 - DNA, 201 bp, Homo sapiens
gatttcccctgccagactgaggcaggactatctgtaattcacacaagacagaaatcttcccagggcaatggatataaaccatccttcagtgatgtctcccwctttgattttcatcaacaattacactcaggagagaaatctcatacgtgtgatgagtgtggaaagaacttttgttacatctcagcccttcgtattcatcag

SEQ ID NO: 2299 - DNA, 201 bp, Homo sapiens
accatacaaatgtgaggagtgtggaaaaggctttatttgtaggcgagatctttatacgcatcatatggtccacacgggagaaaagccatataattgtaaasagtgtgggaagagcttcagatgggcctcgtgtcttttgaaacatcagcgagtccacagtggagaaaaaccattcaaatgtgaagaatgtgggaaaggatt

SEQ ID NO: 2300 - DNA, 201 bp, Homo sapiens
gatttactcaaaattcacatcttcattcccatcagagagttcacactggagaaaagccatacaaatgtgagaagtgtggaaagggctacaatagtaagttkaatcttgatatgcaccagaaggtccacacaggagagagaccatacaattgtaaggaatgtgggaagagttttggctgggcctcgtgtcttttgaaacatc

SEQ ID NO: 2301 - DNA, 201 bp, Homo sapiens
caaagaaggtgatttcccctgccagactgaggcaggactatctgtaattcacacaagacagaaatcttcccagggcaatggatataaaccatccttcagtratgtctcccactttgattttcatcaacaattacactcaggagagaaatctcatacgtgtgatgagtgtggaaagaacttttgttacatctcagcccttcg

SEQ ID NO: 2302 - DNA, 201 bp, Homo sapiens
aagagatttactcaaaattcacatcttcattcccatcagagagttcacactggagaaaagccatacaaatgtgagaagtgtggaaagggctacaatagtargtttaatcttgatatgcaccagaaggtccacacaggagagagaccatacaattgtaaggaatgtgggaagagttttggctgggcctcgtgtcttttgaaa

SEQ ID NO: 2303 - DNA, 201 bp, Homo sapiens
agacttaataggcattccatggttcacacggcagagaaaccattccgatgtgatacgtgtgataagagctttcgtcagagatcagcacttaatagtcatcrcatgatccacacaggagagaaaccatacaaatgtgaggagtgtggaaaaggctttatttgtaggcgagatctttatacgcatcatatggtccacacggga

SEQ ID NO: 2304 - DNA, 201 bp, Homo sapiens
gtgggaagagatttactcaaaattcacatcttcattcccatcagagagttcacactggagaaaagccatacaaatgtgagaagtgtggaaagggctacaawagtaagtttaatcttgatatgcaccagaaggtccacacaggagagagaccatacaattgtaaggaatgtgggaagagttttggctgggcctcgtgtcttt

SEQ ID NO: 2305 - DNA, 201 bp, Homo sapiens
cgtgtcttttgaaacatcagcgagtccacagtggagaaaaaccattcaaatgtgaagaatgtgggaaaggattttacacaaattcacaatgctattcccaycagagatcccatagtggagaaaaaccatacaaatgtgtggagtgtgggaagggctacaaaaggaggttggatcttgactttcaccagcgcgtccatacag

SEQ ID NO: 2306 - DNA, 201 bp, Homo sapiens
ttaccagactaatggtggacatgtccaaattgatgtccactagaatgtaaactacatgtgtctttgctgctaagtcgtcacagccttaacattgattagchctttgtatgtgttcagtacttgtttgttaaatcaatgaaaggataaaacatatgtatggatttggatacaattttgtgtatccaaaaagggaagcctgca

SEQ ID NO: 2307 - DNA, 201 bp, Homo sapiens
catataattgtaaagagtgtgggaagagcttcagatgggcctcgtgtcttttgaaacatcagcgagtccacagtggagaaaaaccattcaaatgtgaagartgtgggaaaggattttacacaaattcacaatgctattcccaccagagatcccatagtggagaaaaaccatacaaatgtgtggagtgtgggaagggctaca

SEQ ID NO: 2308 - DNA, 201 bp, Homo sapiens
aaaattcacatcttcattcccatcagagagttcacactggagaaaagccatacaaatgtgagaagtgtggaaagggctacaatagtaagtttaatcttgayatgcaccagaaggtccacacaggagagagaccatacaattgtaaggaatgtgggaagagttttggctgggcctcgtgtcttttgaaacatcagagactgc

SEQ ID NO: 2309 - DNA, 201 bp, Homo sapiens
gggagaaaagccatataattgtaaagagtgtgggaagagcttcagatgggcctcgtgtcttttgaaacatcagcgagtccacagtggagaaaaaccattcmaatgtgaagaatgtgggaaaggattttacacaaattcacaatgctattcccaccagagatcccatagtggagaaaaaccatacaaatgtgtggagtgtgg

SEQ ID NO: 2310 - DNA, 201 bp, Homo sapiens
agatctttatacgcatcatatggtccacacgggagaaaagccatataattgtaaagagtgtgggaagagcttcagatgggcctcgtgtcttttgaaacatsagcgagtccacagtggagaaaaaccattcaaatgtgaagaatgtgggaaaggattttacacaaattcacaatgctattcccaccagagatcccatagtgg

SEQ ID NO: 2311 - DNA, 201 bp, Homo sapiens
tgtgggaagagttttggctgggcctcgtgtcttttgaaacatcagagactgcacagtggagaaaaaccattcaaatgtgaagagtgtgggaaaagatttaytcagaattcacagcttcattctcatcaaagagtgcacactggagaaaagccatacaaatgtgatgagtgtgggaagggcttcagctggtcctcaactcgt

SEQ ID NO: 2312 - DNA, 201 bp, Homo sapiens
aacatcagcgagtccacagtggagaaaaaccattcaaatgtgaagaatgtgggaaaggattttacacaaattcacaatgctattcccaccagagatcccayagtggagaaaaaccatacaaatgtgtggagtgtgggaagggctacaaaaggaggttggatcttgactttcaccagcgcgtccatacaggagagaaactgt

SEQ ID NO: 2313 - DNA, 201 bp, Homo sapiens
tctttatacgcatcatatggtccacacgggagaaaagccatataattgtaaagagtgtgggaagagcttcagatgggcctcgtgtcttttgaaacatcagmgagtccacagtggagaaaaaccattcaaatgtgaagaatgtgggaaaggattttacacaaattcacaatgctattcccaccagagatcccatagtggaga

SEQ ID NO: 2314 - DNA, 201 bp, Homo sapiens
tgggaagagcttcagatgggcctcgtgtcttttgaaacatcagcgagtccacagtggagaaaaaccattcaaatgtgaagaatgtgggaaaggattttacwcaaattcacaatgctattcccaccagagatcccatagtggagaaaaaccatacaaatgtgtggagtgtgggaagggctacaaaaggaggttggatcttga

SEQ ID NO: 2315 - DNA, 201 bp, Homo sapiens
tgatccacacaggagagaaaccatacaaatgtgaggagtgtggaaaaggctttatttgtaggcgagatctttatacgcatcatatggtccacacgggagaraagccatataattgtaaagagtgtgggaagagcttcagatgggcctcgtgtcttttgaaacatcagcgagtccacagtggagaaaaaccattcaaatgtg

SEQ ID NO: 2316 - DNA, 201 bp, Homo sapiens
aggctttatttgtaggcgagatctttatacgcatcatatggtccacacgggagaaaagccatataattgtaaagagtgtgggaagagcttcagatgggccycgtgtcttttgaaacatcagcgagtccacagtggagaaaaaccattcaaatgtgaagaatgtgggaaaggattttacacaaattcacaatgctattccca

SEQ ID NO: 2317 - DNA, 201 bp, Homo sapiens
agtgtggaaaaggctttatttgtaggcgagatctttatacgcatcatatggtccacacgggagaaaagccatataattgtaaagagtgtgggaagagcttyagatgggcctcgtgtcttttgaaacatcagcgagtccacagtggagaaaaaccattcaaatgtgaagaatgtgggaaaggattttacacaaattcacaat

SEQ ID NO: 2318 - DNA, 201 bp, Homo sapiens
aaccatacaaatgtgaggagtgtggaaaaggctttatttgtaggcgagatctttatacgcatcatatggtccacacgggagaaaagccatataattgtaargagtgtgggaagagcttcagatgggcctcgtgtcttttgaaacatcagcgagtccacagtggagaaaaaccattcaaatgtgaagaatgtgggaaaggat

SEQ ID NO: 2319 - DNA, 201 bp, Homo sapiens; identical to SEQ ID NO: 2274

SEQ ID NO: 2320 - DNA, 201 bp, Homo sapiens; identical to SEQ ID NO: 2275

SEQ ID NO: 2321 - DNA, 201 bp, Homo sapiens; identical to SEQ ID NO: 2276

SEQ ID NO: 2322 - DNA, 201 bp, Homo sapiens; identical to SEQ ID NO: 2277

SEQ ID NO: 2323 - DNA, 201 bp, Homo sapiens; identical to SEQ ID NO: 2278

SEQ ID NO: 2324 - DNA, 201 bp, Homo sapiens; identical to SEQ ID NO: 2279

SEQ ID NO: 2325 - DNA, 201 bp, Homo sapiens; identical to SEQ ID NO: 2280

SEQ ID NO: 2326 - DNA, 201 bp, Homo sapiens; identical to SEQ ID NO: 2281

SEQ ID NO: 2327 - DNA, 201 bp, Homo sapiens; identical to SEQ ID NO: 2282

SEQ ID NO: 2328 - DNA, 201 bp, Homo sapiens; identical to SEQ ID NO: 2283

SEQ ID NO: 2329 - DNA, 201 bp, Homo sapiens; identical to SEQ ID NO: 2284

SEQ ID NO: 2330 - DNA, 201 bp, Homo sapiens; identical to SEQ ID NO: 2285

SEQ ID NO: 2331 - DNA, 201 bp, Homo sapiens; identical to SEQ ID NO: 2286

SEQ ID NO: 2332 - DNA, 201 bp, Homo sapiens; identical to SEQ ID NO: 2287

SEQ ID NO: 2333 - DNA, 201 bp, Homo sapiens; identical to SEQ ID NO: 2288

SEQ ID NO: 2334 - DNA, 201 bp, Homo sapiens; identical to SEQ ID NO: 2289

SEQ ID NO: 2335 - DNA, 201 bp, Homo sapiens; identical to SEQ ID NO: 2290

SEQ ID NO: 2336 - DNA, 201 bp, Homo sapiens; identical to SEQ ID NO: 2291

SEQ ID NO: 2337 - DNA, 201 bp, Homo sapiens; identical to SEQ ID NO: 2292

SEQ ID NO: 2338 - DNA, 201 bp, Homo sapiens; identical to SEQ ID NO: 2293

SEQ ID NO: 2339 - DNA, 201 bp, Homo sapiens; identical to SEQ ID NO: 2294

SEQ ID NO: 2340 - DNA, 201 bp, Homo sapiens; identical to SEQ ID NO: 2295

SEQ ID NO: 2341 - DNA, 201 bp, Homo sapiens; identical to SEQ ID NO: 2296

SEQ ID NO: 2342 - DNA, 201 bp, Homo sapiens; identical to SEQ ID NO: 2297

SEQ ID NO: 2343 - DNA, 201 bp, Homo sapiens; identical to SEQ ID NO: 2298

SEQ ID NO: 2344 - DNA, 201 bp, Homo sapiens; identical to SEQ ID NO: 2299

SEQ ID NO: 2345 - DNA, 201 bp, Homo sapiens; identical to SEQ ID NO: 2300

SEQ ID NO: 2346 - DNA, 201 bp, Homo sapiens; identical to SEQ ID NO: 2301

SEQ ID NO: 2347 - DNA, 201 bp, Homo sapiens; identical to SEQ ID NO: 2302

SEQ ID NO: 2348 - DNA, 201 bp, Homo sapiens; identical to SEQ ID NO: 2303

SEQ ID NO: 2349 - DNA, 201 bp, Homo sapiens; identical to SEQ ID NO: 2304

SEQ ID NO: 2350 - DNA, 201 bp, Homo sapiens; identical to SEQ ID NO: 2305

SEQ ID NO: 2351 - DNA, 201 bp, Homo sapiens; identical to SEQ ID NO: 2306

SEQ ID NO: 2352 - DNA, 201 bp, Homo sapiens; identical to SEQ ID NO: 2307

SEQ ID NO: 2353 - DNA, 201 bp, Homo sapiens; identical to SEQ ID NO: 2308

SEQ ID NO: 2354 - DNA, 201 bp, Homo sapiens; identical to SEQ ID NO: 2309

SEQ ID NO: 2355 - DNA, 201 bp, Homo sapiens; identical to SEQ ID NO: 2310

SEQ ID NO: 2356 - DNA, 201 bp, Homo sapiens; identical to SEQ ID NO: 2311

SEQ ID NO: 2357 - DNA, 201 bp, Homo sapiens; identical to SEQ ID NO: 2312

SEQ ID NO: 2358 - DNA, 201 bp, Homo sapiens; identical to SEQ ID NO: 2313

SEQ ID NO: 2359 - DNA, 201 bp, Homo sapiens; identical to SEQ ID NO: 2314

SEQ ID NO: 2360 - DNA, 201 bp, Homo sapiens; identical to SEQ ID NO: 2315

SEQ ID NO: 2361 - DNA, 201 bp, Homo sapiens; identical to SEQ ID NO: 2316

SEQ ID NO: 2362 - DNA, 201 bp, Homo sapiens; identical to SEQ ID NO: 2317

SEQ ID NO: 2363 - DNA, 201 bp, Homo sapiens; identical to SEQ ID NO: 2318

SEQ ID NO: 2364 - DNA, 201 bp, Homo sapiens; identical to SEQ ID NO: 2274

SEQ ID NO: 2365 - DNA, 201 bp, Homo sapiens; identical to SEQ ID NO: 2275

SEQ ID NO: 2366 - DNA, 201 bp, Homo sapiens; identical to SEQ ID NO: 2276

SEQ ID NO: 2367 - DNA, 201 bp, Homo sapiens; identical to SEQ ID NO: 2277

SEQ ID NO: 2368 - DNA, 201 bp, Homo sapiens; identical to SEQ ID NO: 2278

SEQ ID NO: 2369 - DNA, 201 bp, Homo sapiens; identical to SEQ ID NO: 2279

SEQ ID NO: 2370 - DNA, 201 bp, Homo sapiens; identical to SEQ ID NO: 2280

SEQ ID NO: 2371 - DNA, 201 bp, Homo sapiens; identical to SEQ ID NO: 2281

SEQ ID NO: 2372 - DNA, 201 bp, Homo sapiens; identical to SEQ ID NO: 2282

SEQ ID NO: 2373 - DNA, 201 bp, Homo sapiens; identical to SEQ ID NO: 2283

SEQ ID NO: 2374 - DNA, 201 bp, Homo sapiens; identical to SEQ ID NO: 2284

SEQ ID NO: 2375 - DNA, 201 bp, Homo sapiens; identical to SEQ ID NO: 2285

SEQ ID NO: 2376 - DNA, 201 bp, Homo sapiens; identical to SEQ ID NO: 2286

SEQ ID NO: 2377 - DNA, 201 bp, Homo sapiens; identical to SEQ ID NO: 2287

SEQ ID NO: 2378 - DNA, 201 bp, Homo sapiens; identical to SEQ ID NO: 2288

SEQ ID NO: 2379 - DNA, 201 bp, Homo sapiens; identical to SEQ ID NO: 2289

SEQ ID NO: 2380 - DNA, 201 bp, Homo sapiens; identical to SEQ ID NO: 2290

SEQ ID NO: 2381 - DNA, 201 bp, Homo sapiens; identical to SEQ ID NO: 2292

SEQ ID NO: 2382 - DNA, 201 bp, Homo sapiens; identical to SEQ ID NO: 2293

SEQ ID NO: 2383 - DNA, 201 bp, Homo sapiens; identical to SEQ ID NO: 2294

SEQ ID NO: 2384 - DNA, 201 bp, Homo sapiens; identical to SEQ ID NO: 2295

SEQ ID NO: 2385 - DNA, 201 bp, Homo sapiens; identical to SEQ ID NO: 2296

SEQ ID NO: 2386 - DNA, 201 bp, Homo sapiens; identical to SEQ ID NO: 2297

SEQ ID NO: 2387 - DNA, 201 bp, Homo sapiens; identical to SEQ ID NO: 2298

SEQ ID NO: 2388 - DNA, 201 bp, Homo sapiens; identical to SEQ ID NO: 2299

SEQ ID NO: 2389 - DNA, 201 bp, Homo sapiens; identical to SEQ ID NO: 2300

SEQ ID NO: 2390 - DNA, 201 bp, Homo sapiens; identical to SEQ ID NO: 2301

SEQ ID NO: 2391 - DNA, 201 bp, Homo sapiens; identical to SEQ ID NO: 2302

SEQ ID NO: 2392 - DNA, 201 bp, Homo sapiens; identical to SEQ ID NO: 2303

SEQ ID NO: 2393 - DNA, 201 bp, Homo sapiens; identical to SEQ ID NO: 2304

SEQ ID NO: 2394 - DNA, 201 bp, Homo sapiens; identical to SEQ ID NO: 2305

SEQ ID NO: 2395 - DNA, 201 bp, Homo sapiens; identical to SEQ ID NO: 2307

SEQ ID NO: 2396 - DNA, 201 bp, Homo sapiens; identical to SEQ ID NO: 2308

SEQ ID NO: 2397 - DNA, 201 bp, Homo sapiens; identical to SEQ ID NO: 2309

SEQ ID NO: 2398 - DNA, 201 bp, Homo sapiens; identical to SEQ ID NO: 2310

SEQ ID NO: 2399 - DNA, 201 bp, Homo sapiens; identical to SEQ ID NO: 2311

SEQ ID NO: 2400 - DNA, 201 bp, Homo sapiens; identical to SEQ ID NO: 2312

SEQ ID NO: 2401 - DNA, 201 bp, Homo sapiens; identical to SEQ ID NO: 2313

SEQ ID NO: 2402 - DNA, 201 bp, Homo sapiens; identical to SEQ ID NO: 2314

SEQ ID NO: 2403 - DNA, 201 bp, Homo sapiens; identical to SEQ ID NO: 2315

SEQ ID NO: 2404 - DNA, 201 bp, Homo sapiens; identical to SEQ ID NO: 2316

SEQ ID NO: 2405 - DNA, 201 bp, Homo sapiens; identical to SEQ ID NO: 2317

SEQ ID NO: 2406 - DNA, 201 bp, Homo sapiens; identical to SEQ ID NO: 2318

SEQ ID NO: 2407 - DNA, 201 bp, Homo sapiens; identical to SEQ ID NO: 2274

SEQ ID NO: 2408 - DNA, 201 bp, Homo sapiens; identical to SEQ ID NO: 2275

SEQ ID NO: 2409 - DNA, 201 bp, Homo sapiens; identical to SEQ ID NO: 2276

SEQ ID NO: 2410 - DNA, 201 bp, Homo sapiens; identical to SEQ ID NO: 2277

SEQ ID NO: 2411 - DNA, 201 bp, Homo sapiens; identical to SEQ ID NO: 2278

SEQ ID NO: 2412 - DNA, 201 bp, Homo sapiens; identical to SEQ ID NO: 2279

SEQ ID NO: 2413 - DNA, 201 bp, Homo sapiens; identical to SEQ ID NO: 2280

SEQ ID NO: 2414 - DNA, 201 bp, Homo sapiens; identical to SEQ ID NO: 2281

SEQ ID NO: 2415 - DNA, 201 bp, Homo sapiens; identical to SEQ ID NO: 2282

SEQ ID NO: 2416 - DNA, 201 bp, Homo sapiens; identical to SEQ ID NO: 2283

SEQ ID NO: 2417 - DNA, 201 bp, Homo sapiens; identical to SEQ ID NO: 2284

SEQ ID NO: 2418 - DNA, 201 bp, Homo sapiens; identical to SEQ ID NO: 2285

SEQ ID NO: 2419 - DNA, 201 bp, Homo sapiens; identical to SEQ ID NO: 2286

SEQ ID NO: 2420 - DNA, 201 bp, Homo sapiens; identical to SEQ ID NO: 2287

SEQ ID NO: 2421 - DNA, 201 bp, Homo sapiens; identical to SEQ ID NO: 2288

SEQ ID NO: 2422 - DNA, 201 bp, Homo sapiens; identical to SEQ ID NO: 2289

SEQ ID NO: 2423 - DNA, 201 bp, Homo sapiens; identical to SEQ ID NO: 2290

SEQ ID NO: 2424 - DNA, 201 bp, Homo sapiens; identical to SEQ ID NO: 2292

SEQ ID NO: 2425 - DNA, 201 bp, Homo sapiens; identical to SEQ ID NO: 2293

SEQ ID NO: 2426 - DNA, 201 bp, Homo sapiens; identical to SEQ ID NO: 2294

SEQ ID NO: 2427 - DNA, 201 bp, Homo sapiens; identical to SEQ ID NO: 2295

SEQ ID NO: 2428 - DNA, 201 bp, Homo sapiens; identical to SEQ ID NO: 2296

SEQ ID NO: 2429 - DNA, 201 bp, Homo sapiens; identical to SEQ ID NO: 2297

SEQ ID NO: 2430 - DNA, 201 bp, Homo sapiens; identical to SEQ ID NO: 2298

SEQ ID NO: 2431 - DNA, 201 bp, Homo sapiens; identical to SEQ ID NO: 2299

SEQ ID NO: 2432 - DNA, 201 bp, Homo sapiens; identical to SEQ ID NO: 2300

SEQ ID NO: 2433 - DNA, 201 bp, Homo sapiens; identical to SEQ ID NO: 2301

SEQ ID NO: 2434 - DNA, 201 bp, Homo sapiens; identical to SEQ ID NO: 2302

SEQ ID NO: 2435 - DNA, 201 bp, Homo sapiens; identical to SEQ ID NO: 2303

SEQ ID NO: 2436 - DNA, 201 bp, Homo sapiens; identical to SEQ ID NO: 2304

SEQ ID NO: 2437 - DNA, 201 bp, Homo sapiens; identical to SEQ ID NO: 2305

SEQ ID NO: 2438 - DNA, 201 bp, Homo sapiens; identical to SEQ ID NO: 2307

SEQ ID NO: 2439 - DNA, 201 bp, Homo sapiens; identical to SEQ ID NO: 2308

SEQ ID NO: 2440 - DNA, 201 bp, Homo sapiens; identical to SEQ ID NO: 2309

SEQ ID NO: 2441 - DNA, 201 bp, Homo sapiens; identical to SEQ ID NO: 2310

SEQ ID NO: 2442 - DNA, 201 bp, Homo sapiens; identical to SEQ ID NO: 2311

SEQ ID NO: 2443 - DNA, 201 bp, Homo sapiens; identical to SEQ ID NO: 2312

SEQ ID NO: 2444 - DNA, 201 bp, Homo sapiens; identical to SEQ ID NO: 2313

SEQ ID NO: 2445 - DNA, 201 bp, Homo sapiens; identical to SEQ ID NO: 2314

SEQ ID NO: 2446 - DNA, 201 bp, Homo sapiens; identical to SEQ ID NO: 2315

SEQ ID NO: 2447 - DNA, 201 bp, Homo sapiens; identical to SEQ ID NO: 2316

SEQ ID NO: 2448 - DNA, 201 bp, Homo sapiens; identical to SEQ ID NO: 2317

SEQ ID NO: 2449 - DNA, 201 bp, Homo sapiens; identical to SEQ ID NO: 2318

SEQ ID NO: 2450 - DNA, 201 bp, Homo sapiens; identical to SEQ ID NO: 2274

SEQ ID NO: 2451 - DNA, 201 bp, Homo sapiens; identical to SEQ ID NO: 2275

SEQ ID NO: 2452 - DNA, 201 bp, Homo sapiens; identical to SEQ ID NO: 2276

SEQ ID NO: 2453 - DNA, 201 bp, Homo sapiens; identical to SEQ ID NO: 2277

SEQ ID NO: 2454 - DNA, 201 bp, Homo sapiens; identical to SEQ ID NO: 2278

SEQ ID NO: 2455 - DNA, 201 bp, Homo sapiens; identical to SEQ ID NO: 2279

SEQ ID NO: 2456 - DNA, 201 bp, Homo sapiens; identical to SEQ ID NO: 2280

SEQ ID NO: 2457 - DNA, 201 bp, Homo sapiens; identical to SEQ ID NO: 2281

SEQ ID NO: 2458 - DNA, 201 bp, Homo sapiens; identical to SEQ ID NO: 2282

SEQ ID NO: 2459 - DNA, 201 bp, Homo sapiens; identical to SEQ ID NO: 2283

SEQ ID NO: 2460 - DNA, 201 bp, Homo sapiens; identical to SEQ ID NO: 2284

SEQ ID NO: 2461 - DNA, 201 bp, Homo sapiens; identical to SEQ ID NO: 2286

SEQ ID NO: 2462 - DNA, 201 bp, Homo sapiens; identical to SEQ ID NO: 2287

SEQ ID NO: 2463 - DNA, 201 bp, Homo sapiens; identical to SEQ ID NO: 2288

SEQ ID NO: 2464 - DNA, 201 bp, Homo sapiens; identical to SEQ ID NO: 2290

SEQ ID NO: 2465 - DNA, 201 bp, Homo sapiens; identical to SEQ ID NO: 2289

SEQ ID NO: 2466 - DNA, 201 bp, Homo sapiens; identical to SEQ ID NO: 2291

SEQ ID NO: 2467 - DNA, 201 bp, Homo sapiens; identical to SEQ ID NO: 2292

SEQ ID NO: 2468 - DNA, 201 bp, Homo sapiens; identical to SEQ ID NO: 2293

SEQ ID NO: 2469 - DNA, 201 bp, Homo sapiens; identical to SEQ ID NO: 2294

SEQ ID NO: 2470 - DNA, 201 bp, Homo sapiens; identical to SEQ ID NO: 2295

SEQ ID NO: 2471 - DNA, 201 bp, Homo sapiens; identical to SEQ ID NO: 2296

SEQ ID NO: 2472 - DNA, 201 bp, Homo sapiens; identical to SEQ ID NO: 2297

SEQ ID NO: 2473 - DNA, 201 bp, Homo sapiens; identical to SEQ ID NO: 2298

SEQ ID NO: 2474 - DNA, 201 bp, Homo sapiens; identical to SEQ ID NO: 2299

SEQ ID NO: 2475 - DNA, 201 bp, Homo sapiens; identical to SEQ ID NO: 2300

SEQ ID NO: 2476 - DNA, 201 bp, Homo sapiens; identical to SEQ ID NO: 2301

SEQ ID NO: 2477 - DNA, 201 bp, Homo sapiens; identical to SEQ ID NO: 2302

SEQ ID NO: 2478 - DNA, 201 bp, Homo sapiens; identical to SEQ ID NO: 2303

SEQ ID NO: 2479 - DNA, 201 bp, Homo sapiens; identical to SEQ ID NO: 2304

SEQ ID NO: 2480 - DNA, 201 bp, Homo sapiens; identical to SEQ ID NO: 2306

SEQ ID NO: 2481 - DNA, 201 bp, Homo sapiens; identical to SEQ ID NO: 2305

SEQ ID NO: 2482 - DNA, 201 bp, Homo sapiens; identical to SEQ ID NO: 2307

SEQ ID NO: 2483 - DNA, 201 bp, Homo sapiens; identical to SEQ ID NO: 2308

SEQ ID NO: 2484 - DNA, 201 bp, Homo sapiens
ctgagattttagtgtacccatcacctgagtagtgtacattgtacccaacttgtagctttttatcccttaccctaccttccaccctccccattttgagtctscatagtccattatatcactctgtatgcctttgcatacccatagcttaactcccacttataagtgaaaacacggtatttggttttccattcctgagttact

SEQ ID NO: 2485 - DNA, 201 bp, Homo sapiens; identical to SEQ ID NO: 2309

SEQ ID NO: 2486 - DNA, 201 bp, Homo sapiens; identical to SEQ ID NO: 2310

SEQ ID NO: 2487 - DNA, 201 bp, Homo sapiens; identical to SEQ ID NO: 2311

SEQ ID NO: 2488 - DNA, 201 bp, Homo sapiens; identical to SEQ ID NO: 2312

SEQ ID NO: 2489 - DNA, 201 bp, Homo sapiens; identical to SEQ ID NO: 2313

SEQ ID NO: 2490 - DNA, 201 bp, Homo sapiens; identical to SEQ ID NO: 2314

SEQ ID NO: 2491 - DNA, 201 bp, Homo sapiens; identical to SEQ ID NO: 2316

SEQ ID NO: 2492 - DNA, 201 bp, Homo sapiens; identical to SEQ ID NO: 2315

SEQ ID NO: 2493 - DNA, 201 bp, Homo sapiens; identical to SEQ ID NO: 2317

SEQ ID NO: 2494 - DNA, 201 bp, Homo sapiens; identical to SEQ ID NO: 2318

SEQ ID NO: 2495 - DNA, 201 bp, Homo sapiens
tttaggaactgtgagagggggacaaggtgaagctttcctggccctgggaggaagctggctgtggtagcgtagcgctctctctctctgtctgtggcaggagscaaagagtagggtgtaattgagtgaaggaatcctgggtagagaccattctcaggtggttgggccaggctaaagactgggatttgggtctatctatgcctt

SEQ ID NO: 2496 - DNA, 201 bp, Homo sapiens
gtcagtctcccaagcctggcatgtggccctctggatctgggttccatctctgtctccagcctgcccacttcccttcatgaatgttgggttctagctccctrttctccaaacccatactacacatcccacttctgggtctttgcctgggatgttgctgacactcagaaagtcccaccacctgcacatgtgtagccccaccag

SEQ ID NO: 2497 - DNA, 200 bp, Homo sapiens
gagacatacaggacagagcatggctcgcctacagactgcactcctggttgtcctcgtcctccttgctgtggcgcttcaagcaactgaggcaggcccctayggcgccaacatggaagacagcgtctgctgccgtgattacgtccgttaccgtctgcccctgcgcgtggtgaaacacttctactggacctcagactcctgcc

SEQ ID NO: 2498 - DNA, 201 bp, Homo sapiens
tgctgggattacaggcgtgagccacagtgcctggcctcttccctctccccactcccccccccaactttttttttttttttatggcagggtctcactctgtygcccaggctggagtgcagtggcgtgatctcggctcactacaacctcgacctcctgggttcaagtgattctcccaccccagcctcccaagtagctgggatt

SEQ ID NO: 2499 - DNA, 201 bp, Homo sapiens
tgcccacttcccttcatgaatgttgggttctagctccctgttctccaaacccatactacacatcccacttctgggtctttgcctgggatgttgctgacacycagaaagtcccaccacctgcacatgtgtagccccaccagccctccaaggcattgctcgcccaagcagctggtaattccatttcatgtattagatgtcccc

SEQ ID NO: 2500 - DNA, 201 bp, Homo sapiens
ctttttttttttttttatggcagggtctcactctgtcgcccaggctggagtgcagtggcgtgatctcggctcactacaacctcgacctcctgggttcaagygattctcccaccccagcctcccaagtagctgggattacaggtgtgtgccactacggctggctaatttttgtatttttagtagagacaggtttcaccatat

SEQ ID NO: 2501 - DNA, 201 bp, Homo sapiens
tggggctcaggttgaaagtgtggggagtgacactgcctaggcatccagctcagtgtcatccagggcctgtgtccctcccgaacccagggtcaacctgcctrccacaggcactagaaggacgaatctgcctactgcccatgaacggggccctcaagcgtcctgggatctccttctccctcctgtcctgtccttgcccctcag

SEQ ID NO: 2502 - DNA, 201 bp, Homo sapiens
gacctcctgggttcaagtgattctcccaccccagcctcccaagtagctgggattacaggtgtgtgccactacggctggctaatttttgtatttttagtagmgacaggtttcaccatattggccaggctggtcttgaactcctgacctcaagtgatccaccttccttgtgctcccaaagtgctgagattacaggcgtgagct

SEQ ID NO: 2503 - DNA, 201 bp, Homo sapiens
ctctgtctgtggcaggaggcaaagagtagggtgtaattgagtgaaggaatcctgggtagagaccattctcaggtggttgggccaggctaaagactgggatwtgggtctatctatgcctttctggctgatttttgtagagacggggttttgccatgttacccaggctggtctcaaactcctgggctcaagcgatcctcctgg

SEQ ID NO: 2504 - DNA, 201 bp, Homo sapiens
gagacggggttttgccatgttacccaggctggtctcaaactcctgggctcaagcgatcctcctggctcagcctcccaaagtgctgggattacaggcgtgaytcactgcgcctggcttcctcttcctcttgagaaatattcttttcatacagcaagtatgggacagcagtgtcccaggtaaaggacataaatgttacaagtg

SEQ ID NO: 2505 - DNA, 201 bp, Homo sapiens
taagctggagttatatatgtatttgaaaacagagtaaatacttaagaggccaaatagatgaatggaagaattttaggaactgtgagagggggacaaggtgragctttcctggccctgggaggaagctggctgtggtagcgtagcgctctctctctctgtctgtggcaggaggcaaagagtagggtgtaattgagtgaagga

SEQ ID NO: 2506 - DNA, 201 bp, Homo sapiens
ttacatatcaatacagagactcaaggtcactagaaatgggccagctgggtcaatgtgaagccccaaatttgcccagattcacctttcttcccccactcccttttttttttttttttttgagatggagtttcgctcttgtcacccacgctggagtgcaatggtgtggtcttggcttattgaagcctctgcctcctgggttca

SEQ ID NO: 2507 - DNA, 201 bp, Homo sapiens
gtctgcccctgcgcgtggtgaaacacttctactggacctcagactcctgcccgaggcctggcgtggtgttgctaaccttcagggataaggagatctgtgcygatcccagagtgccctgggtgaagatgattctcaataagctgagccaatgaagagcctactctgatgaccgtggccttggctcctccaggaaggctcagg

SEQ ID NO: 2508 - DNA, 124 bp, Homo sapiens
gagacatacaggacagagcatggmtcgcctacagactgcactcctggttgtcctcgtcctccttgctgtggcgcttcaagcaactgaggcaggcccctacggcgccaacatggaagacagcgtc

SEQ ID NO: 2509 - DNA, 201 bp, Homo sapiens
ctcgaactcctgtcctcaggtaatccgcccacctcagcctcccaaagtgctgggattacaggcgtgagccacagtgcctggcctcttccctctccccactsccccccccaactttttttttttttttatggcagggtctcactctgtcgcccaggctggagtgcagtggcgtgatctcggctcactacaacctcgacctcc

SEQ ID NO: 2510 - DNA, 201 bp, Homo sapiens
aggaacttgggctgcatcaatgctcaaggaaaggaagacatctccatgaattccgttcccatccagcaagagaccctggtcgtccggaggaagcaccaagrctgctctgtttctttccagttggagaaggtgctggtgactgttggctgcacctgcgtcacccctgtcatccaccatgtgcagtaagaggtgcatatccac

SEQ ID NO: 2511 - DNA, 201 bp, Homo sapiens
gtttccatgtcacgtaacatcgagagccgctccacctccccctggaattacactgtcacttgggaccccaaccggtacccctcggaagttgtacaggcccrgtgtaggaacttgggctgcatcaatgctcaaggaaaggaagacatctccatgaattccgttcccatccagcaagagaccctggtcgtccggaggaagcac

SEQ ID NO: 2512 - DNA, 201 bp, Homo sapiens
agttgtacaggcccagtgtaggaacttgggctgcatcaatgctcaaggaaaggaagacatctccatgaattccgttcccatccagcaagagaccctggtcrtccggaggaagcaccaaggctgctctgtttctttccagttggagaaggtgctggtgactgttggctgcacctgcgtcacccctgtcatccaccatgtgca

SEQ ID NO: 2513 - DNA, 201 bp, Homo sapiens
tgctgtcgatattggggcttgcctttctgagtgaggcggcagctcggaaaatccccaaagtaggacatacttttttccaaaagcctgagagttgcccgccygtgccaggaggtagtatgaagcttgacattggcatcatcaatgaaaaccagcgcgtttccatgtcacgtaacatcgagagccgctccacctccccctgga

SEQ ID NO: 2514 - DNA, 201 bp, Homo sapiens
ccatggtagtcaatgaactggctgccactttaatataactgaaaattcattttgagaccaagcaggatcaagtttgtagaataaacactggtttcctagcyatcctctgaaaacagtatgaaacatgaccaagtacataatggatttagtaataaatattgtcgaattgctaaaaagtcttcaatcattcattcactaagt

SEQ ID NO: 2515 - DNA, 201 bp, Homo sapiens
gcaggatcaagtttgtagaataaacactggtttcctagccatcctctgaaaacagtatgaaacatgaccaagtacataatggatttagtaataaatattgycgaattgctaaaaagtcttcaatcattcattcactaagtcactcagtgatatcaatatacttagctcagaaagtgtgggaggctgaataatggtgtctcc

SEQ ID NO: 2516 - DNA, 201 bp, Homo sapiens
gaaatggcacgaggaagtctccagaaatgccagtaatcctggaagtgtccctggaaggatcccatgacacagccaattgtgaggcatgcactttgggcatmtgtggacagggcttaaaaagctgcatgacaaagccgtccaaatccctactcccccacctaaagactgggaattcctcacctggaattggtgctgtgtacc

SEQ ID NO: 2517 - DNA, 201 bp, Homo sapiens
gaaatgccagtaatcctggaagtgtccctggaaggatcccatgacacagccaattgtgaggcatgcactttgggcatctgtggacagggcttaaaaagctrcatgacaaagccgtccaaatccctactcccccacctaaagactgggaattcctcacctggaattggtgctgtgtacctcgcaaaccaagccaagaaccag

SEQ ID NO: 2518 - DNA, 201 bp, Homo sapiens
ccactttaatataactgaaaattcattttgagaccaagcaggatcaagtttgtagaataaacactggtttcctagccatcctctgaaaacagtatgaaacmtgaccaagtacataatggatttagtaataaatattgtcgaattgctaaaaagtcttcaatcattcattcactaagtcactcagtgatatcaatatactta

SEQ ID NO: 2519 - DNA, 201 bp, Homo sapiens
caacagagagcatttggctggttccggtgttcctcctgccagcgaagttgggcttccgcccaagtgcagattctgtgccacacgtactgggagcactggayatcccagggtcaggtgcgtatgaggctctttggccaaaggtgccagaagtgctcctggtcccaatatgagatgcctgagttctcctcggatagcaccatg

SEQ ID NO: 2520 - DNA, 201 bp, Homo sapiens
acaaagccgtccaaatccctactcccccacctaaagactgggaattcctcacctggaattggtgctgtgtacctcgcaaaccaagccaagaaccagtcagmtgaggcaaaagaggctaaggggagtgggtatgagaaattagggcccagtcgagacccagatccactgaacatctgtgtctttattttgctgcttgtattt

SEQ ID NO: 2521 - DNA, 201 bp, Homo sapiens
catgacttaatccccagaacctgtaaacatgttactttacatggtagaatggactttgcggatgtaattaaggaccttgaaatggttagattatttcataytgtccgggtggataagaaccaggattttgtaacagggaggcaacaagctcaaaatcagaaaaaagagatttgtcaatggaacaagaggttgaagtgcttt

SEQ ID NO: 2522 - DNA, 201 bp, Homo sapiens
cgagacccagatccactgaacatctgtgtctttattttgctgcttgtatttattgtagtcaaatgctttacatcagaatgatgaaaataggcttgccactktctcttattttaattccatggtagtcaatgaactggctgccactttaatataactgaaaattcattttgagaccaagcaggatcaagtttgtagaataaa

SEQ ID NO: 2523 - DNA, 201 bp, Homo sapiens
ccagaaatgccagtaatcctggaagtgtccctggaaggatcccatgacacagccaattgtgaggcatgcactttgggcatctgtggacagggcttaaaaarctgcatgacaaagccgtccaaatccctactcccccacctaaagactgggaattcctcacctggaattggtgctgtgtacctcgcaaaccaagccaagaac

SEQ ID NO: 2524 - DNA, 201 bp, Homo sapiens
tggtcccaatatgagatgcctgagttctcctcggatagcaccatgaggattctgagcaacctggtgcagcatatactgaagaaatactatggaaatggcaygaggaagtctccagaaatgccagtaatcctggaagtgtccctggaaggatcccatgacacagccaattgtgaggcatgcactttgggcatctgtggacag

SEQ ID NO: 2525 - DNA, 201 bp, Homo sapiens
gcaaccttcagctagactgcctggctcaagggtggaagcaataccaacagagagcatttggctggttccggtgttcctcctgccagcgaagttgggcttcygcccaagtgcagattctgtgccacacgtactgggagcactggacatcccagggtcaggtgcgtatgaggctctttggccaaaggtgccagaagtgctcct

SEQ ID NO: 2526 - DNA, 201 bp, Homo sapiens
cgtggtcacggggccacatttctgcagctggctcagtggcaggcttgggccgtctctcagtaccatctaagacttctgtctaggttcctgtttttttagamtcctgaactgccattctgattagacacaattttaatggaatttttggatttaatgatagttgataatcaccttatgtatttgcacaatctctttataatt

SEQ ID NO: 2527 - DNA, 201 bp, Homo sapiens
cccctgactcaccgaggtactgtatgatttcagacctttttattgacaactatcaggttaaatgtattaatgggaagatgtgttatgtgcagaagcagccrgcaccacattcccacagaatgagccctgaggaggtctctgcacacgatgccttaatttcaaaagagagcaatacaccaaaaatagatcactgctcttctc

SEQ ID NO: 2528 - DNA, 201 bp, Homo sapiens
tacagtccagagagcagctgggaaccggatgagtgcacccttctctccccctcgcagtctgacctggaagtgattgaaacgatagaaacgactgtgtgagmgtccagacaggaagccacagcctcggacccacgccgagcttttgtacctttgtctggtggatccttttttccaatgctgttgatattttctacccacccc

SEQ ID NO: 2529 - DNA, 201 bp, Homo sapiens
ccccctgactcaccgaggtactgtatgatttcagacctttttattgacaactatcaggttaaatgtattaatgggaagatgtgttatgtgcagaagcagcyggcaccacattcccacagaatgagccctgaggaggtctctgcacacgatgccttaatttcaaaagagagcaatacaccaaaaatagatcactgctcttct

SEQ ID NO: 2530 - DNA, 201 bp, Homo sapiens
ctcagtaccatctaagacttctgtctaggttcctgtttttttagactcctgaactgccattctgattagacacaattttaatggaatttttggatttaatratagttgataatcaccttatgtatttgcacaatctctttataattaaaaactcgctaagcttcacttgctactatctactatatagaattagagacattc

SEQ ID NO: 2531 - DNA, 201 bp, Homo sapiens
ggtgtcggctccgcgcggagggagaggaaatgagtgcggcggcctcgccggcgtcggagcggggttggaagagcgagaaactagatgaggctcaggccctrgcgcggagttgcgccgcccgcagacccgacttccagccgtgcgacgggctgtctatctgtgccacgcacagccatggcaagtgcttcaagctgcactggt

SEQ ID NO: 2532 - DNA, 201 bp, Homo sapiens
tgactcaccgaggtactgtatgatttcagacctttttattgacaactatcaggttaaatgtattaatgggaagatgtgttatgtgcagaagcagccggcaycacattcccacagaatgagccctgaggaggtctctgcacacgatgccttaatttcaaaagagagcaatacaccaaaaatagatcactgctcttctccctc

SEQ ID NO: 2533 - DNA, 201 bp, Homo sapiens
aacagattgtagtttcactttaaattctaggcctgttctatattatgtgaaggaattctctgtaacgctgatactatgttgctaatttgtgtacttacagrcactttagaaaatgtttagactgcaacatgcactataacattgaactcagtcacatgaagtggttaacacttgcacactgactgacagatatgaaagctg

SEQ ID NO: 2534 - DNA, 201 bp, Homo sapiens
aatttaaagattcaacaagacaaaccgagaagggggtcagaggagctctaggaaaggcccaggagagggcagttggaggcaggtgtgagcatgaggagctkccccctgccagggcatggctcaggtggcacagggacatctgatgaaccctgcccgaggttctcggtgcctcccgtgcatgagtggctcactgaaggcagg

SEQ ID NO: 2535 - DNA, 201 bp, Homo sapiens
atatgttattgaactggaattgtttctttatgcttgcattccaaaaccaactgaaacagattgtagtttcactttaaattctaggcctgttctatattatrtgaaggaattctctgtaacgctgatactatgttgctaatttgtgtacttacaggcactttagaaaatgtttagactgcaacatgcactataacattgaac

SEQ ID NO: 2536 - DNA, 201 bp, Homo sapiens
tgaggcatagtttcaaatcctggaaattttaagtatggcctaatgagaacatcagagttggagacagaacagtacttccatcctaactatccagaagcgcrctctcaggccattgtgctctgagattcccttgtgctctggcaccattatggtacatctctacgtcacattaatttttttttttttgagatggagtttccc

SEQ ID NO: 2537 - DNA, 201 bp, Homo sapiens
aacagggtgaaactctcccagagacgaagaaagagtcctgggatttgtacttcatgaagacttttgtgaaagaataggtgtccttatgaacaacgtttttktttttttttttttcttttttggtgtgaaggtgggggggtctattagacatttattcaagagcgttctttttttggttttaaaggtttttgttaatgtaat

SEQ ID NO: 2538 - DNA, 201 bp, Homo sapiens
ttctggaacagggtgaaactctcccagagacgaagaaagagtcctgggatttgtacttcatgaagacttttgtgaaagaataggtgtccttatgaacaacktttttgtttttttttttttcttttttggtgtgaaggtgggggggtctattagacatttattcaagagcgttctttttttggttttaaaggtttttgttaa

SEQ ID NO: 2539 - DNA, 201 bp, Homo sapiens
aggtggtagcggcgccgggcgcgctccgcccgcccctcctccgggccgcactgaggctcgggcgcgcggggacatgtcggtggcgacgggcagcagcgagrcggccggcggggccagcggcggcggcgcacgggttttcttccaaagcccccggggtggcgccggtggcagccccggctccagcagcggctcaggctcctc

SEQ ID NO: 2540 - DNA, 201 bp, Homo sapiens
gctgcgtttcctgcaaggactcagatgttcagtaccttatgatacagggaagatagttttcttacaagtagtttggtaatattttttttcttaagttgtayatttgactcagctgtcaaatttctcacacttgtatatatctacacacaactaagttaaaatgttgatgtgagttttatttcacatggatggaataaactt

SEQ ID NO: 2541 - DNA, 201 bp, Homo sapiens
tatcaaagagctgctttctcggataagaggcatgaggaaactgagccctccgcagaagaagagtgtatgattctggaacagggtgaaactctcccagagaygaagaaagagtcctgggatttgtacttcatgaagacttttgtgaaagaataggtgtccttatgaacaacgtttttgtttttttttttttcttttttggtg

SEQ ID NO: 2542 - DNA, 201 bp, Homo sapiens
ctcagttaccagctctttggagaaggatcaaaattcagatggaatgtgggatgggtaataggtgagagtagaaacccttccctccaggaggcccccgctgmctcccacagaaacccacctaccataagatgtcttcaggtggccttgtccaaggatgggggtcaggcattttatatcaagggtgctctgaacatattttat

SEQ ID NO: 2543 - DNA, 201 bp, Homo sapiens
gtgtttattctctctccaggaaagcagatcaaaagaaagttagcagatcgagtgtcttcttccttagaaataggttctggtagcttctgtgcctgggtagyatcagaccagtgggagtaaaccgagtgttaagtgtcaaggtgagaaagcctcacattctctcaagacagttgctctaggagctgagttgctggtttggaa

SEQ ID NO: 2544 - DNA, 201 bp, Homo sapiens
atctcagtggtattttgcattggaaaaaggaagcactgtgtagcagtgaattgtctgctttccaccgagtactgtgtttattctctctccaggaaagcagrtcaaaagaaagttagcagatcgagtgtcttcttccttagaaataggttctggtagcttctgtgcctgggtagtatcagaccagtgggagtaaaccgagtg

SEQ ID NO: 2545 - DNA, 201 bp, Homo sapiens; identical to SEQ ID NO: 2537

SEQ ID NO: 2546 - DNA, 201 bp, Homo sapiens; identical to SEQ ID NO: 2538

SEQ ID NO: 2547 - DNA, 201 bp, Homo sapiens; identical to SEQ ID NO: 2539

SEQ ID NO: 2548 - DNA, 201 bp, Homo sapiens; identical to SEQ ID NO: 2540

SEQ ID NO: 2549 - DNA, 201 bp, Homo sapiens; identical to SEQ ID NO: 2541

SEQ ID NO: 2550 - DNA, 201 bp, Homo sapiens; identical to SEQ ID NO: 2542

SEQ ID NO: 2551 - DNA, 201 bp, Homo sapiens; identical to SEQ ID NO: 2543

SEQ ID NO: 2552 - DNA, 201 bp, Homo sapiens; identical to SEQ ID NO: 2544

SEQ ID NO: 2553 - DNA, 201 bp, Homo sapiens
gctttaaaccgcaagatggggcctgggcatgcgcaggaggagccatcgggtactacgcagcaacactcacaactgtccaggctgagataaatcccgggacytgaactattagcacgtcactagagactgggagccgaggcagtggtgctggcccaagtgaaggccagagtgaggactgatgcagctctttacgggtcttga

SEQ ID NO: 2554 - DNA, 201 bp, Homo sapiens
gcccgtgacgggccctcaggcgccgaccattaaagagctgatgcggtggtactgcctcaacaccaacacccatggctgtcgccgcatcgtggtgtcccgckgccgtctgcgccgcctcctctggatcgggttcacactgactgccgtggccctcatcctctggcagtgcgccctcctcgtcttctccttctatactgtctc

SEQ ID NO: 2555 - DNA, 201 bp, Homo sapiens
agcagcctagattctcccaccggatcccgctgctgatctttgatcaggatgagaagggcaaggccagggacttcttcacagggaggaagcggaaagtcggyggtagcatcattcacaaggcttcaaatgtcatgcacatcgagtccaagcaagtggtgggattccaactgtgctcaaatgacacctccgactgtgccacct

SEQ ID NO: 2556 - DNA, 201 bp, Homo sapiens
gcaggaggagccatcgggtactacgcagcaacactcacaactgtccaggctgagataaatcccgggacctgaactattagcacgtcactagagactgggarccgaggcagtggtgctggcccaagtgaaggccagagtgaggactgatgcagctctttacgggtcttgagagggaaggactcttccaaagccccaaagccg

SEQ ID NO: 2557 - DNA, 201 bp, Homo sapiens
tgaagtccctgtacggctttccagagtcccggaagcgccgagaggcggagtcctggaactccgtctcagagggaaagcagcctagattctcccaccggatyccgctgctgatctttgatcaggatgagaagggcaaggccagggacttcttcacagggaggaagcggaaagtcggcggtagcatcattcacaaggcttcaa

SEQ ID NO: 2558 - DNA, 201 bp, Homo sapiens
cagtcaccatctgcaacatcaacccctacaagtacagcaccgttcgccaccttctagctgacttggaacaggagaccagagaggccctgaagtccctgtayggctttccagagtcccggaagcgccgagaggcggagtcctggaactccgtctcagagggaaagcagcctagattctcccaccggatcccgctgctgatct

SEQ ID NO: 2559 - DNA, 201 bp, Homo sapiens
cagccctgaagctggagccgtttgtgaataaactgttcttcatcattgacactggagaaaggtgtcctccatgccctcaggcagcagagaactggcccagrgcccttggagtgttggtggagatcagagtgccgtggtggaggtctgggactatgtcagagtgtcctcactttggggcatgggtgggcccaggagatggat

SEQ ID NO: 2560 - DNA, 201 bp, Homo sapiens
aaagcagcctagattctcccaccggatcccgctgctgatctttgatcaggatgagaagggcaaggccagggacttcttcacagggaggaagcggaaagtcrgcggtagcatcattcacaaggcttcaaatgtcatgcacatcgagtccaagcaagtggtgggattccaactgtgctcaaatgacacctccgactgtgccac

SEQ ID NO: 2561 - DNA, 201 bp, Homo sapiens
gttcttcatcattgacactggagaaaggtgtcctccatgccctcaggcagcagagaactggcccagggcccttggagtgttggtggagatcagagtgccgwggtggaggtctgggactatgtcagagtgtcctcactttggggcatgggtgggcccaggagatggatttagttattcaattttgtggatgaataaattgag

SEQ ID NO: 2562 - DNA, 201 bp, Homo sapiens
ccttggagtgttggtggagatcagagtgccgtggtggaggtctgggactatgtcagagtgtcctcactttggggcatgggtgggcccaggagatggatttrgttattcaattttgtggatgaataaattgaggcacagaaagattaagttaccggcccaaggtgacacagtgaggaggtggcagagctaggatttgaaccc

SEQ ID NO: 2563 - DNA, 201 bp, Homo sapiens
tctgttgtctgcgtcatcgagatcatcgaggtcttcttcattgacttcttctctatcattgcccgccgccagtggcagaaagccaaggagtggtgggcctrgaaacaggctcccccatgtccagaagctccccgtagcccacagggccaggacaatccagccctggatatagacgatgacctacccactttcaactctgct

SEQ ID NO: 2564 - DNA, 201 bp, Homo sapiens
gaacccaagtgcccggcacaccgccccccaaatacaataccttgcgcttggagagggccttttccaaccagctcacagatacccagatgctggatgagctstgaggcagggttgagaagacagatctagtcaggaccaccagccatggtctaaggacatggatcgggtgcccccagacgtgtgcacaggggaccctctgcc

SEQ ID NO: 2565 - DNA, 201 bp, Homo sapiens
ttggagagggccttttccaaccagctcacagatacccagatgctggatgagctctgaggcagggttgagaagacagatctagtcaggaccaccagccatgktctaaggacatggatcgggtgcccccagacgtgtgcacaggggaccctctgccccactctgggcttttcagatactctgaccaaaaagcctgctttaaac

SEQ ID NO: 2566 - DNA, 114 bp, Homo sapiens
cacgcccgtcctcrgagtcccgtcctcaaagtcccatcctcgccatggcacccggagagaagatcaaagccaaaatcaagaagaatctgcccgtgacgggccctcaggcgccga

SEQ ID NO: 2567 - DNA, 201 bp, Homo sapiens
agctgctctgttgtctgcgtcatcgagatcatcgaggtcttcttcattgacttcttctctatcattgcccgccgccagtggcagaaagccaaggagtggtrggcctggaaacaggctcccccatgtccagaagctccccgtagcccacagggccaggacaatccagccctggatatagacgatgacctacccactttcaac

SEQ ID NO: 2568 - DNA, 201 bp, Homo sapiens
atacccagatgctggatgagctctgaggcagggttgagaagacagatctagtcaggaccaccagccatggtctaaggacatggatcgggtgcccccagacrtgtgcacaggggaccctctgccccactctgggcttttcagatactctgaccaaaaagcctgctttaaaccgcaagatggggcctgggcatgcgcaggagg

SEQ ID NO: 2569 - DNA, 201 bp, Homo sapiens
tcgggtgcccccagacgtgtgcacaggggaccctctgccccactctgggcttttcagatactctgaccaaaaagcctgctttaaaccgcaagatggggcckgggcatgcgcaggaggagccatcgggtactacgcagcaacactcacaactgtccaggctgagataaatcccgggacctgaactattagcacgtcactaga

SEQ ID NO: 2570 - DNA, 201 bp, Homo sapiens
tgatcaggatgagaagggcaaggccagggacttcttcacagggaggaagcggaaagtcggcggtagcatcattcacaaggcttcaaatgtcatgcacatcragtccaagcaagtggtgggattccaactgtgctcaaatgacacctccgactgtgccacctacaccttcagctcgggaatcaatgccattcaggagtggta

SEQ ID NO: 2571 - DNA, 201 bp, Homo sapiens; identical to SEQ ID NO: 2553

SEQ ID NO: 2572 - DNA, 201 bp, Homo sapiens; identical to SEQ ID NO: 2554

SEQ ID NO: 2573 - DNA, 201 bp, Homo sapiens; identical to SEQ ID NO: 2555

SEQ ID NO: 2574 - DNA, 201 bp, Homo sapiens; identical to SEQ ID NO: 2556

SEQ ID NO: 2575 - DNA, 201 bp, Homo sapiens; identical to SEQ ID NO: 2557

SEQ ID NO: 2576 - DNA, 201 bp, Homo sapiens; identical to SEQ ID NO: 2558

SEQ ID NO: 2577 - DNA, 201 bp, Homo sapiens; identical to SEQ ID NO: 2559

SEQ ID NO: 2578 - DNA, 201 bp, Homo sapiens; identical to SEQ ID NO: 2560

SEQ ID NO: 2579 - DNA, 201 bp, Homo sapiens; identical to SEQ ID NO: 2561

SEQ ID NO: 2580 - DNA, 201 bp, Homo sapiens; identical to SEQ ID NO: 2562

SEQ ID NO: 2581 - DNA, 201 bp, Homo sapiens; identical to SEQ ID NO: 2563

SEQ ID NO: 2582 - DNA, 201 bp, Homo sapiens; identical to SEQ ID NO: 2564

SEQ ID NO: 2583 - DNA, 201 bp, Homo sapiens; identical to SEQ ID NO: 2565

SEQ ID NO: 2584 - DNA, 160 bp, Homo sapiens
aggagcagcgcacccgcacgagccttggaccctttggaaccgaaagcacgcccgtcctcrgagtcccgtcctcaaagtcccatcctcgccatggcacccggagagaagatcaaagccaaaatcaagaagaatctgcccgtgacgggccctcaggcgccga

SEQ ID NO: 2585 - DNA, 201 bp, Homo sapiens; identical to SEQ ID NO: 2567

SEQ ID NO: 2586 - DNA, 201 bp, Homo sapiens; identical to SEQ ID NO: 2568

SEQ ID NO: 2587 - DNA, 201 bp, Homo sapiens; identical to SEQ ID NO: 2569

SEQ ID NO: 2588 - DNA, 201 bp, Homo sapiens; identical to SEQ ID NO: 2570

SEQ ID NO: 2589 - DNA, 201 bp, Homo sapiens; identical to SEQ ID NO: 2553

SEQ ID NO: 2590 - DNA, 201 bp, Homo sapiens; identical to SEQ ID NO: 2554

SEQ ID NO: 2591 - DNA, 201 bp, Homo sapiens; identical to SEQ ID NO: 2555

SEQ ID NO: 2592 - DNA, 201 bp, Homo sapiens; identical to SEQ ID NO: 2556

SEQ ID NO: 2593 - DNA, 201 bp, Homo sapiens; identical to SEQ ID NO: 2557

SEQ ID NO: 2594 - DNA, 201 bp, Homo sapiens; identical to SEQ ID NO: 2558

SEQ ID NO: 2595 - DNA, 201 bp, Homo sapiens
cagccctgaagctggagccgtttgtgaataaactgttcttcatcattgacactggagaaaggtgtcctccatgccctcaggcagcagagaactggcccagrgcccttggagtgttggtggagatcagagtgccgtggtggaggtctgggactatgtcagagtgtcctcactttggggcatggccaagaatttttatttttg

SEQ ID NO: 2596 - DNA, 201 bp, Homo sapiens; identical to SEQ ID NO: 2560

SEQ ID NO: 2597 - DNA, 201 bp, Homo sapiens
gttcttcatcattgacactggagaaaggtgtcctccatgccctcaggcagcagagaactggcccagggcccttggagtgttggtggagatcagagtgccgwggtggaggtctgggactatgtcagagtgtcctcactttggggcatggccaagaatttttatttttgcttttaaatagcaaaagaagaagattctgtgact

SEQ ID NO: 2598 - DNA, 201 bp, Homo sapiens; identical to SEQ ID NO: 2563

SEQ ID NO: 2599 - DNA, 201 bp, Homo sapiens; identical to SEQ ID NO: 2564

SEQ ID NO: 2600 - DNA, 201 bp, Homo sapiens; identical to SEQ ID NO: 2565

SEQ ID NO: 2601 - DNA, 160 bp, Homo sapiens; identical to SEQ ID NO: 2584

SEQ ID NO: 2602 - DNA, 201 bp, Homo sapiens; identical to SEQ ID NO: 2567

SEQ ID NO: 2603 - DNA, 201 bp, Homo sapiens; identical to SEQ ID NO: 2568

SEQ ID NO: 2604 - DNA, 201 bp, Homo sapiens; identical to SEQ ID NO: 2569

SEQ ID NO: 2605 - DNA, 201 bp, Homo sapiens; identical to SEQ ID NO: 2570

SEQ ID NO: 2606 - DNA, 201 bp, Homo sapiens
gacatgacagagccaggtggagctggagagccagcattatggaaaaacaccagttctagcatggagccgactgcacccctggtgactcctccacccaaagsaggaggcgacatggctgtggtagtgtcaaaggaaggttcctgggagaaacctagtgatgacagctttcagaagtctgaagcccaggccatcccagagatg

SEQ ID NO: 2607 - DNA, 201 bp, Homo sapiens
gcctttaagtcttacctgtttacagcccattctgatgggttctttgtcattctgttagtataacccagtacttttcctgctgcctggaatgccctcttctrtgttacctattctgtccgttgagatcccccaacttgggccaaagccaagagatctatgtgccttctctggttttctccacatctatagcacctcaactga

SEQ ID NO: 2608 - DNA, 201 bp, Homo sapiens
gccttccatttcaagcaatagaatgtagtctggcacggattgctccctcaggtgaccagtgggaagaggaagctttggatgagtttgatagactcactcaytgtgctgactggaagcctctggtagccaagatctctagctatgtccagactgggatctcaacttggccaaagatctacttatatgatactagcaatggga

SEQ ID NO: 2609 - DNA, 201 bp, Homo sapiens
gatgataaccttgaagatgactacttactctgaagtctgggcttcagtttgctcagccatctgctttgctgtatgttgcctgcaatgaactcgctgaagcrtgctcagccctggaactggtgctaccagagttccgtagggaacctttactctttagaggttccctgatataaatcattcataagacttcctaccctggaa

SEQ ID NO: 2610 - DNA, 201 bp, Homo sapiens
ctgaccaggtcaagttcaacgtgtttcaaggcatcatggattccctgttccagtccttcaatgcctccatctcagtggccagcttccaggagctgtcagcrtgtgtcttcagctggatcgaggagcactgtaagcctcagaccctgcgggagattgtgattggcgtcctgcaccaattgaaaaaccagctttactgaccgg

SEQ ID NO: 2611 - DNA, 130 bp, Homo sapiens
cgccacccgcttcctcgccgcagggggccmgcccgctggcccgtttccggtccggtgggtacaagatgacggagccgggcgcctctcccgaggacccttgggtcaaggtggagtatgcctacagcgacaa

SEQ ID NO: 2612 - DNA, 201 bp, Homo sapiens
ctgaactgctgggcccgggagactggactacaacacctcacactggtcagctggtttctacttggtgtttggtttttcccagccccattttatcttcagcrgagccgcggtgtttgttttgtgaaagcttctgattaatttattatattgacgataaaactcaaacctacccagccttccccccactccatggaagtcctt

SEQ ID NO: 2613 - DNA, 201 bp, Homo sapiens
tgtttgttttgtgaaagcttctgattaatttattatattgacgataaaactcaaacctacccagccttccccccactccatggaagtccttgggatgggcrtctgctctggacaccccaaagagctcctgccctctcagccctttattcaagcctcagatttctgctcatgatctacatagatttggaaactgttttcctc

SEQ ID NO: 2614 - DNA, 201 bp, Homo sapiens
gagaagaaaaagcaggaggaggaggtgtccacgttacgcaaggatgtcaccgccctaaagatcatgaaagtgaactatgagcagattgtgaaggcacaccrggacaacccccatgaaggggaggaccaggtctctgaccaggtcaagttcaacgtgtttcaaggcatcatggattccctgttccagtccttcaatgcctcc

SEQ ID NO: 2615 - DNA, 201 bp, Homo sapiens
ggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagtt

SEQ ID NO: 2616 - DNA, 201 bp, Homo sapiens
gggctttctggccatctcagggaggggccaccaggttcctcccctcaccccatattccatcaccttcctcctctgctctgggtggtaagggaagccctccyggttcccacaggctatgatgctgcatggcagaggcaggtataacacagcactacatattggaaattttttatttttctaaataccaatgcagttttgcta

SEQ ID NO: 2617 - DNA, 201 bp, Homo sapiens
tggagaacagccaacaagaggcccttgaatctctacgtggccactgaactgctgggcccgggagactggactacaacacctcacactggtcagctggtttstacttggtgtttggtttttcccagccccattttatcttcagcggagccgcggtgtttgttttgtgaaagcttctgattaatttattatattgacgataaa

SEQ ID NO: 2618 - DNA, 120 bp, Homo sapiens
ttcctcgccgcagggggccmgcccgctggcccgtttccggtccggtgggtacaagatgacggagccgggcgcctctcccgaggacccttgggtcaaggcaagccccgtgggcgcgcacgc

SEQ ID NO: 2619 - DNA, 201 bp, Homo sapiens; identical to SEQ ID NO: 2610

SEQ ID NO: 2620 - DNA, 201 bp, Homo sapiens
gctaatagcatcggttccaccagtgcctcttctgtccccaacacaggtaggcagtaacatcccccccgacctcagggggctcagatatgtcataattgtartacctttcctagacagggaagccccagccatccacacaggggtgctggagccaaagtatcagacacaaggtctcaccatctttcacctcatctggaacat

SEQ ID NO: 2621 - DNA, 201 bp, Homo sapiens; identical to SEQ ID NO: 2615

SEQ ID NO: 2622 - DNA, 201 bp, Homo sapiens; identical to SEQ ID NO: 2617

SEQ ID NO: 2623 - DNA, 201 bp, Homo sapiens; identical to SEQ ID NO: 2612

SEQ ID NO: 2624 - DNA, 201 bp, Homo sapiens
cgacctcagggggctcagatatgtcataattgtagtacctttcctagacagggaagccccagccatccacacaggggtgctggagccaaagtatcagacasaaggtctcaccatctttcacctcatctggaacattaggtggttctgtccatctgccttctctggacaccaggttcttcccagctggggaaaggtgggcta

SEQ ID NO: 2625 - DNA, 201 bp, Homo sapiens
acccgcaaggggagtgtagtgtccagagctaatagcatcggttccaccagtgcctcttctgtccccaacacaggtaggcagtaacatcccccccgacctcrgggggctcagatatgtcataattgtagtacctttcctagacagggaagccccagccatccacacaggggtgctggagccaaagtatcagacacaaggtct

SEQ ID NO: 2626 - DNA, 201 bp, Homo sapiens; identical to SEQ ID NO: 2613

SEQ ID NO: 2627 - DNA, 201 bp, Homo sapiens; identical to SEQ ID NO: 2614

SEQ ID NO: 2628 - DNA, 201 bp, Homo sapiens; identical to SEQ ID NO: 2616

SEQ ID NO: 2629 - DNA, 201 bp, Homo sapiens; identical to SEQ ID NO: 2610

SEQ ID NO: 2630 - DNA, 120 bp, Homo sapiens; identical to SEQ ID NO: 2618

SEQ ID NO: 2631 - DNA, 201 bp, Homo sapiens; identical to SEQ ID NO: 2612

SEQ ID NO: 2632 - DNA, 201 bp, Homo sapiens; identical to SEQ ID NO: 2613

SEQ ID NO: 2633 - DNA, 201 bp, Homo sapiens; identical to SEQ ID NO: 2614

SEQ ID NO: 2634 - DNA, 201 bp, Homo sapiens; identical to SEQ ID NO: 2615

SEQ ID NO: 2635 - DNA, 201 bp, Homo sapiens; identical to SEQ ID NO: 2616

SEQ ID NO: 2636 - DNA, 201 bp, Homo sapiens; identical to SEQ ID NO: 2617

SEQ ID NO: 2637 - DNA, 201 bp, Homo sapiens
aatccaggagttaaagaaggaatgcgctggctacagagagagattgaagaacattaaagcagctaccaatcatgtgactccagaagagaaagagcaggtgwacagagagaggcagaagtactgtaaggagtggaggaagaggaagaggatggctacagagctgtctgatgcaatacttgaaggataccccaagagcaagaa

SEQ ID NO: 2638 - DNA, 201 bp, Homo sapiens
tgttcgggaacctacagcgggaacacggactgggcaaggcggtggtggtgaagacgctggagcagctggcgcaacaaggcaagatcaaagagaagatgtayggcaagcagaagatctattttgcggatcaggaccagtttgacatggtgagtgatgctgaccttcaagtcctagatggcaaaatcgtggccctcactgcta

SEQ ID NO: 2639 - DNA, 201 bp, Homo sapiens
aactgcattggtatttagaaaaataaaaaatttccaatatgtagtgctgtgttatacctgcctctgccatgcagcatcatagcctgtgggaaccgggagggcttcccttaccacccagagcagaggaggaaggtgatggaatatggggtgaggggaggaacctggtggcccctccctgagatggccagaaagcccttggcc

SEQ ID NO: 2640 - DNA, 201 bp, Homo sapiens
tagcaaaactgcattggtatttagaaaaataaaaaatttccaatatgtagtgctgtgttatacctgcctctgccatgcagcatcatagcctgtgggaaccrggagggcttcccttaccacccagagcagaggaggaaggtgatggaatatggggtgaggggaggaacctggtggcccctccctgagatggccagaaagccc

SEQ ID NO: 2641 - DNA, 201 bp, Homo sapiens; identical to SEQ ID NO: 2637

SEQ ID NO: 2642 - DNA, 201 bp, Homo sapiens; identical to SEQ ID NO: 2638

SEQ ID NO: 2643 - DNA, 201 bp, Homo sapiens; identical to SEQ ID NO: 2639

SEQ ID NO: 2644 - DNA, 201 bp, Homo sapiens; identical to SEQ ID NO: 2640

SEQ ID NO: 2645 - DNA, 201 bp, Homo sapiens; identical to SEQ ID NO: 2637

SEQ ID NO: 2646 - DNA, 201 bp, Homo sapiens; identical to SEQ ID NO: 2638

SEQ ID NO: 2647 - DNA, 201 bp, Homo sapiens; identical to SEQ ID NO: 2639

SEQ ID NO: 2648 - DNA, 201 bp, Homo sapiens; identical to SEQ ID NO: 2640

SEQ ID NO: 2649 - DNA, 201 bp, Homo sapiens; identical to SEQ ID NO: 2637

SEQ ID NO: 2650 - DNA, 201 bp, Homo sapiens
tgagtaaaggccgggcagaagctgcggcgggaggtaacggcgccgtgggcgcggggaagacccgggagggcagtgggtgaggaggtcggttgagtggcccsctcccctgcctttctctccgtagccgccgggatcctcctgaggtacctgcaggagcagaaccggccctacagctcccaggatgtgttcgggaacctacag

SEQ ID NO: 2651 - DNA, 201 bp, Homo sapiens; identical to SEQ ID NO: 2638

SEQ ID NO: 2652 - DNA, 201 bp, Homo sapiens; identical to SEQ ID NO: 2639

SEQ ID NO: 2653 - DNA, 201 bp, Homo sapiens; identical to SEQ ID NO: 2640

SEQ ID NO: 2654 - DNA, 201 bp, Homo sapiens
aagacttgtcattcagtaatattagcagatagctgcttcgataaaggaatttggagtttaaaaatcaacttgtgaaaacaaggttgtttttgtctttatcktttgttagagttatagatttatgatttcataggcttgattctatgtgaaatatctttttacttttatgcattttaataagatttaaaaatatttagatta

SEQ ID NO: 2655 - DNA, 201 bp, Homo sapiens
gaagattagaactaaatttatttttttcatttctgtcatgaaatcattccagatacctcttttcttctttccaaatggttttcacatgtgtttgaaatatytgtactttgaattgtcggattttccatgtcctcctttctcctttgtgcccagcctgagtcagcaccatcccgcattcagaacctcccagtgaaagggcag

SEQ ID NO: 2656 - DNA, 201 bp, Homo sapiens
gaactaaatttatttttttcatttctgtcatgaaatcattccagatacctcttttcttctttccaaatggttttcacatgtgtttgaaatatttgtacttygaattgtcggattttccatgtcctcctttctcctttgtgcccagcctgagtcagcaccatcccgcattcagaacctcccagtgaaagggcagccttcatt

SEQ ID NO: 2657 - DNA, 201 bp, Homo sapiens
ttctcgtgcagattgagcagctgtatgtccggcaactggcagaagaggctgggaagagctgtggagccggctctgtgatgcaggcccccgaggagccgccrccagaccaggtcttccggatgtttccagatatttgtgcctcacaccagagatcatttttcagagaaaaccaacagatcaccgtctaagtgcgtcgcttgg

SEQ ID NO: 2658 - DNA, 201 bp, Homo sapiens
aggtgacgcggaagctgttcgggcacctggagcgcggggtgctgctgcacagcagccggcagggcgtgttcgtcaagcggctgtgccagggccgcgtgttytgcagcggcaacgccgtggtgtgcaaaggcaggcccaacaagctggagcgtgatgaggtggtccaggtcttcgacaccagccagttcttccgagagctgc

SEQ ID NO: 2659 - DNA, 201 bp, Homo sapiens
ggtacaccacctacgacgcgcaccattcagcattctcccagatggtgatcagcttctactatgggggcaagctggtgggccaggccaccaccacctgcccygagggctgccgcctgtccctgagccagcctgggctgcccggcaccaagctgtatgggcccgagggcctggagctggtgcgcttcccgccggccgacgcca

SEQ ID NO: 2660 - DNA, 201 bp, Homo sapiens
cggaccggtcccaactggacatttccgagccatacaaagtttaccgaattgttcctgaggaagagcaaaaatgcaaactaggcgtggcaactgctggctgygtgaatgaagttacagagatggagtgcggtcgctctgaaatcgacgagctgatcaaggagccttctgtggacgattacatggggatgatcaaaaggagcc

SEQ ID NO: 2661 - DNA, 201 bp, Homo sapiens
actgatttgggagaatgaggagaagagcatgttccggatcccttggaaacacgctggcaagcaagattataatcaggaagtggatgcctccatttttaagrcctgggcagtttttaaagggaagtttaaagaaggggacaaagctgaaccagccacttggaagacgaggttacgctgtgctttgaataagagcccagattt

SEQ ID NO: 2662 - DNA, 130 bp, Homo sapiens
gcggcagcaagcgtgggaacgcgggcggcragacggcggcaggacggcggcaggatgtgtgaccggaatggtggtcggcggcttcgacagtggctgatcgagcagattgacagtagcatgtatccaggac

SEQ ID NO: 2663 - DNA, 201 bp, Homo sapiens
taaagggaagtttaaagaaggggacaaagctgaaccagccacttggaagacgaggttacgctgtgctttgaataagagcccagattttgaggaagtgacgraccggtcccaactggacatttccgagccatacaaagtttaccgaattgttcctgaggaagagcaaaaatgcaaactaggcgtggcaactgctggctgcgt

SEQ ID NO: 2664 - DNA, 201 bp, Homo sapiens
tgatcaaaaggagcccttccccgccggaggcctgtcggagtcagctccttccagactggtgggcgcagcagcccagcacaggcgtgccgctggtgacgggrtacaccacctacgacgcgcaccattcagcattctcccagatggtgatcagcttctactatgggggcaagctggtgggccaggccaccaccacctgccccg

SEQ ID NO: 2665 - DNA, 131 bp, Homo sapiens
gcggcagcaagcgtgggaacgcgggcggcgrgacggcggcaggacggcggcaggatgtgtgaccggaatggtggtcggcggcttcgacagtggctgatcgagcagattgacagtagcatgtatccaggact

SEQ ID NO: 2666 - DNA, 201 bp, Homo sapiens
caacaagctggagcgtgatgaggtggtccaggtcttcgacaccagccagttcttccgagagctgcagcagttctataacagccagggccggcttcctgacrgcagggtggtgctgtgctttggggaagagtttccggatatggcccccttgcgctccaaactcattctcgtgcagattgagcagctgtatgtccggcaact

SEQ ID NO: 2667 - DNA, 201 bp, Homo sapiens
agccatacaaagtttaccgaattgttcctgaggaagagcaaaaatgcaaactaggcgtggcaactgctggctgcgtgaatgaagttacagagatggagtgyggtcgctctgaaatcgacgagctgatcaaggagccttctgtggacgattacatggggatgatcaaaaggagcccttccccgccggaggcctgtcggagtc

SEQ ID NO: 2668 - DNA, 201 bp, Homo sapiens
gaattgttcctgaggaagagcaaaaatgcaaactaggcgtggcaactgctggctgcgtgaatgaagttacagagatggagtgcggtcgctctgaaatcgaygagctgatcaaggagccttctgtggacgattacatggggatgatcaaaaggagcccttccccgccggaggcctgtcggagtcagctccttccagactggt

SEQ ID NO: 2669 - DNA, 201 bp, Homo sapiens
tttacgtgtggatggagttcacaggcgaatagaggagaggaccaggggacgtggcttgtcccttttgtccaacaaagcattatatttttaagaatggcagwcctgtttgctgaagtgttcataagataacaataggcttgaatctccaattcaaatgaatgtcaaagcacatatctttaatatgctgaatgaatatttatt

SEQ ID NO: 2670 - DNA, 201 bp, Homo sapiens
tggaaggagaagtccgttcactcctaaaggatataagccagaaagttgctgtgtatagcacatgcttgtaacagaggagaataaaaaatggctgaggtgamcaaggtaaaacaactacattttaaaaactgacttaatgctcttcaaaataaaacatcacctatttaatgtttttaatcacattttgtatggagttaaata

SEQ ID NO: 2671 - DNA, 201 bp, Homo sapiens
aggctcgcctccttgatgaactggcaggcaagctacaaagcctagacctttcagccgctgccgaaatgacctgtggaacacccccaggggcctcctgttcygagactgaatgtggcgggccaaactgcagaactgacgaaggagagaggaagtgtggggggcctggctgtggtggtctggttactgttgcacacaacgcct

SEQ ID NO: 2672 - DNA, 201 bp, Homo sapiens
acagcttgcctgtgtttgtgatcctggatacattggttccagatgtgacgactgtgcctcaggatactttggcaatccatcagaagttggggggtcgtgtsagccttgccagtgtcacaacaacattgacacgacagacccagaagcctgtgacaaggagactgggaggtgtctcaagtgcctgtaccacacggaagggga

SEQ ID NO: 2673 - DNA, 201 bp, Homo sapiens
gatagtgctgatttggacagcattgaagcagttgctaatgaagtattgaaaatggagatgcctagcaccccacagcagttacagaacttgacagaagatayacgtgaacgagttgaaagcctttctcaagtagaggttattcttcagcatagtgctgctgacattgccagagctgagatgttgttagaagaagctaaaaga

SEQ ID NO: 2674 - DNA, 201 bp, Homo sapiens
ttatgatatggtggttcgaggaaattgcttctgctatggtcatgccagcgaatgtgcccctgtggatggattcaatgaagaagtggaaggaatggttcacrgacactgcatgtgcaggcataacaccaagggcttaaactgtgaactctgcatggatttctaccatgatttaccttggagacctgctgaaggccgaaacag

SEQ ID NO: 2675 - DNA, 201 bp, Homo sapiens
ctgctgaaggccgaaacagcaacgcctgtaaaaaatgtaactgcaatgaacattccatctcttgtcactttgacatggctgtttacctggccacggggaaygtcagcggaggcgtgtgtgatgactgtcagcacaacaccatggggcgcaactgtgagcagtgcaagccgttttactaccagcacccagagagggacatcc

SEQ ID NO: 2676 - DNA, 201 bp, Homo sapiens
aggatctgtcaatgccttctgcaatcccgtcactggccagtgccactgtttccagggagtgtatgctcggcagtgtgatcggtgcttacctgggcactggrgctttccaagttgccagccctgccagtgcaatggccacgccgatgactgcgacccagtgactggggagtgcttgaactgccaggactacaccatgggtca

SEQ ID NO: 2677 - DNA, 201 bp, Homo sapiens
cctccttgatgaactggcaggcaagctacaaagcctagacctttcagccgctgccgaaatgacctgtggaacacccccaggggcctcctgttccgagactkaatgtggcgggccaaactgcagaactgacgaaggagagaggaagtgtggggggcctggctgtggtggtctggttactgttgcacacaacgcctggcagaa

SEQ ID NO: 2678 - DNA, 201 bp, Homo sapiens
ttgacatggctgtttacctggccacggggaacgtcagcggaggcgtgtgtgatgactgtcagcacaacaccatggggcgcaactgtgagcagtgcaagccrttttactaccagcacccagagagggacatccgagatcctaatttctgtgaacgatgtacgtgtgacccagctggctctcaaaatgagggaatttgtgaca

SEQ ID NO: 2679 - DNA, 201 bp, Homo sapiens
attccaaccagcagccgatgtggtaataccatccccgatgatgacaaccaggtggtgtcattatcaccaggctcaagatatgtcgtccttcctcggccggygtgctttgagaagggaacaaactacacggtgaggttggagctgcctcagtacacctcctctgatagcgacgtggagagcccctacacgctgatcgattct

SEQ ID NO: 2680 - DNA, 201 bp, Homo sapiens
ctttgacatggctgtttacctggccacggggaacgtcagcggaggcgtgtgtgatgactgtcagcacaacaccatggggcgcaactgtgagcagtgcaagycgttttactaccagcacccagagagggacatccgagatcctaatttctgtgaacgatgtacgtgtgacccagctggctctcaaaatgagggaatttgtga

SEQ ID NO: 2681 - DNA, 201 bp, Homo sapiens
cggaggaagccaacttggggcctggggttagcatagtggagcggcaatatatccaggaccggattccctcctggactggagccggcttcgtccgagtgcckgaaggggcttatttggagtttttcattgacaacataccatattccatggagtacgacatcctaattcgctacgagccacagctacccgaccactgggaaa

SEQ ID NO: 2682 - DNA, 201 bp, Homo sapiens
cgacagtggacgccagtttgccaggagctgctaccaagatcctgttactttacagcttgcctgtgtttgtgatcctggatacattggttccagatgtgacractgtgcctcaggatactttggcaatccatcagaagttggggggtcgtgtcagccttgccagtgtcacaacaacattgacacgacagacccagaagcctg

SEQ ID NO: 2683 - DNA, 201 bp, Homo sapiens
ttggatactatggtgatgccctccagcaggactgtcgaaagtgtgtctgtaattacctgggcaccgtgcaagagcactgtaacggctctgactgccagtgygacaaagccactggtcagtgcttgtgtcttcctaatgtgatcgggcagaactgtgaccgctgtgcgcccaatacctggcagctggccagtggcactggct

SEQ ID NO: 2684 - DNA, 201 bp, Homo sapiens
acctctatgaagcggaggaagccaacttggggcctggggttagcatagtggagcggcaatatatccaggaccggattccctcctggactggagccggcttygtccgagtgcctgaaggggcttatttggagtttttcattgacaacataccatattccatggagtacgacatcctaattcgctacgagccacagctacccg

SEQ ID NO: 2685 - DNA, 201 bp, Homo sapiens
ctttgagaagggaacaaactacacggtgaggttggagctgcctcagtacacctcctctgatagcgacgtggagagcccctacacgctgatcgattctcttsttctcatgccatactgtaaatcactggacatcttcaccgtgggaggttcaggagatggggtggtcaccaacagtgcctgggaaacctttcagagataccg

SEQ ID NO: 2686 - DNA, 201 bp, Homo sapiens
gcctgtgacaaggagactgggaggtgtctcaagtgcctgtaccacacggaaggggaacactgtcagttctgccggtttggatactatggtgatgccctccrgcaggactgtcgaaagtgtgtctgtaattacctgggcaccgtgcaagagcactgtaacggctctgactgccagtgcgacaaagccactggtcagtgcttg

SEQ ID NO: 2687 - DNA, 201 bp, Homo sapiens
accagtgcctgccagagcactggggcttaagcaatgatttggatggatgtcgaccatgtgactgtgaccttgggggagccttaaacaacagttgctttgcrgagtcaggccagtgctcatgccggcctcacatgattggacgtcagtgcaacgaagtggaacctggttactactttgccaccctggatcactacctctatg

SEQ ID NO: 2688 - DNA, 201 bp, Homo sapiens
attgtgatgtttgcaaagaaggcttctatgatttaagcagtgaagatccatttggttgtaaatcttgtgcttgcaatcctctgggaacaattcctggaggraatccttgtgattccgagacaggtcactgctactgcaagcgtctggtgacaggacagcattgtgaccagtgcctgccagagcactggggcttaagcaatg

SEQ ID NO: 2689 - DNA, 201 bp, Homo sapiens
gtgacccatgcaactgcaatgctgctcattccttcgggccatcttgcaatgagttcacggggcagtgccagtgcatgcctgggtttggaggccgcacctgyagcgagtgccaggaactcttctggggagaccccgacgtggagtgccgagcctgtgactgtgaccccaggggcattgagacgccacagtgtgaccagtcca

SEQ ID NO: 2690 - DNA, 139 bp, Homo sapiens
gggacctggaagcgccccagccccgcagcgatcgcagaytcggctttcaaacaaaagaggcgccccggggggtgggaccgggacctcacccggtcctcgcagagttgcggccgcccgccccttcagccccggctctccg

SEQ ID NO: 2691 - DNA, 201 bp, Homo sapiens
tatggtaaaggaagctctggaagaagcagaaaaggcccaggtcgcagcagagaaggcaattaaacaagcagatgaagacattcaaggaacccagaacctgytaacttcgattgagtctgaaacagcagcttctgaggaaaccttgttcaacgcgtcccagcgcatcagcgagttagagaggaatgtggaagaacttaagcg

SEQ ID NO: 2692 - DNA, 201 bp, Homo sapiens
taactatccaactggatttggaagcagaattccattttactcatctcataatgactttcaagacattccgtccagctgctatgctgatagaacgatcgtcygactttgggaaaacctggggtgtgtatagatacttcgcctatgactgtgaggcctcgtttccaggcatttcaactggccccatgaaaaaagtcgatgaca

SEQ ID NO: 2693 - DNA, 201 bp, Homo sapiens
atatttaaatttatataagaaaatgttagaaaaaaatatggggagtgtatataaaacttgctttattgcatggggcaggggaagtccaggcctaatactcytaaagtaagagttgggtcctttttttcttcaatacaactgtgctgtaccttgtaaagtattttatctgctgcttatttgtggaatgaaacctcaaacaaa

SEQ ID NO: 2694 - DNA, 201 bp, Homo sapiens
caggtatgatatgttcaaggatagatcatcaagactttcatcattaaatcattcttacagtcactctcatggaatgaagaagaggtcttctgattctcatraagacctactgagtggcctctactttgaccagagaaactatagcagtcttagacatagcaaacccacctctgcctactacactcggcagtcttcttccct

SEQ ID NO: 2695 - DNA, 201 bp, Homo sapiens
agctcttcggcccttcccggacagcgacgcagtcgcagcgcgcgccctaacacagatgtgggaagataaatgaaggggtctagatgtaaatgtcagtggaraggagagctaccatcactaagggctgaaaacacagttaaatcactttcaaagttaaaagactattaagaacacaagatggggactcctgcttctggaagg

SEQ ID NO: 2696 - DNA, 201 bp, Homo sapiens
tgaacactttggattttgttgtagtttgattctagggtagaaccagtccatgctgtttttattttttatctccgtaattgtagaatcatgtttactcaacrtttttccccagctgcctcagtaactgggcactcggaggccttggcacgggttctggaggacagacagcaattctatgagtgctcactgagatacttgctg

SEQ ID NO: 2697 - DNA, 201 bp, Homo sapiens
tccagacacttcattaagtgaattgcgggatatctatgaccttaaggaccagatacaggatgtagaagggagatacatgcaggggcttaaagaactaaagraatctttgtctgaagtggaagaaaaatacaagaaagccatggtttccaatgcacagttagacaatgagaagaacaatttgatctaccaagtagacacact

SEQ ID NO: 2698 - DNA, 201 bp, Homo sapiens
tttgaccagagaaactatagcagtcttagacatagcaaacccacctctgcctactacactcggcagtcttcttccctgtacagtgaccctctggcaacatrtaagagtgacagggcctctcctactgcaaattctggtctgctgagaagtgccagtctggcatcattgtacaatggtggattatataacccttatggtcct

SEQ ID NO: 2699 - DNA, 201 bp, Homo sapiens
acagggcctctcctactgcaaattctggtctgctgagaagtgccagtctggcatcattgtacaatggtggattatataacccttatggtcctcgaactccwtctgaatgcagttattattcatcaagaataagttcagcccgaagcagtccagggtttaccaacgatgacactgcaagcattgtgtcttctgatcgtgcca

SEQ ID NO: 2700 - DNA, 101 bp, Homo sapiens
tctattaaatacacccttttgccaaccacaattggctactgacatgttcattttgttataggagactttaaaacaaatcatggcaaccacatccctcttcr

SEQ ID NO: 2701 - DNA, 181 bp, Homo sapiens
atggctatgaaatctgaggacttccctccagacaagaagggactgagggaagtcctgatcaaaggactgagaaggaaggggaaagggcttgccagttctggacaaggccagcagagagaaacatgcttgcaggactactcagaatggtggcttcttctgctaatggaggcctggaaccctt

SEQ ID NO: 2702 - DNA, 201 bp, Homo sapiens
aatacaagaaagccatggtttccaatgcacagttagacaatgagaagaacaatttgatctaccaagtagacacactcaaggatgttattgaagagcaggargaacagatggcagaattttatagagaaaatgaagaaaaatcaaaggagttagaaaggcagaaacatatgtgtagtgtgctgcagcataagatggaagaac

SEQ ID NO: 2703 - DNA, 198 bp, Homo sapiens
gtattttatctgctgcttatttgtggaatgaaacctcaaacaaacccaaagggggagggtagggcagggcaggcagattggaaatctgcctgcagattctrttaaatacacccttttgccaaccacaattggctactgacatgttcattttgttataggagactttaaaacaaatcatggcaaccacatccctcttct

SEQ ID NO: 2704 - DNA, 201 bp, Homo sapiens
cttagacatagcaaacccacctctgcctactacactcggcagtcttcttccctgtacagtgaccctctggcaacatataagagtgacagggcctctcctaytgcaaattctggtctgctgagaagtgccagtctggcatcattgtacaatggtggattatataacccttatggtcctcgaactccatctgaatgcagttat

SEQ ID NO: 2705 - DNA, 201 bp, Homo sapiens; identical to SEQ ID NO: 2693

SEQ ID NO: 2706 - DNA, 201 bp, Homo sapiens; identical to SEQ ID NO: 2694

SEQ ID NO: 2707 - DNA, 146 bp, Homo sapiens
atgtgggaagataaatgaaggggtctagatgtaaatgtcagtggaraggagagctaccatcactaagggctgaaaacacagttaaatcactttcaaagttaaaagactattaagaacacaagatggggactcctgcttctggaagg

SEQ ID NO: 2708 - DNA, 201 bp, Homo sapiens; identical to SEQ ID NO: 2696

SEQ ID NO: 2709 - DNA, 201 bp, Homo sapiens; identical to SEQ ID NO: 2697

SEQ ID NO: 2710 - DNA, 201 bp, Homo sapiens; identical to SEQ ID NO: 2698

SEQ ID NO: 2711 - DNA, 201 bp, Homo sapiens; identical to SEQ ID NO: 2699

SEQ ID NO: 2712 - DNA, 201 bp, Homo sapiens; identical to SEQ ID NO: 2702

SEQ ID NO: 2713 - DNA, 198 bp, Homo sapiens; identical to SEQ ID NO: 2703

SEQ ID NO: 2714 - DNA, 201 bp, Homo sapiens; identical to SEQ ID NO: 2704

SEQ ID NO: 2715 - DNA, 201 bp, Homo sapiens; identical to SEQ ID NO: 2693

SEQ ID NO: 2716 - DNA, 146 bp, Homo sapiens; identical to SEQ ID NO: 2707

SEQ ID NO: 2717 - DNA, 201 bp, Homo sapiens; identical to SEQ ID NO: 2702

SEQ ID NO: 2718 - DNA, 201 bp, Homo sapiens; identical to SEQ ID NO: 2696

SEQ ID NO: 2719 - DNA, 198 bp, Homo sapiens; identical to SEQ ID NO: 2703

SEQ ID NO: 2720 - DNA, 201 bp, Homo sapiens
tgcctcagcaacaacccctctaagtggaaactcatccagacgaggaagtggggacaccagcagcttaatagatccagacacttcattaagtgaattgcggraatctttgtctgaagtggaagaaaaatacaagaaagccatggtttccaatgcacagttagacaatgagaagaacaatttgatctaccaagtagacacact

SEQ ID NO: 2721 - DNA, 201 bp, Homo sapiens; identical to SEQ ID NO: 2693

SEQ ID NO: 2722 - DNA, 201 bp, Homo sapiens; identical to SEQ ID NO: 2695

SEQ ID NO: 2723 - DNA, 201 bp, Homo sapiens; identical to SEQ ID NO: 2702

SEQ ID NO: 2724 - DNA, 198 bp, Homo sapiens; identical to SEQ ID NO: 2703

SEQ ID NO: 2725 - DNA, 201 bp, Homo sapiens; identical to SEQ ID NO: 2720

SEQ ID NO: 2726 - DNA, 101 bp, Homo sapiens; identical to SEQ ID NO: 2700

SEQ ID NO: 2727 - DNA, 201 bp, Homo sapiens; identical to SEQ ID NO: 2693

SEQ ID NO: 2728 - DNA, 201 bp, Homo sapiens; identical to SEQ ID NO: 2695

SEQ ID NO: 2729 - DNA, 201 bp, Homo sapiens; identical to SEQ ID NO: 2696

SEQ ID NO: 2730 - DNA, 201 bp, Homo sapiens; identical to SEQ ID NO: 2720

SEQ ID NO: 2731 - DNA, 101 bp, Homo sapiens; identical to SEQ ID NO: 2700

SEQ ID NO: 2732 - DNA, 181 bp, Homo sapiens; identical to SEQ ID NO: 2701

SEQ ID NO: 2733 - DNA, 201 bp, Homo sapiens; identical to SEQ ID NO: 2702

SEQ ID NO: 2734 - DNA, 198 bp, Homo sapiens; identical to SEQ ID NO: 2703

SEQ ID NO: 2735 - DNA, 201 bp, Homo sapiens; identical to SEQ ID NO: 2693

SEQ ID NO: 2736 - DNA, 201 bp, Homo sapiens; identical to SEQ ID NO: 2694

SEQ ID NO: 2737 - DNA, 201 bp, Homo sapiens; identical to SEQ ID NO: 2695

SEQ ID NO: 2738 - DNA, 201 bp, Homo sapiens; identical to SEQ ID NO: 2697

SEQ ID NO: 2739 - DNA, 201 bp, Homo sapiens; identical to SEQ ID NO: 2698

SEQ ID NO: 2740 - DNA, 201 bp, Homo sapiens; identical to SEQ ID NO: 2699

SEQ ID NO: 2741 - DNA, 101 bp, Homo sapiens; identical to SEQ ID NO: 2700

SEQ ID NO: 2742 - DNA, 201 bp, Homo sapiens; identical to SEQ ID NO: 2702

SEQ ID NO: 2743 - DNA, 198 bp, Homo sapiens; identical to SEQ ID NO: 2703

SEQ ID NO: 2744 - DNA, 201 bp, Homo sapiens; identical to SEQ ID NO: 2704

SEQ ID NO: 2745 - DNA, 201 bp, Homo sapiens; identical to SEQ ID NO: 2693

SEQ ID NO: 2746 - DNA, 201 bp, Homo sapiens; identical to SEQ ID NO: 2694

SEQ ID NO: 2747 - DNA, 201 bp, Homo sapiens
ccctcgcccatagccccagcgggcgccgggcgggcgagcagctcttcggcccttcccggaggaagataaatgaaggggtctagatgtaaatgtcagtggaraggagagctaccatcactaagggctgaaaacacagttaaatcactttcaaagttaaaagactattaagaacacaagatggggactcctgcttctggaagg

SEQ ID NO: 2748 - DNA, 201 bp, Homo sapiens; identical to SEQ ID NO: 2697

SEQ ID NO: 2749 - DNA, 201 bp, Homo sapiens; identical to SEQ ID NO: 2698

SEQ ID NO: 2750 - DNA, 201 bp, Homo sapiens; identical to SEQ ID NO: 2699

SEQ ID NO: 2751 - DNA, 181 bp, Homo sapiens; identical to SEQ ID NO: 2701

SEQ ID NO: 2752 - DNA, 201 bp, Homo sapiens; identical to SEQ ID NO: 2702

SEQ ID NO: 2753 - DNA, 198 bp, Homo sapiens; identical to SEQ ID NO: 2703

SEQ ID NO: 2754 - DNA, 201 bp, Homo sapiens; identical to SEQ ID NO: 2704

SEQ ID NO: 2755 - DNA, 201 bp, Homo sapiens; identical to SEQ ID NO: 2693

SEQ ID NO: 2756 - DNA, 201 bp, Homo sapiens; identical to SEQ ID NO: 2695

SEQ ID NO: 2757 - DNA, 201 bp, Homo sapiens; identical to SEQ ID NO: 2702

SEQ ID NO: 2758 - DNA, 198 bp, Homo sapiens; identical to SEQ ID NO: 2703

SEQ ID NO: 2759 - DNA, 201 bp, Homo sapiens; identical to SEQ ID NO: 2697

SEQ ID NO: 2760 - DNA, 101 bp, Homo sapiens; identical to SEQ ID NO: 2700

SEQ ID NO: 2761 - DNA, 201 bp, Homo sapiens
gtcctctgggagaagtggttgaacagggcataacacgggtgaggaacgccacagatgcagttggaattgtgctgaaagagctaaagaggcaaagttctttsggtatgtttcacctcctagtggccgtggatggaatcaatgctctttggggaagaaccactctgaaaagagaagataaaagcccgattgcccccgaggaat

SEQ ID NO: 2762 - DNA, 201 bp, Homo sapiens
ctggaactcctgggctcaagcaatatgcccatctcagcctcccaaggtgctgggattacaggaaggatttgatgccctggatccctttattcccatcctgrtttccaactataacccaaaggaatttgaaagttgtattcagtattatttggaaaacaattggcttcaacatgagaaagctcctacagaagaagggaaaaa

SEQ ID NO: 2763 - DNA, 201 bp, Homo sapiens
gcttatctctaggatccataaggccaagcatggggatcagcacgagggtcagcactacaacatctccccccaggatttggagactgtatttccccatggcyttcctcctcgctttgtgatgcaggtgaagacattcagtgaagcttgcctgatggtaaggaaaccagccctagaacttctgcattacctgaaaaacaccag

SEQ ID NO: 2764 - DNA, 201 bp, Homo sapiens
cccagaaagcccaggattcaatcgctgagagagtgcttaggcccgaatgccggcccaaatcgttctactcaccgtgtcggaggccgagagcgatgagagtrcagggaagtgaggaagagggggtggccgccaggctcctccgcttccctgggtccaccgcggatccctcccgcttgtcaggaggcggccagcggtctcagg

SEQ ID NO: 2765 - DNA, 163 bp, Homo sapiens
ggcacggtggcatgcgcctgtaatccaagctacttgggaggctgaggcaggagaattgcttcaacttgggaggcggatgttgcagtgagccaaaattgcascactgcactccagcctgggcagcagagcaagactccgtctcaaaataaataaataaataaat

SEQ ID NO: 2766 - DNA, 201 bp, Homo sapiens
gctctggacctgcattaaaatgggtttcactgtgaatgcgtgacaataagatattcccttgttcctaaaactttatatcagtttattggatgtggtttttmacatttaagataattatggctcttttcctaaaaaataaaatatctttctaaagtgttgtgttagattaataatatggaaggagtctttagattggccaaa

SEQ ID NO: 2767 - DNA, 201 bp, Homo sapiens
atctgctttatgctggacccagtaagatgaggaagtcgggcagtacacaggaagaggagccaggcccttgtacctatgggattggacaggactgcagttgkctctggacctgcattaaaatgggtttcactgtgaatgcgtgacaataagatattcccttgttcctaaaactttatatcagtttattggatgtggtttttc

SEQ ID NO: 2768 - DNA, 201 bp, Homo sapiens
gctgggattacaggaaggatttgatgccctggatccctttattcccatcctggtttccaactataacccaaaggaatttgaaagttgtattcagtattatytggaaaacaattggcttcaacatgagaaagctcctacagaagaagggaaaaaagagctgctgttcctaagtaacgcgaacccctcgctgctggagcggca

SEQ ID NO: 2769 - DNA, 201 bp, Homo sapiens
acgccacagatgcagttggaattgtgctgaaagagctaaagaggcaaagttctttgggtatgtttcacctcctagtggccgtggatggaatcaatgctctytggggaagaaccactctgaaaagagaagataaaagcccgattgcccccgaggaattagcacttgttcacaacttgaggaaaatgatgaaaaatgattggc

SEQ ID NO: 2770 - DNA, 115 bp, Homo sapiens
ctgctctcccagagrtccaggtccgggagatgacagtggctcccagaaagcccaggattcaatcgctgagagagtgcttaggcccgaatgccggcccaaatcgttctactcaccg

SEQ ID NO: 2771 - DNA, 201 bp, Homo sapiens
tgggtccaccgcggatccctcccgcttgtcaggaggcggccagcggtctcaggacgggcgctttggagccggccccaggcagcgtgtgtcggtcgcctagkctggagaactagtcctcgactcacgtgcaaggatgatgctgaaaggaataacaaggcttatctctaggatccataaggccaagcatggggatcagcacga

SEQ ID NO: 2772 - DNA, 109 bp, Homo sapiens
ctgctctcycagaggtccaggtccgggagatgacagtggctcccagaaagcccaggattcaatcgctgagagagtgcttaggcccgaatgccggcccaaatcgttctac

SEQ ID NO: 2773 - DNA, 201 bp, Homo sapiens
aagttgtattcagtattatttggaaaacaattggcttcaacatgagaaagctcctacagaagaagggaaaaaagagctgctgttcctaagtaacgcgaacmcctcgctgctggagcggcactgtgcctacctctaagccaagatcacagcatgtgaggaagacagtggacatctgctttatgctggacccagtaagatgag

SEQ ID NO: 2774 - DNA, 201 bp, Homo sapiens; identical to SEQ ID NO: 2761

SEQ ID NO: 2775 - DNA, 201 bp, Homo sapiens
ccagactgggtctctctttaagccccggaaagcctatctgccccaggagttgctgggaaaggaaggatttgatgccctggatccctttattcccatcctgrtttccaactataacccaaaggaatttgaaagttgtattcagtattatttggaaaacaattggcttcaacatgagaaagctcctacagaagaagggaaaaa

SEQ ID NO: 2776 - DNA, 201 bp, Homo sapiens
ccgcaccaatgagaatgacccggccaagcatggggatcagcacgagggtcagcactacaacatctccccccaggatttggagactgtatttccccatggcyttcctcctcgctttgtgatgcaggtgaagacattcagtgaagcttgcctgatggtaaggaaaccagccctagaacttctgcattacctgaaaaacaccag

SEQ ID NO: 2777 - DNA, 201 bp, Homo sapiens; identical to SEQ ID NO: 2764

SEQ ID NO: 2778 - DNA, 163 bp, Homo sapiens; identical to SEQ ID NO: 2765

SEQ ID NO: 2779 - DNA, 201 bp, Homo sapiens; identical to SEQ ID NO: 2766

SEQ ID NO: 2780 - DNA, 201 bp, Homo sapiens; identical to SEQ ID NO: 2767

SEQ ID NO: 2781 - DNA, 201 bp, Homo sapiens
gttgctgggaaaggaaggatttgatgccctggatccctttattcccatcctggtttccaactataacccaaaggaatttgaaagttgtattcagtattatytggaaaacaattggcttcaacatgagaaagctcctacagaagaagggaaaaaagagctgctgttcctaagtaacgcgaacccctcgctgctggagcggca

SEQ ID NO: 2782 - DNA, 201 bp, Homo sapiens; identical to SEQ ID NO: 2769

SEQ ID NO: 2783 - DNA, 115 bp, Homo sapiens; identical to SEQ ID NO: 2770

SEQ ID NO: 2784 - DNA, 201 bp, Homo sapiens
tgggtccaccgcggatccctcccgcttgtcaggaggcggccagcggtctcaggacgggcgctttggagccggccccaggcagcgtgtgtcggtcgcctagkctggagaactagtcctcgactcacgagatgaagttttaccatgttggccaggctggtctcgaattcctgacctcaagtgatctgcccaccttgacctccc

SEQ ID NO: 2785 - DNA, 109 bp, Homo sapiens; identical to SEQ ID NO: 2772

SEQ ID NO: 2786 - DNA, 201 bp, Homo sapiens; identical to SEQ ID NO: 2773

SEQ ID NO: 2787 - DNA, 201 bp, Homo sapiens; identical to SEQ ID NO: 2761

SEQ ID NO: 2788 - DNA, 201 bp, Homo sapiens; identical to SEQ ID NO: 2775

SEQ ID NO: 2789 - DNA, 201 bp, Homo sapiens; identical to SEQ ID NO: 2776

SEQ ID NO: 2790 - DNA, 201 bp, Homo sapiens; identical to SEQ ID NO: 2764

SEQ ID NO: 2791 - DNA, 163 bp, Homo sapiens; identical to SEQ ID NO: 2765

SEQ ID NO: 2792 - DNA, 201 bp, Homo sapiens; identical to SEQ ID NO: 2766

SEQ ID NO: 2793 - DNA, 201 bp, Homo sapiens; identical to SEQ ID NO: 2767

SEQ ID NO: 2794 - DNA, 201 bp, Homo sapiens; identical to SEQ ID NO: 2781

SEQ ID NO: 2795 - DNA, 201 bp, Homo sapiens; identical to SEQ ID NO: 2769

SEQ ID NO: 2796 - DNA, 115 bp, Homo sapiens; identical to SEQ ID NO: 2770

SEQ ID NO: 2797 - DNA, 201 bp, Homo sapiens
tgggtccaccgcggatccctcccgcttgtcaggaggcggccagcggtctcaggacgggcgctttggagccggccccaggcagcgtgtgtcggtcgcctagkctggagaactagtcctcgactcacgtgcaaggatgatgctgaaaggaataacaaggcttatctctaggatccataagttggaccctgggcgttttttaca

SEQ ID NO: 2798 - DNA, 109 bp, Homo sapiens; identical to SEQ ID NO: 2772

SEQ ID NO: 2799 - DNA, 201 bp, Homo sapiens; identical to SEQ ID NO: 2773

SEQ ID NO: 2800 - DNA, 201 bp, Homo sapiens
ttttcttaataacaaaggtcccttttcttggaaggcttgtactatggccatgacagtgacattgccctcaccatgatccctctccaaagtggttgtctttytttaccttgtgtcttctcttgtaaaaatgaaactcaaaaataaaataaatgtgtcaaattttgaaaaaaaaagaaaactgaaaaagctaacatgaattgt

SEQ ID NO: 2801 - DNA, 201 bp, Homo sapiens
cggtggtggccggcctcatcggggcctctgtgctggtggtgtgtgtctcggtgaccgtctttgtctggtcatgctgccaccagcaggcagagaagaagcasaagaacccaccatacaagtttattcacatgctcaaaggcatcagcatatacccagagaccctcagcaacaagaagaaaatcatcaaagtgcggagagaca

SEQ ID NO: 2802 - DNA, 201 bp, Homo sapiens
gaccgtcgcaggaggcgtccgctggataccttcccccttccctgacctagagctctacagctgctgcctcggtactgaccgagggttcccagagctgtctyaccattgcaaaaacgttatagcaacagcctctgattacgacatggctgagatcaccaatatccgacctagctttgatgtgtcaccggtggtggccggcct

SEQ ID NO: 2803 - DNA, 201 bp, Homo sapiens
catcatctccagaggaggatgtcatgctaggatccctcaccttctcagtggactataacttcccgaaaaaagccctggtggtgacaatccaggaggcccaygggctgccagtgatggatgaccagacccagggatctgacccctacatcaaaatgaccatccttcctgacaaacggcatcgggtgaagaccagagtgctgc

SEQ ID NO: 2804 - DNA, 157 bp, Homo sapiens
ggcggagcctacctctcatcaggaccagtctgactgcacctgcatccttagctcagmgcatccccggagcatcttaagagctgagcgcagctgacaactaggggccggaccgtcgcaggaggcgtccgctggataccttcccccttccctgacctag

SEQ ID NO: 2805 - DNA, 164 bp, Homo sapiens
aaattttgaaaaaaaaagaaaactgaaaaagctaacatgaattgtgtgaaattgcataatgctgtaatgctaatctacaatatgtaatgctatcttgtatsttgaatttgttaatgcaccacacaagtgcaaaataaagactgattcacattacataggcacag

SEQ ID NO: 2806 - DNA, 147 bp, Homo sapiens
gaaaactgaaaaagctaacatgaattgtgtgaaattgcataatgctgtaatgctaatctacaatatgtaatgctatcttgtatgttgaatttgttaatgcmccacacaagtgcaaaataaagactgattcacattacataggcacag

SEQ ID NO: 2807 - DNA, 201 bp, Homo sapiens
taagagctgagcgcagctgacaactaggggccggaccgtcgcaggaggcgtccgctggataccttcccccttccctgacctagagctctacagctgctgcstcggtactgaccgagggttcccagagctgtctcaccattgcaaaaacgttatagcaacagcctctgattacgacatggctgagatcaccaatatccgacc

SEQ ID NO: 2808 - DNA, 201 bp, Homo sapiens
acttgcatgtctaatacaaactgaagaaattagcctaactgccaatatcaagttgcagattttaatccatggaaattgtgttttgtgctgaattgtatttkctgattacctgaaattggcttctttttattgggcttctctggagaatttctcccactccccacctctgcagaagaaaattttgctcttataaaacctcat

SEQ ID NO: 2809 - DNA, 201 bp, Homo sapiens
gagagggaataacgcaggtcccttttcttggaaggcttgtactatggccatgacagtgacattgccctcaccatgatccctctccaaagtggttgtctttytttaccttgtgtcttctcttgtaaaaatgaaactcaaaaataaaataaatgtgtcaaattttgaaaaaaaaagaaaactgaaaaagctaacatgaattgt

SEQ ID NO: 2810 - DNA, 201 bp, Homo sapiens; identical to SEQ ID NO: 2802

SEQ ID NO: 2811 - DNA, 201 bp, Homo sapiens; identical to SEQ ID NO: 2803

SEQ ID NO: 2812 - DNA, 157 bp, Homo sapiens; identical to SEQ ID NO: 2804

SEQ ID NO: 2813 - DNA, 201 bp, Homo sapiens
ttggcttctttttattgggcttctctggagaatttctcccactccccacctctgcagaagaaaattttgctcttataaaacctcatgttttcatcattccyatcttttctttttattgcctcttatatctctgctctttgacctcaaggtctagaggtctgcagtaagccaagaaacaaaggtggggtggatgaggcaagg

SEQ ID NO: 2814 - DNA, 161 bp, Homo sapiens
aaattttgaaaaaaaaagaaaactgaaaaagctaacatgaattgtgtgaaattgcataatgctgtaatgctaatctacaatatgtaatgctatcttgtatsttgaatttgttaatgcaccacacaagtgcaaaataaagactgattcacattacataggca

SEQ ID NO: 2815 - DNA, 201 bp, Homo sapiens; identical to SEQ ID NO: 2807

SEQ ID NO: 2816 - DNA, 201 bp, Homo sapiens; identical to SEQ ID NO: 2801

SEQ ID NO: 2817 - DNA, 144 bp, Homo sapiens
gaaaactgaaaaagctaacatgaattgtgtgaaattgcataatgctgtaatgctaatctacaatatgtaatgctatcttgtatgttgaatttgttaatgcmccacacaagtgcaaaataaagactgattcacattacataggca

SEQ ID NO: 2818 - DNA, 201 bp, Homo sapiens
caagacaacattgtaagagagatgagcacttctaagttgagtatattataatagattagtactggattattcaggctttaggcatatgcttctttaaaaamgctataaattatattcctcttgcatttcacttgagtggaggtttatagttaatctataactacatattgaatagggctaggaatatagattaaatcatac

SEQ ID NO: 2819 - DNA, 193 bp, Homo sapiens
tggggtctgggtgggggcaaagagacccagtcaattacatgtttggtaccaagaaaggaacctgtcagggcagtacaatgtgactttgaaaatatataccstgggggtagttttaccctatatctataaacactgtttgttccagaatctgtatgattctatggagctattttaaaccaattgcaggtctaga

SEQ ID NO: 2820 - DNA, 201 bp, Homo sapiens
ggctttcccacctgagaaatatgcccaatggtcagctgggattgccttaatgaaaaatatccttggttttattatccctttaatattcatagcaacatgcyattttggaattagaaaacacttactgaagacgaatagctatgggaagaacaggataacccgtgaccaagtcctgaagatggcagctgctgttgttctggc

SEQ ID NO: 2821 - DNA, 201 bp, Homo sapiens
gaaaacacttactgaagacgaatagctatgggaagaacaggataacccgtgaccaagtcctgaagatggcagctgctgttgttctggccttcatcatttgstggcttcccttccatgttctgaccttcctggatgctctggcctggatgggtgtcattaatagctgcgaagttatagcagtcattgacctggcacttcctt

SEQ ID NO: 2822 - DNA, 201 bp, Homo sapiens
ttactgaagacgaatagctatgggaagaacaggataacccgtgaccaagtcctgaagatggcagctgctgttgttctggccttcatcatttgctggcttcycttccatgttctgaccttcctggatgctctggcctggatgggtgtcattaatagctgcgaagttatagcagtcattgacctggcacttccttttgccatc

SEQ ID NO: 2823 - DNA, 201 bp, Homo sapiens
accaaaggcataagaactaggagctgctgacatttcaatatgaagggcaactccacccttgccactactagcaaaaacattaccagcggtcttcacttcgkgcttgtgaacatctctggcaacaatgagtctaccttgaactgttcacagaaaccatcagataagcatttagatgcaattcctattctttactacattata

SEQ ID NO: 2824 - DNA, 201 bp, Homo sapiens
catcctcttgggattcaccaacagctgcgttaatccgtttctgtattgttttgttggaaaccggttccaacagaagctccgcagtgtgtttagggttccarttacttggctccaagggaaaagagagagtatgtcttgccggaaaagcagttctcttagagaaatggagacctttgtgtcttaaacgtgagagcaaaatgc

SEQ ID NO: 2825 - DNA, 201 bp, Homo sapiens
tttttatcacctgcatgagtgttgataggtaccaatctgtcatctacccctttctgtctcaaagaagaaatccctggcaagcatcttatatagttcccctygtttggtgtatggcctgtttgtcctcattgccaacattttattttcgagacgtcagaaccattgaatacttaggagtgaatgcttgcattatggctttcc

SEQ ID NO: 2826 - DNA, 201 bp, Homo sapiens
gaagttatagcagtcattgacctggcacttccttttgccatcctcttgggattcaccaacagctgcgttaatccgtttctgtattgttttgttggaaaccrgttccaacagaagctccgcagtgtgtttagggttccaattacttggctccaagggaaaagagagagtatgtcttgccggaaaagcagttctcttagagaa

SEQ ID NO: 2827 - DNA, 201 bp, Homo sapiens
aaaaatatccttggttttattatccctttaatattcatagcaacatgctattttggaattagaaaacacttactgaagacgaatagctatgggaagaacargataacccgtgaccaagtcctgaagatggcagctgctgttgttctggccttcatcatttgctggcttcccttccatgttctgaccttcctggatgctctg

SEQ ID NO: 2828 - DNA, 201 bp, Homo sapiens
tagcaacatgctattttggaattagaaaacacttactgaagacgaatagctatgggaagaacaggataacccgtgaccaagtcctgaagatggcagctgcygttgttctggccttcatcatttgctggcttcccttccatgttctgaccttcctggatgctctggcctggatgggtgtcattaatagctgcgaagttatag

SEQ ID NO: 2829 - DNA, 201 bp, Homo sapiens
ttctgaatcttctgaaaccaaatgtaactatgttttatcgtccagtgactttcaggaattgcccattgtttttctgatatgtttgtacaagattgtcattrgtgagacatatttacaacctagaagtaactggtgatatatctcaaattgtaattaataatagattgtgaataatgatttggggattcagatttctctttg

SEQ ID NO: 2830 - DNA, 201 bp, Homo sapiens
aatcttttctgaatcttctgaaaccaaatgtaactatgttttatcgtccagtgactttcaggaattgcccattgtttttctgatatgtttgtacaagattktcattagtgagacatatttacaacctagaagtaactggtgatatatctcaaattgtaattaataatagattgtgaataatgatttggggattcagatttc

SEQ ID NO: 2831 - DNA, 201 bp, Homo sapiens
aactccaaacagacaaaattgcttacccagtacatattaaatctcggcaagtatgatcaaaactacgacatcagagaccgtacaagatttattaggcagcktattgttccgaatgaaaagagtggagctttaagtaaatatgccaaaaaaatattcctagcacaaaagcctgcaccactgcttgagtctccttttaaagat

SEQ ID NO: 2832 - DNA, 201 bp, Homo sapiens
ctagagcaagtattctttggctaattggagaaaactgtgaacgagttcctaaaattgcccctgatgttttgaggaagatggctaaaagcttcactagtgargatgatctggtaaaactgcagatattaaatctgggagcaaaattgtatttaaccaactccaaacagacaaaattgcttacccagtacatattaaatctcg

SEQ ID NO: 2833 - DNA, 201 bp, Homo sapiens
catctggcagtgggggtagaatacactcttgacattcttgtctcctgctttagaatgctagtgtgtatctatcatgtatgcaatactttccccctttttgytttgctaaccaaagagcatatattttactgtcagttgtctcaactcttgaatccatgtggcgttttctctgtcctgctgcttcttttggcctcctcgttt

SEQ ID NO: 2834 - DNA, 201 bp, Homo sapiens
ggccagaggtggcgcccgacccatcagttcgaaatgtagaagtaatagagttggcaaaagaatggaccccagcaggaaaagcaaagcaagagaattctgcyaagaagttttattctgaatctgaggaagaggaggactcttctgatagtagcagtgacagtgagagtgaatctggaagtgaaagtggagaacaaggcgaaa

SEQ ID NO: 2835 - DNA, 201 bp, Homo sapiens
tgaaagataaaagcacattggtagctggcagtgttgtgatggcttttgaagaagtatgcccggacagaatagatctgattcataaaaattaccgcaagctrtgtaacttactagtggatgttgaagagtgggggcaggttgtcataatccacatgctaactcgatatgctcggacacagtttgtcagcccttggaaagagg

SEQ ID NO: 2836 - DNA, 201 bp, Homo sapiens
aagatgatctggtaaaactgcagatattaaatctgggagcaaaattgtatttaaccaactccaaacagacaaaattgcttacccagtacatattaaatctyggcaagtatgatcaaaactacgacatcagagaccgtacaagatttattaggcagcttattgttccgaatgaaaagagtggagctttaagtaaatatgcca

SEQ ID NO: 2837 - DNA, 201 bp, Homo sapiens
ctgcggtggttatggcagttgctcagctgtattggcacatatcaccaaaatctgaagctggcataatttctaaatcactagtgcgtttacttcgtagcaayagggaggtgcagtatattgtcctacaaaatatagcaactatgtcaattcaacttgaaattttgacaaacttggcaaatgaagccaacatatcaactcttc

SEQ ID NO: 2838 - DNA, 201 bp, Homo sapiens
aggaactcaaaagccaaaggaaaaagtgattctgaagatggggagaaggaaaatgaaaaatctaaaacttcagattcttcaaatgacgaatctagttcaawagaagacagttcttccgattctgaatcagagtcagaacctgaaagtgaatctgaatccagaagagtcactaaggagaaagaaaagaaaacaaagcaagat

SEQ ID NO: 2839 - DNA, 201 bp, Homo sapiens
gtgaggactcctccagtgagcaggacagtgagagtggacgggagtcaggcctagaaaacaaaagaacagccaagaggaactcaaaagccaaaggaaaaagygattctgaagatggggagaaggaaaatgaaaaatctaaaacttcagattcttcaaatgacgaatctagttcaatagaagacagttcttccgattctgaat

SEQ ID NO: 2840 - DNA, 201 bp, Homo sapiens
aaattgcttacccagtacatattaaatctcggcaagtatgatcaaaactacgacatcagagaccgtacaagatttattaggcagcttattgttccgaatgwaaagagtggagctttaagtaaatatgccaaaaaaatattcctagcacaaaagcctgcaccactgcttgagtctccttttaaagatagagatcatttccag

SEQ ID NO: 2841 - DNA, 201 bp, Homo sapiens
gcatgaaaatgcatgtttttaatccaatagactctcttgagcctgagggatccattacagtttcaatgggtattgacttttgtgattctactcagactgcyagtttccagttgtgtaccaaggatgattgcttcaatgttaatattcagccacctgttggagaactgcttttacctgtggccatgtcagagaaagatttta

SEQ ID NO: 2842 - DNA, 201 bp, Homo sapiens
ggtagacatgaatgagatatttaaagttcattggaaatcttcttccctacagcagtaagcaaaaattagcaaagagatagtctaaatggcctctcagcttkgtatgtgaaaatgagatcacatactttttaaatccaaatacaaaagcatagtctctgcaagattttgttctttgaatttcttgatattgtaattgattat

SEQ ID NO: 2843 - DNA, 201 bp, Homo sapiens
cttctggccaggataatatacacaggtttgcagctaaaactgtgcacagtgggtcattgatgctagtcacagtggaactgaaggaaggctctacagcccarcttatcataaacactgagaaaactgtgattggctctgttctgctgcgggaactgaagcctgtcctgtctcaggggtaacctgcttacatctggactttag

SEQ ID NO: 2844 - DNA, 201 bp, Homo sapiens
aaaactgtgattggctctgttctgctgcgggaactgaagcctgtcctgtctcaggggtaacctgcttacatctggactttagaatctggcacacaacaaargtgcctggcatccactactgctgcctttcatttataataatagcccttccatctggcagtgggggtagaatacactcttgacattcttgtctcctgcttt

SEQ ID NO: 2845 - DNA, 201 bp, Homo sapiens
ctgctaagaagttttattctgaatctgaggaagaggaggactcttctgatagtagcagtgacagtgagagtgaatctggaagtgaaagtggagaacaaggygaaagtggggaggaaggagacagcaatgaggacagcagtgaggactcctccagtgagcaggacagtgagagtggacgggagtcaggcctagaaaacaaaa

SEQ ID NO: 2846 - DNA, 201 bp, Homo sapiens
acatggtgaaattattaaacatatggccaaactcctggacagtatcactgttcctgttgctagagcaagtattctttggctaattggagaaaactgtgaaygagttcctaaaattgcccctgatgttttgaggaagatggctaaaagcttcactagtgaagatgatctggtaaaactgcagatattaaatctgggagcaaa

SEQ ID NO: 2847 - DNA, 201 bp, Homo sapiens
tttcctgctgttgtgaagaatgtggccagtaaaaatattgagatcaagaagttggtatatgtttacctggttcgatatgctgaagaacagcaggatcttgyactcctgtccataagcacttttcagcgagctctgaaggacccaaaccaactaattcgtgcaagcgctttgagagttctgtcaagtattagagtgccaatt

SEQ ID NO: 2848 - DNA, 201 bp, Homo sapiens
ttcctgctgttgtgaagaatgtggccagtaaaaatattgagatcaagaagttggtatatgtttacctggttcgatatgctgaagaacagcaggatcttgcmctcctgtccataagcacttttcagcgagctctgaaggacccaaaccaactaattcgtgcaagcgctttgagagttctgtcaagtattagagtgccaatta

SEQ ID NO: 2849 - DNA, 201 bp, Homo sapiens; identical to SEQ ID NO: 2831

SEQ ID NO: 2850 - DNA, 201 bp, Homo sapiens; identical to SEQ ID NO: 2832

SEQ ID NO: 2851 - DNA, 201 bp, Homo sapiens; identical to SEQ ID NO: 2833

SEQ ID NO: 2852 - DNA, 201 bp, Homo sapiens; identical to SEQ ID NO: 2835

SEQ ID NO: 2853 - DNA, 201 bp, Homo sapiens; identical to SEQ ID NO: 2834

SEQ ID NO: 2854 - DNA, 201 bp, Homo sapiens; identical to SEQ ID NO: 2836

SEQ ID NO: 2855 - DNA, 201 bp, Homo sapiens
ctgcggtggttatggcagttgctcagctgtattggcacatatcaccaaaatctgaagctggcataatttctaaatcactagtgcgtttacttcgtagcaayagggaggtgcagtatattgtcctacaaaatatagcaactatgtcaattcaaagagcttgaaattttgacaaacttggcaaatgaagccaacatatcaact

SEQ ID NO: 2856 - DNA, 201 bp, Homo sapiens; identical to SEQ ID NO: 2838

SEQ ID NO: 2857 - DNA, 201 bp, Homo sapiens; identical to SEQ ID NO: 2839

SEQ ID NO: 2858 - DNA, 201 bp, Homo sapiens; identical to SEQ ID NO: 2840

SEQ ID NO: 2859 - DNA, 201 bp, Homo sapiens; identical to SEQ ID NO: 2841

SEQ ID NO: 2860 - DNA, 201 bp, Homo sapiens; identical to SEQ ID NO: 2842

SEQ ID NO: 2861 - DNA, 201 bp, Homo sapiens; identical to SEQ ID NO: 2843

SEQ ID NO: 2862 - DNA, 201 bp, Homo sapiens; identical to SEQ ID NO: 2844

SEQ ID NO: 2863 - DNA, 201 bp, Homo sapiens; identical to SEQ ID NO: 2845

SEQ ID NO: 2864 - DNA, 201 bp, Homo sapiens; identical to SEQ ID NO: 2846

SEQ ID NO: 2865 - DNA, 201 bp, Homo sapiens; identical to SEQ ID NO: 2847

SEQ ID NO: 2866 - DNA, 201 bp, Homo sapiens; identical to SEQ ID NO: 2848

SEQ ID NO: 2867 - DNA, 201 bp, Homo sapiens
tctcccaaaaaaatacaaaaattagctgggcgtgctggtgtgcctgtattcccagctacttgggaggctgaggtgggaggattgcttcagctggggaggcrgaggctgcagggagccaagactgagccattgcacccagcctgggtgacagagcaagaccctgtctctaaaaatgaatgaaaggaaggaagaaagagagag

SEQ ID NO: 2868 - DNA, 201 bp, Homo sapiens
ttgaatgaaacaatcgctgggaaagcattaagagaattaaggctgggcactgtggctcatgcctgtaatcccagcactttgtgaggctgaggcaggcagayaacttgagcccaggagtttgagaccagcctgggcaacatggcaaaaccctgctctcccaaaaaaatacaaaaattagctgggcgtgctggtgtgcctgta

SEQ ID NO: 2869 - DNA, 201 bp, Homo sapiens
gacctgcagccttgggtcgaccctgccctaggggtgactgcaggagagcagggaggatggtcaggcgtcaccaacaaccccatcacccagtaacaagaacyttgactctctcagtccctctgcatcaagacacttacccatttcccacctcatgcctgctaacttgaatgaaacaatcgctgggaaagcattaagagaatt

SEQ ID NO: 2870 - DNA, 201 bp, Homo sapiens
cgcctgtcttccagaacgattccttcaccagccctctttccattgctctaggatgcagatgtctccagccctcacctgcctagtcctgggcctggcccttrtctttggtgaagggtctgctgtgcaccatcccccatcctacgtggcccacctggcctcagacttcggggtgagggtgtttcagcaggtggcgcaggcctc

SEQ ID NO: 2871 - DNA, 201 bp, Homo sapiens
cggatcatgaggtcaggagatcaagaccatcctggctaacacagtgaaactccatctctactaaaaatacaaaaaaaattagccaggcgtggtggcaggcrcctgtagtcccagctactcgggaggctgaggcaggagaatggcatgaacccaggaggcagagcttgcagtgagctgagatcgtgccactgcactccagcc

SEQ ID NO: 2872 - DNA, 201 bp, Homo sapiens
cgggcggatcatgaggtcaggagatcaagaccatcctggctaacacagtgaaactccatctctactaaaaatacaaaaaaaattagccaggcgtggtggcrggcgcctgtagtcccagctactcgggaggctgaggcaggagaatggcatgaacccaggaggcagagcttgcagtgagctgagatcgtgccactgcactcc

SEQ ID NO: 2873 - DNA, 201 bp, Homo sapiens
ccctcccgcctgtcttccagaacgattccttcaccagccctctttccattgctctaggatgcagatgtctccagccctcacctgcctagtcctgggcctgrcccttgtctttggtgaagggtctgctgtgcaccatcccccatcctacgtggcccacctggcctcagacttcggggtgagggtgtttcagcaggtggcgca

SEQ ID NO: 2874 - DNA, 201 bp, Homo sapiens
ttcatgagccgggcgcggtggctcaaacgcctgtaatcccagcactttgggaggccaaggcgggcggatcatgaggtcaggagatcaagaccatcctggcyaacacagtgaaactccatctctactaaaaatacaaaaaaaattagccaggcgtggtggcaggcgcctgtagtcccagctactcgggaggctgaggcagga

SEQ ID NO: 2875 - DNA, 201 bp, Homo sapiens
gccaaggaaaggctggctctggcttagccgagccaagccccatacagctgtgctgcaggggccaccccatcttcttcccactacactccaagtcactggayccttgaatctccaagggtgtctgaccagtagatttaccgcttattcaccaccgtgtgatcttaacctcgttaagtttgcccatctacaaaatgaggatta

SEQ ID NO: 2876 - DNA, 201 bp, Homo sapiens
gctgtcctaaagaattcatgagccgggcgcggtggctcaaacgcctgtaatcccagcactttgggaggccaaggcgggcggatcatgaggtcaggagatcragaccatcctggctaacacagtgaaactccatctctactaaaaatacaaaaaaaattagccaggcgtggtggcaggcgcctgtagtcccagctactcggg

SEQ ID NO: 2877 - DNA, 201 bp, Homo sapiens
tgctgtcctaaagaattcatgagccgggcgcggtggctcaaacgcctgtaatcccagcactttgggaggccaaggcgggcggatcatgaggtcaggagatyaagaccatcctggctaacacagtgaaactccatctctactaaaaatacaaaaaaaattagccaggcgtggtggcaggcgcctgtagtcccagctactcgg

SEQ ID NO: 2878 - DNA, 201 bp, Homo sapiens
gaatgaaacaatcgctgggaaagcattaagagaattaaggctgggcactgtggctcatgcctgtaatcccagcactttgtgaggctgaggcaggcagatawcttgagcccaggagtttgagaccagcctgggcaacatggcaaaaccctgctctcccaaaaaaatacaaaaattagctgggcgtgctggtgtgcctgtatt

SEQ ID NO: 2879 - DNA, 201 bp, Homo sapiens
gcccatctacaaaatgaggattatttgctgtcctaaagaattcatgagccgggcgcggtggctcaaacgcctgtaatcccagcactttgggaggccaaggmgggcggatcatgaggtcaggagatcaagaccatcctggctaacacagtgaaactccatctctactaaaaatacaaaaaaaattagccaggcgtggtggca

SEQ ID NO: 2880 - DNA, 201 bp, Homo sapiens
gtttgcccatctacaaaatgaggattatttgctgtcctaaagaattcatgagccgggcgcggtggctcaaacgcctgtaatcccagcactttgggaggccvaggcgggcggatcatgaggtcaggagatcaagaccatcctggctaacacagtgaaactccatctctactaaaaatacaaaaaaaattagccaggcgtggt

SEQ ID NO: 2881 - DNA, 169 bp, Homo sapiens
ctctactaaaaatacaaaaaaaattagccaggcgtggtggcaggcgcctgtagtcccagctactcgggaggctgaggcaggagaatggcatgaacccaggmggcagagcttgcagtgagctgagatcgtgccactgcactccagcctgggcgacagagagagactccgt

SEQ ID NO: 2882 - DNA, 201 bp, Homo sapiens
ccccctccagcagctgaattcctgcagctcagcagccgccgccagagcaggacgaaccgccaatcgcaaggcacctctgagaacttcaggtaggagaaaakcaaactccctccaacctcttacttcgggcttaaggcagagaactcgcctccccagaatctcctccctccatgatcccccgctattcctctattttctttt

SEQ ID NO: 2883 - DNA, 201 bp, Homo sapiens
tcttcccactacactccaagtcactggacccttgaatctccaagggtgtctgaccagtagatttaccgcttattcaccaccgtgtgatcttaacctcgttwagtttgcccatctacaaaatgaggattatttgctgtcctaaagaattcatgagccgggcgcggtggctcaaacgcctgtaatcccagcactttgggaggc

SEQ ID NO: 2884 - DNA, 176 bp, Homo sapiens
gcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggtaggagaaaagcaaactccctccaacctctta

SEQ ID NO: 2885 - DNA, 201 bp, Homo sapiens
caccagccctctttccattgctctaggatgcagatgtctccagccctcacctgcctagtcctgggcctggcccttgtctttggtgaagggtctgctgtgcmccatcccccatcctacgtggcccacctggcctcagacttcggggtgagggtgtttcagcaggtggcgcaggcctccaaggaccgcaacgtggttttctca

SEQ ID NO: 2886 - DNA, 201 bp, Homo sapiens
cccatacagctgtgctgcaggggccaccccatcttcttcccactacactccaagtcactggacccttgaatctccaagggtgtctgaccagtagatttacygcttattcaccaccgtgtgatcttaacctcgttaagtttgcccatctacaaaatgaggattatttgctgtcctaaagaattcatgagccgggcgcggtgg

SEQ ID NO: 2887 - DNA, 201 bp, Homo sapiens
catggtctcttcctgcaccttgccctagtgttcacttaccacctgcttgcaggaaacaagaagagcagggcccacagctggccagctcccctcccctcccrcctgtcttccagaacgattccttcaccagccctctttccattgctctaggatgcagatgtctccagccctcacctgcctagtcctgggcctggcccttgt

SEQ ID NO: 2888 - DNA, 201 bp, Homo sapiens
gaacttcaggtaggagaaaagcaaactccctccaacctcttacttcgggcttaaggcagagaactcgcctccccagaatctcctccctccatgatcccccrctattcctctattttcttttcctcggacctgcagccttgggtcgaccctgccctaggggtgactgcaggagagcagggaggatggtcaggcgtcaccaac

SEQ ID NO: 2889 - DNA, 201 bp, Homo sapiens
gggaagggagatggactggattccaagattcccacagggcaagatgggcgaagactccctgccactgcccggggataagtcagtctgagtgagacggagtrggatgggcttagaacctgaacatgtcatggtctcttcctgcaccttgccctagtgttcacttaccacctgcttgcaggaaacaagaagagcagggcccac

SEQ ID NO: 2890 - DNA, 201 bp, Homo sapiens
aagagagagaaagagagagaggaaagaaggaaggaagtaaagaagaaagaaagaaagaaagaggaaagaggaagaaagaaagaaaagaaagaaaagaaaakaaagcaaatttaaagcttatgcaaatcaaagatgttgtgataattgataattgagtctgggctaaattccccctgggctgcaaaggcagagagtggtaat

SEQ ID NO: 2891 - DNA, 201 bp, Homo sapiens
gggaggattgcttcagctggggaggcggaggctgcagggagccaagactgagccattgcacccagcctgggtgacagagcaagaccctgtctctaaaaatraatgaaaggaaggaagaaagagagagaaagagagagaggaaagaaggaaggaagtaaagaagaaagaaagaaagaaagaggaaagaggaagaaagaaaga

SEQ ID NO: 2892 - DNA, 201 bp, Homo sapiens
ccaactctcctggcctggccatctccctccccagaaacagtgtgcatgggttattttggagtgtaggtgacttgtttactcattgaagcagatttctgctyccttttatttttataggaatagaggaagaaatgtcagatgcgtgcccagctcttcaccccccaatctcttggtggggaggggtgtacctaaatatttatc

SEQ ID NO: 2893 - DNA, 201 bp, Homo sapiens
gtggcccaactctcctggcctggccatctccctccccagaaacagtgtgcatgggttattttggagtgtaggtgacttgtttactcattgaagcagatttytgcttccttttatttttataggaatagaggaagaaatgtcagatgcgtgcccagctcttcaccccccaatctcttggtggggaggggtgtacctaaatat

SEQ ID NO: 2894 - DNA, 201 bp, Homo sapiens
agcagattcaagcagctatgggattcaagattgatgacaagggcatggcccccgccctccggcatctgtacaaggagctcatggggccatggaacaaggaygagatcagcaccacagacgcgatcttcgtccagcgggatctgaagctggtccagggcttcatgccccacttcttcaggctgttccggagcacggtcaagc

SEQ ID NO: 2895 - DNA, 201 bp, Homo sapiens
gattcaagattgatgacaagggcatggcccccgccctccggcatctgtacaaggagctcatggggccatggaacaaggatgagatcagcaccacagacgcratcttcgtccagcgggatctgaagctggtccagggcttcatgccccacttcttcaggctgttccggagcacggtcaagcaagtggacttttcagaggtgg

SEQ ID NO: 2896 - DNA, 201 bp, Homo sapiens
tatccttgcccttgagtgcttgttagagagaaagagaactactaaggaaaataatattatttaaactcgctcctagtgtttctttgtggtctgtgtcaccrtatctcaggaagtccagccacttgactggcacacacccctccggacatccagcgtgacggagcccacactgccaccttgtggccgcctgagaccctcgcg

SEQ ID NO: 2897 - DNA, 201 bp, Homo sapiens
ccgccagagcaggacgaaccgccaatcgcaaggcacctctgagaacttcaggatgcagatgtctccagccctcacctgcctagtcctgggcctggcccttrtctttggtgaagggtctgctgtgcaccatcccccatcctacgtggcccacctggcctcagacttcggggtgagggtgtttcagcaggtggcgcaggcctc

SEQ ID NO: 2898 - DNA, 201 bp, Homo sapiens
tcctggcctggccatctccctccccagaaacagtgtgcatgggttattttggagtgtaggtgacttgtttactcattgaagcagatttctgcttccttttwtttttataggaatagaggaagaaatgtcagatgcgtgcccagctcttcaccccccaatctcttggtggggaggggtgtacctaaatatttatcatatcct

SEQ ID NO: 2899 - DNA, 143 bp, Homo sapiens
cagagagggaggtgtcgagggggacccgctggctgttcagacrgactcccagagccagtgagtgggtggggctggaacatgagttcatctatttcctgcccacatctggtataaaaggaggcagtggcccacagaggagcaca

SEQ ID NO: 2900 - DNA, 201 bp, Homo sapiens
cagccgccgccagagcaggacgaaccgccaatcgcaaggcacctctgagaacttcaggatgcagatgtctccagccctcacctgcctagtcctgggcctgrcccttgtctttggtgaagggtctgctgtgcaccatcccccatcctacgtggcccacctggcctcagacttcggggtgagggtgtttcagcaggtggcgca

SEQ ID NO: 2901 - DNA, 201 bp, Homo sapiens
gcccagctcttcaccccccaatctcttggtggggaggggtgtacctaaatatttatcatatccttgcccttgagtgcttgttagagagaaagagaactacyaaggaaaataatattatttaaactcgctcctagtgtttctttgtggtctgtgtcaccgtatctcaggaagtccagccacttgactggcacacacccctcc

SEQ ID NO: 2902 - DNA, 201 bp, Homo sapiens
tgacacggctggtgctggtgaatgccctctacttcaacggccagtggaagactcccttccccgactccagcacccaccgccgcctcttccacaaatcagayggcagcactgtctctgtgcccatgatggctcagaccaacaagttcaactatactgagttcaccacgcccgatggccattactacgacatcctggaactgc

SEQ ID NO: 2903 - DNA, 201 bp, Homo sapiens
cgtgcccagctcttcaccccccaatctcttggtggggaggggtgtacctaaatatttatcatatccttgcccttgagtgcttgttagagagaaagagaacyactaaggaaaataatattatttaaactcgctcctagtgtttctttgtggtctgtgtcaccgtatctcaggaagtccagccacttgactggcacacacccc

SEQ ID NO: 2904 - DNA, 201 bp, Homo sapiens
acctgagaccctgggagagaagtttgaagcacaactcccttaaggtctccaaaccagacggtgacgcctgcgggaccatctggggcacctgcttccacccrtctctctgcccactcgggtctgcagacctggttcccactgaggccctttgcaggacggaactacggggcttacaggagcttttgtgtgcctggtagaaac

SEQ ID NO: 2905 - DNA, 201 bp, Homo sapiens
gggaaaggagccgtggaccagctgacacggctggtgctggtgaatgccctctacttcaacggccagtggaagactcccttccccgactccagcacccaccrccgcctcttccacaaatcagacggcagcactgtctctgtgcccatgatggctcagaccaacaagttcaactatactgagttcaccacgcccgatggccat

SEQ ID NO: 2906 - DNA, 201 bp, Homo sapiens
gaaaagaattttagtgttaatgactctttctgaaggaagagaagacatttgccttttgttaaaagatggtaaaccagatctgtctccaagaccttggcctytccttggaggacctttaggtcaaactccctagtctccacctgagaccctgggagagaagtttgaagcacaactcccttaaggtctccaaaccagacggtg

SEQ ID NO: 2907 - DNA, 201 bp, Homo sapiens
gacggtgacgcctgcgggaccatctggggcacctgcttccacccgtctctctgcccactcgggtctgcagacctggttcccactgaggccctttgcaggayggaactacggggcttacaggagcttttgtgtgcctggtagaaactatttctgttccagtcacattgccatcactcttgtactccctttcatctcagagtc

SEQ ID NO: 2908 - DNA, 201 bp, Homo sapiens
ctgggacaaaactggagatgcatcgggaaagaagaaactccgaagaaaagaattttagtgttaatgactctttctgaaggaagagaagacatttgcctttygttaaaagatggtaaaccagatctgtctccaagaccttggcctctccttggaggacctttaggtcaaactccctagtctccacctgagaccctgggagag

SEQ ID NO: 2909 - DNA, 201 bp, Homo sapiens
agaaacagtgtgcatgggttattttggagtgtaggtgacttgtttactcattgaagcagatttctgcttccttttatttttataggaatagaggaagaaakgtcagatgcgtgcccagctcttcaccccccaatctcttggtggggaggggtgtacctaaatatttatcatatccttgcccttgagtgcttgttagagaga

SEQ ID NO: 2910 - DNA, 195 bp, Homo sapiens
cacgtgaggggggggtgggtgagagagacaggcagctcggattcaactaccttagataatatttctgaaaacctaccagccagagggtagggcacaaagayggatgtaatgcactttgggaggccaaggcgggaggattgcttgagcccaggagttcaagaccagcctgggcaacataccaagacccccgtctct

SEQ ID NO: 2911 - DNA, 201 bp, Homo sapiens
aaaggaggcagtggcccacagaggagcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggatgcagatgtctccagccctcacctgcctagt

SEQ ID NO: 2912 - DNA, 201 bp, Homo sapiens
acaggaggagaaacccagcagcagattcaagcagctatgggattcaagattgatgacaagggcatggcccccgccctccggcatctgtacaaggagctcayggggccatggaacaaggatgagatcagcaccacagacgcgatcttcgtccagcgggatctgaagctggtccagggcttcatgccccacttcttcaggctg

SEQ ID NO: 2913 - DNA, 201 bp, Homo sapiens
tcgcaaggcacctctgagaacttcaggatgcagatgtctccagccctcacctgcctagtcctgggcctggcccttgtctttggtgaagggtctgctgtgcmccatcccccatcctacgtggcccacctggcctcagacttcggggtgagggtgtttcagcaggtggcgcaggcctccaaggaccgcaacgtggttttctca

SEQ ID NO: 2914 - DNA, 201 bp, Homo sapiens
ctggctgttcagacggactcccagagccagtgagtgggtggggctggaacatgagttcatctatttcctgcccacatctggtataaaaggaggcagtggcycacagaggagcacagctgtgtttggctgcagggccaagagcgctgtcaagaagacccacacgcccccctccagcagctgaattcctgcagctcagcagcc

SEQ ID NO: 2915 - DNA, 201 bp, Homo sapiens
ttggagtgtaggtgacttgtttactcattgaagcagatttctgcttccttttatttttataggaatagaggaagaaatgtcagatgcgtgcccagctcttmaccccccaatctcttggtggggaggggtgtacctaaatatttatcatatccttgcccttgagtgcttgttagagagaaagagaactactaaggaaaataa

SEQ ID NO: 2916 - DNA, 104 bp, Homo sapiens
gcacaaagatggatgtaatgcactttgggaggccaaggcgggaggattgcttgagcccaggagttcaagaccagcctgggcaacataccaagacccccgtytct

SEQ ID NO: 2917 - DNA, 201 bp, Homo sapiens
gtgcccatgatggctcagaccaacaagttcaactatactgagttcaccacgcccgatggccattactacgacatcctggaactgccctaccacggggacamcctcagcatgttcattgctgccccttatgaaaaagaggtgcctctctctgccctcaccaacattctgagtgcccagctcatcagccactggaaaggcaac

SEQ ID NO: 2918 - DNA, 201 bp, Homo sapiens
actcagatgaggacagagtggtttccaatgtgttcaatagatttaggagcagaaatgcaaggggctgcatgacctaccaggacagaactttccccaattayagggtgactcacagccgcattggtgactcacttcaatgtgtcatttccggctgctgtgtgtgagcagtggacacgtgaggggggggtgggtgagagagac

SEQ ID NO: 2919 - DNA, 201 bp, Homo sapiens
aggagcagaaatgcaaggggctgcatgacctaccaggacagaactttccccaattacagggtgactcacagccgcattggtgactcacttcaatgtgtcawttccggctgctgtgtgtgagcagtggacacgtgaggggggggtgggtgagagagacaggcagctcggattcaactaccttagataatatttctgaaaacc

SEQ ID NO: 2920 - DNA, 184 bp, Homo sapiens
ctttctttcttttttgattttgcactggacggtgacgtcagccatgtacaggatccacaggggtggtgtcaaatgctattgaaattgtgttgaattgtatrctttttcacttttgataaataaacatgtaaaaatgtttcaaaaaaataataaaataaataaatacgaagaatatgtcaggaca

SEQ ID NO: 2921 - DNA, 201 bp, Homo sapiens; identical to SEQ ID NO: 2892

SEQ ID NO: 2922 - DNA, 201 bp, Homo sapiens; identical to SEQ ID NO: 2893

SEQ ID NO: 2923 - DNA, 201 bp, Homo sapiens; identical to SEQ ID NO: 2894

SEQ ID NO: 2924 - DNA, 201 bp, Homo sapiens; identical to SEQ ID NO: 2895

SEQ ID NO: 2925 - DNA, 201 bp, Homo sapiens; identical to SEQ ID NO: 2896

SEQ ID NO: 2926 - DNA, 201 bp, Homo sapiens; identical to SEQ ID NO: 2897

SEQ ID NO: 2927 - DNA, 201 bp, Homo sapiens; identical to SEQ ID NO: 2898

SEQ ID NO: 2928 - DNA, 143 bp, Homo sapiens; identical to SEQ ID NO: 2899

SEQ ID NO: 2929 - DNA, 201 bp, Homo sapiens; identical to SEQ ID NO: 2900

SEQ ID NO: 2930 - DNA, 201 bp, Homo sapiens; identical to SEQ ID NO: 2901

SEQ ID NO: 2931 - DNA, 201 bp, Homo sapiens; identical to SEQ ID NO: 2902

SEQ ID NO: 2932 - DNA, 201 bp, Homo sapiens; identical to SEQ ID NO: 2903

SEQ ID NO: 2933 - DNA, 201 bp, Homo sapiens; identical to SEQ ID NO: 2904

SEQ ID NO: 2934 - DNA, 201 bp, Homo sapiens; identical to SEQ ID NO: 2905

SEQ ID NO: 2935 - DNA, 201 bp, Homo sapiens; identical to SEQ ID NO: 2906

SEQ ID NO: 2936 - DNA, 201 bp, Homo sapiens
gacggtgacgcctgcgggaccatctggggcacctgcttccacccgtctctctgcccactcgggtctgcagacctggttcccactgaggccctttgcaggayggaactacggggcttacaggagcttttgtgtgcctggtagaaactatttctgttccagtcacattgccatcactcttgtactgcctgccaccgcggagga

SEQ ID NO: 2937 - DNA, 201 bp, Homo sapiens; identical to SEQ ID NO: 2908

SEQ ID NO: 2938 - DNA, 201 bp, Homo sapiens; identical to SEQ ID NO: 2909

SEQ ID NO: 2939 - DNA, 201 bp, Homo sapiens
cacgtgaggggggggtgggtgagagagacaggcagctcggattcaactaccttagataatatttctgaaaacctaccagccagagggtagggcacaaagayggatgtaatgcactttgggaggccaaggcgggaggattgcttgagcccaggagttcaagaccagcctgggcaacataccaagacccccgtctctttaaaa

SEQ ID NO: 2940 - DNA, 201 bp, Homo sapiens; identical to SEQ ID NO: 2911

SEQ ID NO: 2941 - DNA, 201 bp, Homo sapiens; identical to SEQ ID NO: 2912

SEQ ID NO: 2942 - DNA, 201 bp, Homo sapiens; identical to SEQ ID NO: 2913

SEQ ID NO: 2943 - DNA, 201 bp, Homo sapiens; identical to SEQ ID NO: 2914

SEQ ID NO: 2944 - DNA, 201 bp, Homo sapiens; identical to SEQ ID NO: 2915

SEQ ID NO: 2945 - DNA, 201 bp, Homo sapiens
gcacaaagatggatgtaatgcactttgggaggccaaggcgggaggattgcttgagcccaggagttcaagaccagcctgggcaacataccaagacccccgtytctttaaaaatatatatattttaaatatacttaaatatatatttctaatatctttaaatatatatatatattttaaagaccaatttatgggagaattgca

SEQ ID NO: 2946 - DNA, 201 bp, Homo sapiens; identical to SEQ ID NO: 2917

SEQ ID NO: 2947 - DNA, 201 bp, Homo sapiens; identical to SEQ ID NO: 2918

SEQ ID NO: 2948 - DNA, 201 bp, Homo sapiens; identical to SEQ ID NO: 2919

SEQ ID NO: 2949 - DNA, 201 bp, Homo sapiens
atattcctaccgattttgagggctggttcttctgtaccgctttcagaaagtttatatgggttattcttcagcctctcttttatgcctttcgacctctgttyatcaaccccaaaccaattacgtatctggaagttatcaataccgtggcacaggtcacttttgacattttaatttattactttttgggaattaaatccttag

SEQ ID NO: 2950 - DNA, 201 bp, Homo sapiens
gttttgctttattaaaaagctaataaacagctattaatcacagtgtattagtatttgttacatttttgtatttcactatctttatactatataatatggtwacttgggtaccgggggaactttaaaatttcatctcaaaaataatttttaaaaagcctgaggtatgatatagcataaaagattgagatgaaaatatatttc

SEQ ID NO: 2951 - DNA, 132 bp, Homo sapiens
atttccctgtaagctgaattactcatttaaaaattttaacttctatatgggacccgaattagacactgctgaatcctgtacagccttactcataaataaartacttactgaatttccaccattcaaattcat

SEQ ID NO: 2952 - DNA, 201 bp, Homo sapiens
tacatgttcttaaagggtcatgaaacttactcatattatgggcctctgaatttacttaccttcaatgtgggttatcataatgaacatcatgatttccccarcattcctggaaaaagtcttccactggtgaggaaaatagcagctgaatactatgacaacctccctcactacaattcctggataaaagtactgtatgatttt

SEQ ID NO: 2953 - DNA, 201 bp, Homo sapiens
ttaaaaagcttctaaaaagctatttcgccaggcacggtggctcatgcctataatcccagcactttgggaggccaaggtgggtggatcacctgaggtcaggrgttcgagaccagcctggccaacacggtgaaaccccatctctactaaaaatgcaaaaattagccgggcgtggcggcacatgcctgtaatcccagctacatg

SEQ ID NO: 2954 - DNA, 201 bp, Homo sapiens
aaacttgtgacttgtgtattatcgtcattgaggatgtttcactcatgtctgtcattttataagcatatcatttaaaaagcttctaaaaagctatttcgccrggcacggtggctcatgcctataatcccagcactttgggaggccaaggtgggtggatcacctgaggtcaggagttcgagaccagcctggccaacacggtga

SEQ ID NO: 2955 - DNA, 201 bp, Homo sapiens
actcaagaatgaagaggcaccaaaaaggagagatggtgctggagtaaatatcattagtgccaaagggattcttctccaaaactttagatgataaaatggartttttgcattattaaacttgagaccagtgatgctcagaagctcccctggcacaatttcagagtaagagctcggtgataccaagaagtgaatctggctttt

SEQ ID NO: 2956 - DNA, 201 bp, Homo sapiens
ttagtctacatgttggcagcatctttacttggcctgggtttgcacccaatttctggacattttatagctgagcattacatgttcttaaagggtcatgaaamttactcatattatgggcctctgaatttacttaccttcaatgtgggttatcataatgaacatcatgatttccccaacattcctggaaaaagtcttccactg

SEQ ID NO: 2957 - DNA, 142 bp, Homo sapiens
atgaaaatatatttccctgtaagctgaattactcatttaaaaattttaacttctatatgggacccgaattagacactgctgaatcctgtacagccttactyataaataaagtacttactgaatttccaccattcaaattcat

SEQ ID NO: 2958 - DNA, 201 bp, Homo sapiens; identical to SEQ ID NO: 2949

SEQ ID NO: 2959 - DNA, 150 bp, Homo sapiens
gttttgctttattaaaaagctaataaacagctattaatcacagtgtattagtatttgttacatttttgtatttcactatctttatactatataatatggtwacttgggtaccgggggaactttaaaatttcatctcaaaaataattttta

SEQ ID NO: 2960 - DNA, 201 bp, Homo sapiens; identical to SEQ ID NO: 2956

SEQ ID NO: 2961 - DNA, 201 bp, Homo sapiens
actcaagaatgaagaggcaccaaaaaggagagatggtgctggagtaaatatcattagtgccaaagggattcttctccaaaactttagatgataaaatggarccgggcgtggcggcacatgcctgtaatcccagctacatgggaggctgaggtgggagaattgcttgaacccaggaggcggaggcagaggctgcagtgaccc

SEQ ID NO: 2962 - DNA, 201 bp, Homo sapiens; identical to SEQ ID NO: 2952

SEQ ID NO: 2963 - DNA, 201 bp, Homo sapiens
gcaaaagatttcttggcatgtatattcacttatacttagaaatattcattcttttaatttatgccagaataacaaagtggaaatcttatttcaaaatgctstttgtttttttgtgtgtgtttctgtagttctgctttctggggtagactagtaaaatggtagcttccagcattttgtccctggggccttctttatagggcc

SEQ ID NO: 2964 - DNA, 201 bp, Homo sapiens
gtataataattatagtggtaagcatagcacatcagcattatgccaacattctagactctttagttgatgtcattaaatggaaaagaaacttggattaaatragtgtgctgctcaccttcccaagttctgttatttcaaacctgtgaactaaccttgcagttcattataaatcaacagtaacaactgcattctaaattactc

SEQ ID NO: 2965 - DNA, 201 bp, Homo sapiens
aagagacagtggttcccatatttgaagcaacgcctggatttgaaaagtcgctggaaaacataacagctctgaggaaagaaggaggaggggaaagactgagygaagccagagacacagagcacaaagacagagaagagctgtccagcagggagaatagggccctgaaggaagggcaccgccaagatggagagggggccttag

SEQ ID NO: 2966 - DNA, 201 bp, Homo sapiens
aaagggaattgtcagaaactaaagacaaatttaattggctttacactttggcctagaatcataccacactgggtgatgacacttagaaatgcccatcacchtcatcatcatcatcatcatcatcatcatcattgctgttattattaagtgcctagatacttgctaataagtggaagatgaagatgctctctctatattatt

SEQ ID NO: 2967 - DNA, 201 bp, Homo sapiens
gtcctggctcttggtgcaccaacaatgaatttcatggtggatgaaacagcagcaatcaactcaaacaaggaatcccagcaattggtgcaaaaaacgtatayactggagaagaaagaagcaatggaggaagatgaagcgccccagcacagagatgctgacatagtacagggaaaaggggaggcagcactgtggggagaagca

SEQ ID NO: 2968 - DNA, 201 bp, Homo sapiens
tagaaattgaaattgaagaccaagaaataacaaaagcagatgtggagaccaagccgatgccaatagacgaaagctttgagaatgttcttaaagaaggaacrgagaaaggaacccaagagattgcagagggtttatctgagaagtccgggaaacatgtttctgcagaagaaaaggaaaaggataagagtaagctttgggaag

SEQ ID NO: 2969 - DNA, 183 bp, Homo sapiens
atatggcctgatacacccatctcatcttgggaatgggctagccaaaggtaccagaaaactcaaaggtctttggctaaaatccyctgtatcctccagcagtaactttgccattaggactagaaatactcaaagtccaatgagtaggatttcctctcccctagatagtacttggatgggtgcttt

SEQ ID NO: 2970 - DNA, 201 bp, Homo sapiens
caagaaagtctcaccttccaattgaggaatccttagaaattgaaattgaagaccaagaaataacaaaagcagatgtggagaccaagccgatgccaatagaygaaagctttgagaatgttcttaaagaaggaacggagaaaggaacccaagagattgcagagggtttatctgagaagtccgggaaacatgtttctgcagaag

SEQ ID NO: 2971 - DNA, 201 bp, Homo sapiens; identical to SEQ ID NO: 2963

SEQ ID NO: 2972 - DNA, 201 bp, Homo sapiens
aagtgccagaaggtcatcttctcaggaactgagtgaaaatgataagccaagaaagtctcaccttccaattgaggaatccttagaaattgaaattgaagacsaagaaataacaaaagcagatgtggagaccaagccgatgccaatagacgaaagctttgagaatgttcttaaagaaggaacggagaaaggaacccaagagat

SEQ ID NO: 2973 - DNA, 201 bp, Homo sapiens
cagggaagcccacactgacagcagcacagatgaaagtgccagaaggtcatcttctcaggaactgagtgaaaatgataagccaagaaagtctcaccttccarttgaggaatccttagaaattgaaattgaagaccaagaaataacaaaagcagatgtggagaccaagccgatgccaatagacgaaagctttgagaatgttct

SEQ ID NO: 2974 - DNA, 201 bp, Homo sapiens
tggctaaaatcctctgtatcctccagcagtaactttgccattaggactagaaatactcaaagtccaatgagtaggatttcctctcccctagatagtacttrgatgggtgctttccatgcttgccaagggcaagaaggcagtgatgaagttcaggaactccataggcaattcacagagaatgaattcatatcaacttccaaa

SEQ ID NO: 2975 - DNA, 201 bp, Homo sapiens
ccgatgccaatagacgaaagctttgagaatgttcttaaagaaggaacggagaaaggaacccaagagattgcagagggtttatctgagaagtccgggaaacrtgtttctgcagaagaaaaggaaaaggataagagtaagctttgggaagaaagcactgctcaggtgaaggacaaaaaggcaggtctccctgggttggaggaa

SEQ ID NO: 2976 - DNA, 201 bp, Homo sapiens
caaatgaatggaataccgcagtcacctttggatgataaaaaagataatttagaccctgaaaaagagagtgaaacctcatcacagaaggcaccagatgcccrtgacaatgtgaaagatgagaatgatggatgctctgagagtgaactggaagaggataaacaaggcgagttgttcagcttatcatgtaacataggctgttta

SEQ ID NO: 2977 - DNA, 201 bp, Homo sapiens
catgatgcctattcctcctccacttcccccaactgggaaaatcacaagagaaaatagatctgaaacatggagaaggagaagatttcgtccaaccactgctscaaatggcttagaacctcttttgacaaaggattcaagaaggattcataaaacatccttacatagtaatgcagctattacaatgatctatttggggaaaaa

SEQ ID NO: 2978 - DNA, 201 bp, Homo sapiens; identical to SEQ ID NO: 2964

SEQ ID NO: 2979 - DNA, 201 bp, Homo sapiens; identical to SEQ ID NO: 2965

SEQ ID NO: 2980 - DNA, 201 bp, Homo sapiens
aatgatggatgctctgagagtgaactggaagaggataaacaaggcgagttgttcagcttatcatgtaacataggctgtttactgaatatgaaaactgcttyatcaacctcatccagaagtcacccttattctagtgacagtgaggatgaatctgcagtgggggacagggaagcccacactgacagcagcacagatgaaagt

SEQ ID NO: 2981 - DNA, 201 bp, Homo sapiens; identical to SEQ ID NO: 2967

SEQ ID NO: 2982 - DNA, 201 bp, Homo sapiens
ttgggaatgggctagccaaaggtaccagaaaactcaaaggtctttggctaaaatcctctgtatcctccagcagtaactttgccattaggactagaaatackcaaagtccaatgagtaggatttcctctcccctagatagtacttggatgggtgctttccatgcttgccaagggcaagaaggcagtgatgaagttcaggaac

SEQ ID NO: 2983 - DNA, 201 bp, Homo sapiens
actatataatatataataatgaaatgactaagttatgtgaggaaaaaaacagaagacattgctaaaagagttaaaagtcattgctctggagaattaggagkgatggggcaggggactgttaggatgcattataaactgaaaagcctttttaaaattttatgtattaatatatgcattcacttgaaaaactaaaaaaaaaca

SEQ ID NO: 2984 - DNA, 201 bp, Homo sapiens
gatcacttgagaccagcttgggcaacatggcaaagccccatctctacaaaaaacacaaaaattagctgggcattgtggcgcacacctgtattcccatctastcaggaagctgagatggaagaattaattgagcccacgagttcaaggctgcagtgagtcgtgattgtgccactgcactccagccggggtgacagaagagac

SEQ ID NO: 2985 - DNA, 201 bp, Homo sapiens
ccaaagggttgcatgtagtaagaaattgtgatttaagatatattttaaagttataagtagcaggatattctgatggagtttgactttggttttgggcccasggagtttcagatgcctttgagaaatgaatgaagtagagagaaaataaaagaaaaactagccaggcacagtggctcacacctgtaatcccagcgctttggg

SEQ ID NO: 2986 - DNA, 201 bp, Homo sapiens
tagcaggatattctgatggagtttgactttggttttgggcccagggagtttcagatgcctttgagaaatgaatgaagtagagagaaaataaaagaaaaacyagccaggcacagtggctcacacctgtaatcccagcgctttgggaggctaaggcaggcagatcacttgagaccagcttgggcaacatggcaaagccccatc

SEQ ID NO: 2987 - DNA, 136 bp, Homo sapiens
cgatggccctgcccagtcccagacagaacctactaygtgcggcggcagctggggcgggaaggcgggcgctgggggcgctgcggccgctgcagcgccagggtccacctggtcggctgcacctgtggaggaggaggtg

SEQ ID NO: 2988 - DNA, 201 bp, Homo sapiens
cccttcaactgagcagtttcactagtggaaataccaaaagcttcctacgtgtatatccagaggtttgtagataaatgttgccaccttgtttgtaacagtgraaaattgaaaacaacctggaagtccagtgatgggaaaatgagtatgtttctgtcttagattggggaacccaaagcagattgcaagactgaaatttcagtg

SEQ ID NO: 2989 - DNA, 201 bp, Homo sapiens
cttgacattgtcgggcttttcacatgttggtaatatttattaaagatgaagatccacatacccttcaactgagcagtttcactagtggaaataccaaaagmttcctacgtgtatatccagaggtttgtagataaatgttgccaccttgtttgtaacagtgaaaaattgaaaacaacctggaagtccagtgatgggaaaatg

SEQ ID NO: 2990 - DNA, 201 bp, Homo sapiens
gtgagtcgtgattgtgccactgcactccagccggggtgacagaagagaccttgtctcgaaaaggaatctgaaaacaatggaaccatgccttcataattctrgaaagttattttcaactgataaatctatattcacccaaataatcaagggtgaaggtaaaataatacatttttagacaagcaaagactcaggggttacctc

SEQ ID NO: 2991 - DNA, 201 bp, Homo sapiens
ttccccactactcttgtctctatcagataccatttatgagacattcttgctataactaagtgcttctccaagaccccaactgagtccccagcacctgctayagtgagctgccattccacacccatcacatgtggcactcttgccagtccttgacattgtcgggcttttcacatgttggtaatatttattaaagatgaagat

SEQ ID NO: 2992 - DNA, 201 bp, Homo sapiens
atttttagtagagatggggtttcaccatgttggtcaggctagtctcgaactcgtgaccgcaagcgattcacccacctcagcctcccaaagtgctgggattrccggcttgagccaccacacccggcacatcttcattctttttatgtagtaaaaagtataaggccacacatggtttatttgaagtattttataatttaaaaa

SEQ ID NO: 2993 - DNA, 166 bp, Homo sapiens
cgatggccctgcccagtcccagacagaacctactacgtgcggcggcagctggggcgggaaggcggscgctgggggcgctgcggccgctgcagcgccagggtccacctggtcggctgcacctgtggaggaggaggtggatttcaggcttcccgtagactggaagaat

SEQ ID NO: 2994 - DNA, 201 bp, Homo sapiens
ctagtttaagttgttccccctccctctgaaaaaagtatgtatttttacattagaaaaggttttttgttgactttagatctataattatttctaagcaactwgtttttattccccactactcttgtctctatcagataccatttatgagacattcttgctataactaagtgcttctccaagaccccaactgagtccccagca

SEQ ID NO: 2995 - DNA, 175 bp, Homo sapiens
cgatggccctgcccagtcccagacagaacctactacgtgcggcggcagctggggcgggaaggcgggcgctggggscgctgcggccgctgcagcgccagggtccacctggtcggctgcacctgtggaggaggaggtggatttcaggcttcccgtagactggaagaatcggctcaaa

SEQ ID NO: 2996 - DNA, 182 bp, Homo sapiens
cgatggccctgcccagtcccagacagaacctactacgtgcggcggcagctggggcgggaaggcgggcgctgggggcgctgcrgccgctgcagcgccagggtccacctggtcggctgcacctgtggaggaggaggtggatttcaggcttcccgtagactggaagaatcggctcaaaaccgctt

SEQ ID NO: 2997 - DNA, 201 bp, Homo sapiens
gcgcgaacccgcggccgcagttcccaggcgtctgcgggcgcgagcacgccgcgaccctgcgtgcgccggggcgggggggcggggcctcgcctgcacaaatrgggacgagggggcggggcggccacaatttcgcgccaaacttgaccgcgcgttctgctgtaacgagcgggctcggaggtcctcccgctgctgtcatggttg

SEQ ID NO: 2998 - DNA, 172 bp, Homo sapiens
cgatggccctgcccagtcccagacagaacctactacgtgcggcggcagctggggcgggaaggcgggcgctgsgggcgctgcggccgctgcagcgccagggtccacctggtcggctgcacctgtggaggaggaggtggatttcaggcttcccgtagactggaagaatcggctc

SEQ ID NO: 2999 - DNA, 201 bp, Homo sapiens
aaaagcaatttaaagtcagcgagcaggttctcattgataacaagctccatactgctgagatacagggaaatggaggggggaaagctggagtattgatcccrcccccctccttggttgtcagctccctgtcctgtgtgtgggcggaacatagtccagctgctctatagcaagtctcaggtgtttgcagtaagaagctgctgg

SEQ ID NO: 3000 - DNA, 201 bp, Homo sapiens
gtcctgtgtgtgggcggaacatagtccagctgctctatagcaagtctcaggtgtttgcagtaagaagctgctggcatgcacgggaacagtgaatgccaaasacttaaagcaattcgatgtttaagtatgtaagttcttttttttttagacagcgtttcgctcttgttgcccaggctagcatgcaatggtgtgacctcggct

SEQ ID NO: 3001 - DNA, 201 bp, Homo sapiens
cgattctcctgcctcaggctcccaagtagctaggaccaggtgcgcgccaccacgcccggctaatttttgtattttgtatttttagtagagatggggtttcrccatgttggtcaggctagtctcgaactcgtgaccgcaagcgattcacccacctcagcctcccaaagtgctgggattaccggcttgagccaccacacccgg

SEQ ID NO: 3002 - DNA, 201 bp, Homo sapiens
ggagctagctttaaaaaggaacagtaaaaatattaatcggttagctgggtggaatggcccatgcctgtagtcccagctactcaggaggctcagcagcaggrcgacttgagcccaagagttccagaccagcctggccaccttagtgagatcccttctcttaaaaataataacttattgccagatttggggcatttggaaaga

SEQ ID NO: 3003 - DNA, 201 bp, Homo sapiens
gacgacttgagcccaagagttccagaccagcctggccaccttagtgagatcccttctcttaaaaataataacttattgccagatttggggcatttggaaakaagttcattgaagataaagcaaaagtaaaaaaaaaaaaaaaaaaacaaggggaaagggttggttaggcaatcattctagggcagaaagaagtacaggata

SEQ ID NO: 3004 - DNA, 201 bp, Homo sapiens
cggttagctgggtggaatggcccatgcctgtagtcccagctactcaggaggctcagcagcaggacgacttgagcccaagagttccagaccagcctggccaycttagtgagatcccttctcttaaaaataataacttattgccagatttggggcatttggaaagaagttcattgaagataaagcaaaagtaaaaaaaaaaaa

SEQ ID NO: 3005 - DNA, 201 bp, Homo sapiens
cttgggcaacatggcaaagccccatctctacaaaaaacacaaaaattagctgggcattgtggcgcacacctgtattcccatctactcaggaagctgagatkgaagaattaattgagcccacgagttcaaggctgcagtgagtcgtgattgtgccactgcactccagccggggtgacagaagagaccttgtctcgaaaagga

SEQ ID NO: 3006 - DNA, 144 bp, Homo sapiens
gtatttgcctctggaaagaacaactggcaggactgttgttttcattgtaagacttttggagccatttaattgtacttaaccattttcatctatttctttartaagaacaattccatcttaataaagagttacacttgttaataa

SEQ ID NO: 3007 - DNA, 201 bp, Homo sapiens
gctcccaagtagctaggaccaggtgcgcgccaccacgcccggctaatttttgtattttgtatttttagtagagatggggtttcaccatgttggtcaggctrgtctcgaactcgtgaccgcaagcgattcacccacctcagcctcccaaagtgctgggattaccggcttgagccaccacacccggcacatcttcattctttt

SEQ ID NO: 3008 - DNA, 201 bp, Homo sapiens
ggagaaactgaactgagaaggtaagaaaagcaatttaaagtcagcgagcaggttctcattgataacaagctccatactgctgagatacagggaaatggagrggggaaagctggagtattgatcccgcccccctccttggttgtcagctccctgtcctgtgtgtgggcggaacatagtccagctgctctatagcaagtctca

SEQ ID NO: 3009 - DNA, 201 bp, Homo sapiens
cgcttgcctcgcaggggctgagctggaggcagcgaggccgcccgacgcaggcttccggcgagacatggcagggcaaggatggcagcccggcggcagggccyggcgaggagcgcgaacccgcggccgcagttcccaggcgtctgcgggcgcgagcacgccgcgaccctgcgtgcgccggggcgggggggcggggcctcgcct

SEQ ID NO: 3010 - DNA, 201 bp, Homo sapiens
ttctgtcttagattggggaacccaaagcagattgcaagactgaaatttcagtgaaagcagtgtatttgctaggtcataccagaaatcatcaattgaggtayggagaaactgaactgagaaggtaagaaaagcaatttaaagtcagcgagcaggttctcattgataacaagctccatactgctgagatacagggaaatggag

SEQ ID NO: 3011 - DNA, 201 bp, Homo sapiens
acctccgccttcccagattcaagcgattctcctgcctcaggctcccaagtagctaggaccaggtgcgcgccaccacgcccggctaatttttgtattttgtrtttttagtagagatggggtttcaccatgttggtcaggctagtctcgaactcgtgaccgcaagcgattcacccacctcagcctcccaaagtgctgggatta

SEQ ID NO: 3012 - DNA, 201 bp, Homo sapiens
tatggtaactactctgggacaatatgggaggaaaagtgaagattgtgatggtgtaagagctaaatcctcatctgtcatatccagaaatcactatataatayataataatgaaatgactaagttatgtgaggaaaaaaacagaagacattgctaaaagagttaaaagtcattgctctggagaattaggagggatggggcagg

SEQ ID NO: 3013 - DNA, 201 bp, Homo sapiens
ggctgagctggaggcagcgaggccgcccgacgcaggcttccggcgagacatggcagggcaaggatggcagcccggcggcagggcccggcgaggagcgcgarcccgcggccgcagttcccaggcgtctgcgggcgcgagcacgccgcgaccctgcgtgcgccggggcgggggggcggggcctcgcctgcacaaatagggacg

SEQ ID NO: 3014 - DNA, 201 bp, Homo sapiens
ccggctaatttttgtattttgtatttttagtagagatggggtttcaccatgttggtcaggctagtctcgaactcgtgaccgcaagcgattcacccacctcrgcctcccaaagtgctgggattaccggcttgagccaccacacccggcacatcttcattctttttatgtagtaaaaagtataaggccacacatggtttattt

SEQ ID NO: 3015 - DNA, 108 bp, Homo sapiens
actatataatatataataatgaaatgactaagttatgtgaggaaaaaaacagaagacattgctaaaagagttaaaagtcattgctctggagaattaggagkgatgggg

SEQ ID NO: 3016 - DNA, 201 bp, Homo sapiens; identical to SEQ ID NO: 2984

SEQ ID NO: 3017 - DNA, 136 bp, Homo sapiens; identical to SEQ ID NO: 2987

SEQ ID NO: 3018 - DNA, 201 bp, Homo sapiens; identical to SEQ ID NO: 2988

SEQ ID NO: 3019 - DNA, 201 bp, Homo sapiens; identical to SEQ ID NO: 2989

SEQ ID NO: 3020 - DNA, 201 bp, Homo sapiens; identical to SEQ ID NO: 2991

SEQ ID NO: 3021 - DNA, 201 bp, Homo sapiens; identical to SEQ ID NO: 2990

SEQ ID NO: 3022 - DNA, 166 bp, Homo sapiens; identical to SEQ ID NO: 2993

SEQ ID NO: 3023 - DNA, 201 bp, Homo sapiens; identical to SEQ ID NO: 2994

SEQ ID NO: 3024 - DNA, 175 bp, Homo sapiens; identical to SEQ ID NO: 2995

SEQ ID NO: 3025 - DNA, 182 bp, Homo sapiens; identical to SEQ ID NO: 2996

SEQ ID NO: 3026 - DNA, 201 bp, Homo sapiens; identical to SEQ ID NO: 2997

SEQ ID NO: 3027 - DNA, 172 bp, Homo sapiens; identical to SEQ ID NO: 2998

SEQ ID NO: 3028 - DNA, 201 bp, Homo sapiens; identical to SEQ ID NO: 2999

SEQ ID NO: 3029 - DNA, 201 bp, Homo sapiens
cgattctcctgcctcaggctcccaagtagctaggaccaggtgcgcgccaccacgcccggctaatttttgtattttgtatttttagtagagatggggtttcrccatgttggtcaggctagtctcgaactcgtgaccgcaagcgattcacccacctgtaatcccagcgctttgggaggctaaggcaggcagatcacttgagac

SEQ ID NO: 3030 - DNA, 201 bp, Homo sapiens; identical to SEQ ID NO: 3000

SEQ ID NO: 3031 - DNA, 201 bp, Homo sapiens; identical to SEQ ID NO: 3002

SEQ ID NO: 3032 - DNA, 201 bp, Homo sapiens; identical to SEQ ID NO: 3003

SEQ ID NO: 3033 - DNA, 201 bp, Homo sapiens; identical to SEQ ID NO: 3004

SEQ ID NO: 3034 - DNA, 201 bp, Homo sapiens; identical to SEQ ID NO: 3005

SEQ ID NO: 3035 - DNA, 201 bp, Homo sapiens
gctcccaagtagctaggaccaggtgcgcgccaccacgcccggctaatttttgtattttgtatttttagtagagatggggtttcaccatgttggtcaggctrgtctcgaactcgtgaccgcaagcgattcacccacctgtaatcccagcgctttgggaggctaaggcaggcagatcacttgagaccagcttgggcaacatgg

SEQ ID NO: 3036 - DNA, 201 bp, Homo sapiens; identical to SEQ ID NO: 3008

SEQ ID NO: 3037 - DNA, 201 bp, Homo sapiens; identical to SEQ ID NO: 3009

SEQ ID NO: 3038 - DNA, 201 bp, Homo sapiens; identical to SEQ ID NO: 3010

SEQ ID NO: 3039 - DNA, 201 bp, Homo sapiens
acctccgccttcccagattcaagcgattctcctgcctcaggctcccaagtagctaggaccaggtgcgcgccaccacgcccggctaatttttgtattttgtrtttttagtagagatggggtttcaccatgttggtcaggctagtctcgaactcgtgaccgcaagcgattcacccacctgtaatcccagcgctttgggaggct

SEQ ID NO: 3040 - DNA, 201 bp, Homo sapiens; identical to SEQ ID NO: 3013

SEQ ID NO: 3041 - DNA, 197 bp, Homo sapiens
gggcagaaagaagtacaggataggaagagcataatacactgtttttctcggtgtaagagctaaatcctcatctgtcatatccagaaatcactatataatayataataatgaaatgactaagttatgtgaggaaaaaaacagaagacattgctaaaagagttaaaagtcattgctctggagaattaggagggatgggg

SEQ ID NO: 3042 - DNA, 201 bp, Homo sapiens
tccaggcccaggaatccataacactggaggatgtggctgtggacttcacttgggaggagtggcaactcctgggcgctgctcagaaggacctgtaccgggaygtgatgttggagaactacagcaacctggtggcagtggggtatcaagccagcaaaccggatgcactcttcaagttggaacaaggagaacaactgtggacaa

SEQ ID NO: 3043 - DNA, 201 bp, Homo sapiens
taccgggatgtgatgttggagaactacagcaacctggtggcagtggggtatcaagccagcaaaccggatgcactcttcaagttggaacaaggagaacaacygtggacaattgaagatggaatccacagtggagcctgttcagacatatggaaagttgatcatgtgctggagcgcttgcagagtgaaagcctggtgaacaga

SEQ ID NO: 3044 - DNA, 201 bp, Homo sapiens
acacaggaaagacgccctttgtgtgcagtgaatgtggaaaatcctgttctcagaaatcaggtctcattaaacatcaaagaattcacacaggagagaaaccmtttgaatgtagtgaatgtgggaaagcctttagcacaaagcaaaagctcattgtccatcaaaggactcatacaggagagagaccctatggctgtaacgagt

SEQ ID NO: 3045 - DNA, 201 bp, Homo sapiens
cccctcagacatcattaaacatcagcggcctcctcgcaaacaggaacgtagtccttgtgggacagccagtggtcagatgtgcagcctcaggagataacagwggatttgcacaggacagaaaccttgtgaatgcagtgaatgtggttgtgccttccgtgatcaattatgtcttattttatgttacagaaaacccataggaag

SEQ ID NO: 3046 - DNA, 201 bp, Homo sapiens
gctcgactgtgtcaattaaatgagtaaaggaagcccaagtacttttaagtggaggaaatgaagtactgtgaatttttaaaacagatgagataattggtgtygggagtgttgcagtgactgaaaagcttcataaggggcagttggtgggaaagggctaatactgtaatggtggaatgtgggacacatatgtgtcaattcagt

SEQ ID NO: 3047 - DNA, 201 bp, Homo sapiens
accctttgaatgtagtgaatgtgggaaagcctttagcacaaagcaaaagctcattgtccatcaaaggactcatacaggagagagaccctatggctgtaacragtgtgggaaagcgtttgcgtatatgtcgtgtctggttaagcataagagaatacacacaagggagaaacaagaggcagccaaggtggaaaatcctcctgc

SEQ ID NO: 3048 - DNA, 201 bp, Homo sapiens
gctcattacacaccagtgatgtcatgcaggagaaaaactctgctaacggggcgactacacaagtgccttctgtggcccctcagacatcattaaacatcagyggcctcctcgcaaacaggaacgtagtccttgtgggacagccagtggtcagatgtgcagcctcaggagataacagaggatttgcacaggacagaaaccttg

SEQ ID NO: 3049 - DNA, 201 bp, Homo sapiens
cttattttatgttacagaaaacccataggaagaaaactcagatctatgtggaaaagggttgagcaaaaatttgtagttcattatgtggccgaaaagcatayactgagagaacatgtataaggctgagatagcctgataaactcatcctattaaaatgtatgctgtgatacacaggcaaatttgatgttaacctaagcacat

SEQ ID NO: 3050 - DNA, 201 bp, Homo sapiens
agaagcatcatgtgtgcagtgaatgtgggaaagccttcatcaagaagtcttggctaactgatcaccaggtaatgcatacaggagagaaaccccacagatgyagtctatgtgagaaagccttctccagaaagttcatgcttactgaacatcagcgaactcatacaggagaaaaaccttatgaatgccctgaatgtggcaaag

SEQ ID NO: 3051 - DNA, 201 bp, Homo sapiens
cagaaggaaaccatgtcatgaacatgatgcatttgaaaatattgttcattgcagcaaaagtcagtttctgttagggcaaaatcatgatatatttgacttaygtggaaaaagtttgaaatccaatttaactttagttaaccagagcaaaggctatgaaataaagaactctgttgagtttactggaaatggggactcctttct

SEQ ID NO: 3052 - DNA, 201 bp, Homo sapiens; identical to SEQ ID NO: 3042

SEQ ID NO: 3053 - DNA, 201 bp, Homo sapiens; identical to SEQ ID NO: 3043

SEQ ID NO: 3054 - DNA, 201 bp, Homo sapiens; identical to SEQ ID NO: 3044

SEQ ID NO: 3055 - DNA, 201 bp, Homo sapiens; identical to SEQ ID NO: 3045

SEQ ID NO: 3056 - DNA, 201 bp, Homo sapiens; identical to SEQ ID NO: 3046

SEQ ID NO: 3057 - DNA, 201 bp, Homo sapiens; identical to SEQ ID NO: 3047

SEQ ID NO: 3058 - DNA, 201 bp, Homo sapiens; identical to SEQ ID NO: 3048

SEQ ID NO: 3059 - DNA, 201 bp, Homo sapiens; identical to SEQ ID NO: 3049

SEQ ID NO: 3060 - DNA, 201 bp, Homo sapiens; identical to SEQ ID NO: 3050

SEQ ID NO: 3061 - DNA, 201 bp, Homo sapiens; identical to SEQ ID NO: 3051

SEQ ID NO: 3062 - DNA, 147 bp, Homo sapiens
aagctgggtatggagcccctcagcggcggcggggtctgtgagttggwcgcggggtcttggcggggaatggaggtagaataaacgtgggacccggagtgcaccaaggtgagaaaaaaaaattactaaaaatgacaagtagaagacttg

SEQ ID NO: 3063 - DNA, 109 bp, Homo sapiens
aagctgggyatggagcccctcagcggcggcggggtctgtgagttggacgcggggtcttggcggggaatggaggtagaataaacgtgggacccggagtgcaccaaggtga

SEQ ID NO: 3064 - DNA, 201 bp, Homo sapiens
gaatatttgttttgggtgatcagaactgagactcctattgtggattagtaacatgcctcctcctagaacaagggagggcagggatcgccgagaccaccacygggctcccagcgaggaagaggccttggagaaatgggactggaattgtccagagacgcgtcgcctcttggaagatgccttcttccgtgaagaggattacat

SEQ ID NO: 3065 - DNA, 201 bp, Homo sapiens
cagagcagcggaagggccgggcgggccgcacgggccccggagtctgcttccgcctctatgccgaatcggactatgatgccttcgccccctaccccgtcccrgaaattcggagggtggccctggactcgttggtgctgcagatgaagagcatgagtgtgggggacccccgaaccttccccttcatcgagcccccaccaccag

SEQ ID NO: 3066 - DNA, 201 bp, Homo sapiens
ttgtgtccatcccagagatcactgcagatgtcatgaggtaccctttgtgtcaccagctcaagcaggcctctggccactttatcatctgtggtggtcctgtsccgtgaccaggaggaaaaattagctctttgaagagaaagtagttctctattgcaggcactggcctcttaaattgttgcaggtggggaatggatgagaata

SEQ ID NO: 3067 - DNA, 201 bp, Homo sapiens
cacgttcggcggccaccaagattgtattcctgacagtggggctgctcctgcgacaaatccagcgggaacccagcctgccccagtatgaggtcctgattgtrgatgaagtccatgagcggcatctccacaacgatttcctcctgggcgtcctccagcgcctgttgcccacgcggcctgacctcaaggtcatcctcatgtcgg

SEQ ID NO: 3068 - DNA, 169 bp, Homo sapiens
gttcagcctggtggagcctgtgctcaccatcgcagccgcacttagcgtccagtcgcccttcacccgcagcgcccagagcagcccagagtgcgcggcagcayggcggccgctggagagcgaccagggtgaccccttcacgctcttcaacgtcttcaacgcctgggtgcag

SEQ ID NO: 3069 - DNA, 201 bp, Homo sapiens
ggacagcccaagcacagcatcccagcgctggccgacctacctcgcacttacgacccacgttaccgcatcaacctctctgttcttggccctgccacgcgggrctctcagggactgggcaggcacttgcccgcggagagagtggctgagttccgccgagccctgttgcactacctggactttggccagaagcaggcatttggg

SEQ ID NO: 3070 - DNA, 201 bp, Homo sapiens
gaacccagcctgccccagtatgaggtcctgattgtggatgaagtccatgagcggcatctccacaacgatttcctcctgggcgtcctccagcgcctgttgcscacgcggcctgacctcaaggtcatcctcatgtcggccaccatcaacatctcgctcttctccagctatttcagcaatgcccctgtggtacaggtgcctggg

SEQ ID NO: 3071 - DNA, 201 bp, Homo sapiens
catccagaaagcagcagctgccttgttagtcctccccagggtctagctttccttcttcctgctgcagggtgctgcctgaggggtcctgggtaggaggggckttagagccagcagggacctcccatgtctccagattccaggtgcaggttcttagcacctccgcagccgctctctcttgagtccatcctcagtctctcctac

SEQ ID NO: 3072 - DNA, 201 bp, Homo sapiens; identical to SEQ ID NO: 3067

SEQ ID NO: 3073 - DNA, 201 bp, Homo sapiens
gaaggacttcctctttacacccacagaggtgctgcgccaccggaagcagcacgtgtgagctgggccaggagccctgcccacctccgtgcagctgacctgcyctccagcccaggactaggggcaggactcttgcctgaacccccagcctgggcttagccctgtggtcctgtcccagtgcagagggcctggagcacggattgt

SEQ ID NO: 3074 - DNA, 201 bp, Homo sapiens
cgttagagccagcagggacctcccatgtctccagattccaggtgcaggttcttagcacctccgcagccgctctctcttgagtccatcctcagtctctcctwccccttgaagtagggggaccctgaatttgcccatccacctgggtcactttgagagttgtgcaggggggctgggagcactggtgttcacgtgggaccacag

SEQ ID NO: 3075 - DNA, 201 bp, Homo sapiens; identical to SEQ ID NO: 3070

SEQ ID NO: 3076 - DNA, 201 bp, Homo sapiens
ggtctttggacaccaatggtgactgctcccgcctggtggccgatggctggctggagctgcagctagcagacagtgaaagtgccatccgactcctggcggcktccctgcggctccgtgcccgctgggaaagtgccctggaccggcagctggcgcaccaggcccagcagcagctggaggaggaggaggaggatacgccagtca

SEQ ID NO: 3077 - DNA, 201 bp, Homo sapiens; identical to SEQ ID NO: 3064

SEQ ID NO: 3078 - DNA, 201 bp, Homo sapiens; identical to SEQ ID NO: 3066

SEQ ID NO: 3079 - DNA, 201 bp, Homo sapiens; identical to SEQ ID NO: 3065

SEQ ID NO: 3080 - DNA, 201 bp, Homo sapiens
ggagccctgcccacctccgtgcagctgacctgccctccagcccaggactaggggcaggactcttgcctgaacccccagcctgggcttagccctgtggtccygtcccagtgcagagggcctggagcacggattgtgaataaagcctcacatgctgatacacactgttaggcctgcacctgcccatccagaaagcagcagctg

SEQ ID NO: 3081 - DNA, 201 bp, Homo sapiens
ggactaggggcaggactcttgcctgaacccccagcctgggcttagccctgtggtcctgtcccagtgcagagggcctggagcacggattgtgaataaagcckcacatgctgatacacactgttaggcctgcacctgcccatccagaaagcagcagctgccttgttagtcctccccagggtctagctttccttcttcctgctg

SEQ ID NO: 3082 - DNA, 201 bp, Homo sapiens; identical to SEQ ID NO: 3069

SEQ ID NO: 3083 - DNA, 201 bp, Homo sapiens
cggccgtgaccaacattcttaatctgtcctctagtgctggccactctaaaacttcacaagaatgtgctgtctgtgtctagcttcttttacccaacatgagsttgcatgggcttggttcattcattctgttccatgaattcatcacaatatatccattcttttgtccagggacatttggcttccagaaacctacccctaaca

SEQ ID NO: 3084 - DNA, 201 bp, Homo sapiens
gcagaacaaaggccccatcagaggggacgtgctgggtgtcagcgtcagcttctgggaggaggaaggtcagagctaaggcctgaaggatgatgaggtatcargtgggtggaggggagacgctcaggaggtgggaaaggcggaggtgcacaggcttggttccaggtacaaataacgttactaggagcacacagtacctggatt

SEQ ID NO: 3085 - DNA, 201 bp, Homo sapiens; identical to SEQ ID NO: 3071

SEQ ID NO: 3086 - DNA, 201 bp, Homo sapiens; identical to SEQ ID NO: 3067

SEQ ID NO: 3087 - DNA, 201 bp, Homo sapiens; identical to SEQ ID NO: 3073

SEQ ID NO: 3088 - DNA, 201 bp, Homo sapiens; identical to SEQ ID NO: 3074

SEQ ID NO: 3089 - DNA, 201 bp, Homo sapiens; identical to SEQ ID NO: 3070

SEQ ID NO: 3090 - DNA, 201 bp, Homo sapiens; identical to SEQ ID NO: 3076

SEQ ID NO: 3091 - DNA, 201 bp, Homo sapiens; identical to SEQ ID NO: 3064

SEQ ID NO: 3092 - DNA, 201 bp, Homo sapiens; identical to SEQ ID NO: 3066

SEQ ID NO: 3093 - DNA, 201 bp, Homo sapiens; identical to SEQ ID NO: 3065

SEQ ID NO: 3094 - DNA, 201 bp, Homo sapiens; identical to SEQ ID NO: 3080

SEQ ID NO: 3095 - DNA, 201 bp, Homo sapiens; identical to SEQ ID NO: 3081

SEQ ID NO: 3096 - DNA, 201 bp, Homo sapiens; identical to SEQ ID NO: 3069

SEQ ID NO: 3097 - DNA, 201 bp, Homo sapiens; identical to SEQ ID NO: 3083

SEQ ID NO: 3098 - DNA, 201 bp, Homo sapiens; identical to SEQ ID NO: 3084

SEQ ID NO: 3099 - DNA, 201 bp, Homo sapiens; identical to SEQ ID NO: 3071

SEQ ID NO: 3100 - DNA, 201 bp, Homo sapiens; identical to SEQ ID NO: 3067

SEQ ID NO: 3101 - DNA, 201 bp, Homo sapiens; identical to SEQ ID NO: 3073

SEQ ID NO: 3102 - DNA, 201 bp, Homo sapiens; identical to SEQ ID NO: 3074

SEQ ID NO: 3103 - DNA, 201 bp, Homo sapiens; identical to SEQ ID NO: 3070

SEQ ID NO: 3104 - DNA, 201 bp, Homo sapiens; identical to SEQ ID NO: 3076

SEQ ID NO: 3105 - DNA, 201 bp, Homo sapiens; identical to SEQ ID NO: 3064

SEQ ID NO: 3106 - DNA, 201 bp, Homo sapiens; identical to SEQ ID NO: 3066

SEQ ID NO: 3107 - DNA, 201 bp, Homo sapiens; identical to SEQ ID NO: 3065

SEQ ID NO: 3108 - DNA, 201 bp, Homo sapiens; identical to SEQ ID NO: 3080

SEQ ID NO: 3109 - DNA, 201 bp, Homo sapiens; identical to SEQ ID NO: 3081

SEQ ID NO: 3110 - DNA, 201 bp, Homo sapiens; identical to SEQ ID NO: 3069

SEQ ID NO: 3111 - DNA, 201 bp, Homo sapiens; identical to SEQ ID NO: 3083

SEQ ID NO: 3112 - DNA, 201 bp, Homo sapiens; identical to SEQ ID NO: 3084

SEQ ID NO: 3113 - DNA, 201 bp, Homo sapiens
acggtaagcatgaaccctccttccctgaaggtgggatttcaggaagaccccaccaccccgtttcaccttagtccagggacatagttcccaagtggggcccrtggccctgagggcttctgggaagggtcccgggggggcacttgggtggtgggtggcacttggcgggggcccagccctgacagctggcctgccacagaatga

SEQ ID NO: 3114 - DNA, 201 bp, Homo sapiens; identical to SEQ ID NO: 3071

SEQ ID NO: 3115 - DNA, 201 bp, Homo sapiens; identical to SEQ ID NO: 3073

SEQ ID NO: 3116 - DNA, 201 bp, Homo sapiens; identical to SEQ ID NO: 3074

SEQ ID NO: 3117 - DNA, 201 bp, Homo sapiens; identical to SEQ ID NO: 3076

SEQ ID NO: 3118 - DNA, 201 bp, Homo sapiens
aggatgtgaagttcaagcttcggcatgacctggcgcagctgcaggccgctgccagctcagcccaggacctgagccgcgagcagctggctctgctgaagctrgtgctgggccggggcctgtacccacagctggccgtccccgacgccttcaacagcagccgaaaggactcagaccagattttccacacgcaggccaagcagg

SEQ ID NO: 3119 - DNA, 201 bp, Homo sapiens; identical to SEQ ID NO: 3080

SEQ ID NO: 3120 - DNA, 201 bp, Homo sapiens; identical to SEQ ID NO: 3081

SEQ ID NO: 3121 - DNA, 201 bp, Homo sapiens; identical to SEQ ID NO: 3083

SEQ ID NO: 3122 - DNA, 201 bp, Homo sapiens; identical to SEQ ID NO: 3084

SEQ ID NO: 3123 - DNA, 201 bp, Homo sapiens; identical to SEQ ID NO: 3113

SEQ ID NO: 3124 - DNA, 163 bp, Homo sapiens
tcccaggggacatggccctgtcctcatttcaggagccgggtttccatggacggtgcttggtcycaggtatctgcagagcctgggggtctgcggatcatggtaggagcccctcaggtcccctaagactctgcctccccgtgctccccccaggatgtgaagttca

SEQ ID NO: 3125 - DNA, 201 bp, Homo sapiens; identical to SEQ ID NO: 3064

SEQ ID NO: 3126 - DNA, 201 bp, Homo sapiens; identical to SEQ ID NO: 3066

SEQ ID NO: 3127 - DNA, 201 bp, Homo sapiens; identical to SEQ ID NO: 3067

SEQ ID NO: 3128 - DNA, 201 bp, Homo sapiens; identical to SEQ ID NO: 3069

SEQ ID NO: 3129 - DNA, 201 bp, Homo sapiens; identical to SEQ ID NO: 3070

SEQ ID NO: 3130 - DNA, 201 bp, Homo sapiens
gggcgagcctcagccccaaggtcctccaagctggacagacgagtgtctcagttctcaggacgaggagcacgaggcagacaagaaggaggacgacctcgaarccatgaacgcagaggaggactcactgaggaacgggggagaggaggaggacgaagatgaggacctggaagaggaggaagaagaggaagaggaggatgacga

SEQ ID NO: 3131 - DNA, 201 bp, Homo sapiens
ttaaaaaataaaaaaatacagtaaagtttaaaaaatacaccacgaatttggtgtggctgtattcagatcgtattaattatctgatcgggataacaaaatcmcaagcaataattaggatctatgcaatttttaaactagtaatgggccaattaaaatatatataaatatatatttttcaaccagcattttactacttgttac

SEQ ID NO: 3132 - DNA, 201 bp, Homo sapiens
cagtaaagtttaaaaaatacaccacgaatttggtgtggctgtattcagatcgtattaattatctgatcgggataacaaaatcacaagcaataattaggatytatgcaatttttaaactagtaatgggccaattaaaatatatataaatatatatttttcaaccagcattttactacttgttacctttcccatgctgaatta

SEQ ID NO: 3133 - DNA, 201 bp, Homo sapiens
ttgtacagaatttttaatgactttttataatgtggatttcctattttaaaaccatgcagcttcatcaatttttatacatatcagaaaagtagaattatatytaatttatacaaaataatttaactaatttaaaccagcagaaaagtgcttagaaagttattgtgttgccttagcacttctttcctctccaattgtaaaaaa

SEQ ID NO: 3134 - DNA, 201 bp, Homo sapiens
gacctggtctccttcgttcagacgctttgcaagggcttatcccaacccaccaccaacctggttgcgggctgcctgcaactcaatcctcggacttttctgcmtgagcagaaccaggacatgcccccccacctgccgacggccagcgcttccttccctgtacacccctactcctaccagtcgcctgggctgcccagtccgcct

SEQ ID NO: 3135 - DNA, 201 bp, Homo sapiens
gatcaaaagcccaagagacgcggccccaaaaagaagaagatgactaaggctcgcctggagcgttttaaattgagacgcatgaaggctaacgcccgggagckgaaccgcatgcacggactgaacgcggcgctagacaacctgcgcaaggtggtgccttgctattctaagacgcagaagctgtccaaaatcgagactctgcgc

SEQ ID NO: 3136 - DNA, 201 bp, Homo sapiens
tgacgatcaaaagcccaagagacgcggccccaaaaagaagaagatgactaaggctcgcctggagcgttttaaattgagacgcatgaaggctaacgcccggragcggaaccgcatgcacggactgaacgcggcgctagacaacctgcgcaaggtggtgccttgctattctaagacgcagaagctgtccaaaatcgagactct

SEQ ID NO: 3137 - DNA, 201 bp, Homo sapiens
ctcagctagcggccccgcccgcgcttagcatcactaactgggctatataacctgagcgcccgcgcggccacgacacgaggaattcgcccacgcaggaggcrcggcgtccggaggccccagggttatgagactatcactgctcaggacctactaacaacaaaggaaatcgaaacatgaccaaatcgtacagcgagagtgggc

SEQ ID NO: 3138 - DNA, 201 bp, Homo sapiens
aagatgaaactgtggattttcaggctcctttacttccagtgacctgtggtggggtgaagggaattttacataaggagaaattggaacaaggaaccttggcraagtgtatacagactgaggatggaaaatggttcacccccatggaatttgaaatcaaaggaggctacgcaagatcaaagaactggaggctgagtgtgcgct

SEQ ID NO: 3139 - DNA, 201 bp, Homo sapiens
cgaacatgaatctgaaagacctttccaagattagggggagaaagagaggcaaacctggaacccactttactcagagtgacagagctccacagaaaagagtmcgatcaagagcttcaagaaagcacaaagatgaaactgtggattttcaggctcctttacttccagtgacctgtggtggggtgaagggaattttacataagg

SEQ ID NO: 3140 - DNA, 201 bp, Homo sapiens
aggcctgacgtccctggagttgaaagcccagtttctgacacacaggcctggcaggcaggactccttgtgctcccagcagctcagacagggaaaggatagtccccactcacggtgacaccaccttcctgaggcttccctcctgctgctaccactgatgcgagggaaaggccagtggctggagaccccatgtgcagttcttgg

SEQ ID NO: 3141 - DNA, 201 bp, Homo sapiens
atggaggcctgacgtccctggagttgaaagcccagtttctgacacacaggcctggcaggcaggactccttgtgctcccagcagctcagacagggaaaggakagtccccactcacggtgacaccaccttcctgaggcttccctcctgctgctaccactgatgcgagggaaaggccagtggctggagaccccatgtgcagttc

SEQ ID NO: 3142 - DNA, 201 bp, Homo sapiens
caaaggaggctacgcaagatcaaagaactggaggctgagtgtgcgctgtggcgggtggcccctacgacggctgatggaggaaggatctctacctaatcctycaagaatatattacaggaacaaaaagagaatactgaagtctcaaaacaatagctcagttgacccttgtatgagaaacttggatgagtgtgaggtgtgccg

SEQ ID NO: 3143 - DNA, 201 bp, Homo sapiens
ggcaaaatggatactgtggatattgcaaacaactctactttgggaaaacccaagaggaaaagaagaaaaaagaaggggcatggctggagcagaatgggaaygagaacgcagaaaaacaaccaacaaaatgataacagcaaagccgatggccagctggtctcgagtgaaaagaaggcgaacatgaatctgaaagacctttcc

SEQ ID NO: 3144 - DNA, 201 bp, Homo sapiens
gcctgccaccatgcccagctaattttttgcatttttagtagagacggggtttcactatgttggccaggctggtctcgaactcctgacctcatgagccgccygccttggcctcccaaagtgctgggacgtgacaggagtgagccaccacacctggccactcgcaagaccttttatctgaaaaccagccaagctttattcacg

SEQ ID NO: 3145 - DNA, 201 bp, Homo sapiens
agtgcctgccaccatgcccagctaattttttgcatttttagtagagacggggtttcactatgttggccaggctggtctcgaactcctgacctcatgagccrcccgccttggcctcccaaagtgctgggacgtgacaggagtgagccaccacacctggccactcgcaagaccttttatctgaaaaccagccaagctttattc

SEQ ID NO: 3146 - DNA, 201 bp, Homo sapiens
ctcagctcactgcaacctctgcctcccggattcaagtgattctcctgtctcagcctcccaagtagctgggattacagtgcctgccaccatgcccagctaaytttttgcatttttagtagagacggggtttcactatgttggccaggctggtctcgaactcctgacctcatgagccgcccgccttggcctcccaaagtgctg

SEQ ID NO: 3147 - DNA, 201 bp, Homo sapiens
gaagttttgcagtagggtctcctgtcccagggggttgaggaaaaaaaacaccagttgtttatattttgtgcttattcatacaagacaggaagcacggtctyaggcggatggaggcctgacgtccctggagttgaaagcccagtttctgacacacaggcctggcaggcaggactccttgtgctcccagcagctcagacaggg

SEQ ID NO: 3148 - DNA, 201 bp, Homo sapiens
tcctgtcccagggggttgaggaaaaaaaacaccagttgtttatattttgtgcttattcatacaagacaggaagcacggtcttaggcggatggaggcctgaygtccctggagttgaaagcccagtttctgacacacaggcctggcaggcaggactccttgtgctcccagcagctcagacagggaaaggatagtccccactca

SEQ ID NO: 3149 - DNA, 201 bp, Homo sapiens
agactctcacctcttctcctgaggtctgctccagacaacatttattactcacaagacctttttcctccgttttttttttgagatggagtctcacacagtcrcccgggattggaatgcaatggcgcgatctcagctcactgcaacctctgcctcccggattcaagtgattctcctgtctcagcctcccaagtagctgggatt

SEQ ID NO: 3150 - DNA, 201 bp, Homo sapiens
agacaggaagcacggtcttaggcggatggaggcctgacgtccctggagttgaaagcccagtttctgacacacaggcctggcaggcaggactccttgtgctyccagcagctcagacagggaaaggatagtccccactcacggtgacaccaccttcctgaggcttccctcctgctgctaccactgatgcgagggaaaggccag

SEQ ID NO: 3151 - DNA, 201 bp, Homo sapiens
ggaaggagattggaggtgataccagcacagacagactctcacctcttctcctgaggtctgctccagacaacatttattactcacaagacctttttcctccrttttttttttgagatggagtctcacacagtcacccgggattggaatgcaatggcgcgatctcagctcactgcaacctctgcctcccggattcaagtgatt

SEQ ID NO: 3152 - DNA, 201 bp, Homo sapiens
gtccctggagttgaaagcccagtttctgacacacaggcctggcaggcaggactccttgtgctcccagcagctcagacagggaaaggatagtccccactcayggtgacaccaccttcctgaggcttccctcctgctgctaccactgatgcgagggaaaggccagtggctggagaccccatgtgcagttcttggatactctgg

SEQ ID NO: 3153 - DNA, 201 bp, Homo sapiens
ggcaaagtgtatacagactgaggatggaaaatggttcacccccatggaatttgaaatcaaaggaggctacgcaagatcaaagaactggaggctgagtgtgygctgtggcgggtggcccctacgacggctgatggaggaaggatctctacctaatcctccaagaatatattacaggaacaaaaagagaatactgaagtctca

SEQ ID NO: 3154 - DNA, 201 bp, Homo sapiens
agagaatactgaagtctcaaaacaatagctcagttgacccttgtatgagaaacttggatgagtgtgaggtgtgccgggacggaggggagctgttctgttgygacacttgttcaagagtcttccatgaggactgccacatcccacctgtggaaagtgagaagtaagtgacatgcaggcacctctctttcatcctttaaggga

SEQ ID NO: 3155 - DNA, 201 bp, Homo sapiens
atgacactgtattcaagcacttcaaaagacataagctggagatatcaaatgcaataaaaaagacatttccattccttgagggcctccgcgatcgggaactyatcacaaataaaatgtttgaagattctgaagattcttgtagaaacctggtccctgtacaaagagtggtgtacaatgttctcagtgaactggagaagacat

SEQ ID NO: 3156 - DNA, 201 bp, Homo sapiens
ttgtctatgacactgtattcaagcacttcaaaagacataagctggagatatcaaatgcaataaaaaagacatttccattccttgagggcctccgcgatcgkgaactcatcacaaataaaatgtttgaagattctgaagattcttgtagaaacctggtccctgtacaaagagtggtgtacaatgttctcagtgaactggaga

SEQ ID NO: 3157 - DNA, 201 bp, Homo sapiens
aagcacttcaaaagacataagctggagatatcaaatgcaataaaaaagacatttccattccttgagggcctccgcgatcgggaactcatcacaaataaaaygtttgaagattctgaagattcttgtagaaacctggtccctgtacaaagagtggtgtacaatgttctcagtgaactggagaagacatttaacctgtcagtt

SEQ ID NO: 3158 - DNA, 201 bp, Homo sapiens; identical to SEQ ID NO: 3138

SEQ ID NO: 3159 - DNA, 201 bp, Homo sapiens; identical to SEQ ID NO: 3149

SEQ ID NO: 3160 - DNA, 201 bp, Homo sapiens; identical to SEQ ID NO: 3139

SEQ ID NO: 3161 - DNA, 201 bp, Homo sapiens; identical to SEQ ID NO: 3151

SEQ ID NO: 3162 - DNA, 201 bp, Homo sapiens; identical to SEQ ID NO: 3153

SEQ ID NO: 3163 - DNA, 201 bp, Homo sapiens
agagaatactgaagtctcaaaacaatagctcagttgacccttgtatgagaaacttggatgagtgtgaggtgtgccgggacggaggggagctgttctgttgygacacttgttcaagagtcttccatgaggactgccacatcccacctgtggaaagtgagaagaccccgtggaattgcatcttctgcaggatgaaggagtctc

SEQ ID NO: 3164 - DNA, 201 bp, Homo sapiens; identical to SEQ ID NO: 3142

SEQ ID NO: 3165 - DNA, 201 bp, Homo sapiens; identical to SEQ ID NO: 3155

SEQ ID NO: 3166 - DNA, 201 bp, Homo sapiens; identical to SEQ ID NO: 3156

SEQ ID NO: 3167 - DNA, 201 bp, Homo sapiens; identical to SEQ ID NO: 3157

SEQ ID NO: 3168 - DNA, 201 bp, Homo sapiens; identical to SEQ ID NO: 3143

SEQ ID NO: 3169 - DNA, 201 bp, Homo sapiens; identical to SEQ ID NO: 3144

SEQ ID NO: 3170 - DNA, 201 bp, Homo sapiens; identical to SEQ ID NO: 3145

SEQ ID NO: 3171 - DNA, 201 bp, Homo sapiens; identical to SEQ ID NO: 3146

SEQ ID NO: 3172 - DNA, 201 bp, Homo sapiens; identical to SEQ ID NO: 3138

SEQ ID NO: 3173 - DNA, 201 bp, Homo sapiens; identical to SEQ ID NO: 3139

SEQ ID NO: 3174 - DNA, 201 bp, Homo sapiens; identical to SEQ ID NO: 3140

SEQ ID NO: 3175 - DNA, 201 bp, Homo sapiens; identical to SEQ ID NO: 3141

SEQ ID NO: 3176 - DNA, 201 bp, Homo sapiens; identical to SEQ ID NO: 3142

SEQ ID NO: 3177 - DNA, 201 bp, Homo sapiens; identical to SEQ ID NO: 3144

SEQ ID NO: 3178 - DNA, 201 bp, Homo sapiens; identical to SEQ ID NO: 3143

SEQ ID NO: 3179 - DNA, 201 bp, Homo sapiens; identical to SEQ ID NO: 3157

SEQ ID NO: 3180 - DNA, 201 bp, Homo sapiens; identical to SEQ ID NO: 3145

SEQ ID NO: 3181 - DNA, 201 bp, Homo sapiens; identical to SEQ ID NO: 3146

SEQ ID NO: 3182 - DNA, 201 bp, Homo sapiens; identical to SEQ ID NO: 3147

SEQ ID NO: 3183 - DNA, 201 bp, Homo sapiens; identical to SEQ ID NO: 3148

SEQ ID NO: 3184 - DNA, 201 bp, Homo sapiens; identical to SEQ ID NO: 3149

SEQ ID NO: 3185 - DNA, 201 bp, Homo sapiens; identical to SEQ ID NO: 3150

SEQ ID NO: 3186 - DNA, 201 bp, Homo sapiens; identical to SEQ ID NO: 3151

SEQ ID NO: 3187 - DNA, 201 bp, Homo sapiens; identical to SEQ ID NO: 3153

SEQ ID NO: 3188 - DNA, 201 bp, Homo sapiens; identical to SEQ ID NO: 3152

SEQ ID NO: 3189 - DNA, 201 bp, Homo sapiens; identical to SEQ ID NO: 3154

SEQ ID NO: 3190 - DNA, 201 bp, Homo sapiens; identical to SEQ ID NO: 3155

SEQ ID NO: 3191 - DNA, 201 bp, Homo sapiens; identical to SEQ ID NO: 3156

SEQ ID NO: 3192 - DNA, 201 bp, Homo sapiens
tgaagttcatgctcatcgtgaaagctaccaaactgttccctgtgggctacaacctcatgaagccattcctgagtgaggacactcgcaggaaaattattgtrttgggaaataactggaaggaaggtttgctgaaactcatcagtcctgaggaactgcctgcccagtttgggggcaccctgactgacccagatgggaacccca

SEQ ID NO: 3193 - DNA, 201 bp, Homo sapiens
ttctcaggtggcagttctcatctgatggtgcggacatcggcttcggagttttcctgaagaccaagatgggggagcgacagcgggcaggggagatgacagakgttctacccagccagcgctataacgcccacatggtgcccgaggatgggaacctcacctgctcagaggccggcgtctgtgtgagacaatgggatgtaatga

SEQ ID NO: 3194 - DNA, 201 bp, Homo sapiens
agtacgagcactcggtgcagatcaaccgcggctcatcacaccaagtggaatacgagatcctatttccaggctgcgttctcaggtggcagttctcatctgayggtgcggacatcggcttcggagttttcctgaagaccaagatgggggagcgacagcgggcaggggagatgacagatgttctacccagccagcgctataacg

SEQ ID NO: 3195 - DNA, 201 bp, Homo sapiens
agatcaaccgcggctcatcacaccaagtggaatacgagatcctatttccaggctgcgttctcaggtggcagttctcatctgatggtgcggacatcggcttyggagttttcctgaagaccaagatgggggagcgacagcgggcaggggagatgacagatgttctacccagccagcgctataacgcccacatggtgcccgagg

SEQ ID NO: 3196 - DNA, 201 bp, Homo sapiens
aattacccagagaccctgaagttcatgctcatcgtgaaagctaccaaactgttccctgtgggctacaacctcatgaagccattcctgagtgaggacactcrcaggaaaattattgtgttgggaaataactggaaggaaggtttgctgaaactcatcagtcctgaggaactgcctgcccagtttgggggcaccctgactgac

SEQ ID NO: 3197 - DNA, 201 bp, Homo sapiens
catatccttgattggcagcccccagaggtgatccagaagtacatgcctgggggcctgtgtggctatgaccgtgatggctgccccgtgtggtatgacatcaytgggccacttgatcccaaggggttgctcttctcagtcaccaagcaggacctgctcaagaccaagatgagggactgtgagcgcatcctgcatgagtgtgac

SEQ ID NO: 3198 - DNA, 201 bp, Homo sapiens
ctcagaggccggcgtctgtgtgagacaatgggatgtaatgaccattgttctcgatgccagtaaagccatgcctgggcacatgccaagaggagatgtcctaygcttcgacaacacctatagctttgtccacgccaagaaggtcagcttcacagtggaggtcctgctccctgacgagggcatgcagaaatatgataaggagct

SEQ ID NO: 3199 - DNA, 201 bp, Homo sapiens; identical to SEQ ID NO: 3192

SEQ ID NO: 3200 - DNA, 201 bp, Homo sapiens
ttctcaggtggcagttctcatctgatggtgcggacatcggcttcggagttttcctgaagaccaagatgggggagcgacagcgggcaggggagatgacagakgttctacccagccagcgctataacgcccacatggtgcccgaggatgggaacctcacctgctcagaggccggcgtctatgtcctacgcttcgacaacacct

SEQ ID NO: 3201 - DNA, 201 bp, Homo sapiens; identical to SEQ ID NO: 3194

SEQ ID NO: 3202 - DNA, 201 bp, Homo sapiens; identical to SEQ ID NO: 3195

SEQ ID NO: 3203 - DNA, 201 bp, Homo sapiens; identical to SEQ ID NO: 3196

SEQ ID NO: 3204 - DNA, 201 bp, Homo sapiens; identical to SEQ ID NO: 3197

SEQ ID NO: 3205 - DNA, 201 bp, Homo sapiens
aggggagatgacagatgttctacccagccagcgctataacgcccacatggtgcccgaggatgggaacctcacctgctcagaggccggcgtctatgtcctaygcttcgacaacacctatagctttgtccacgccaagaaggtcagcttcacagtggaggtcctgctccctgacgagggcatgcagaaatatgataaggagct

SEQ ID NO: 3206 - DNA, 201 bp, Homo sapiens
tgctaggaaatggctccctgatctatcaggccgtgggtatctgccctgggctgggtgcccgaggggctcatatgctgctgcagaatgagctcttcctgaaygtgggcaccaaggacttcccagacggagagcttcgggggcacgtggctgccctgccctactgtgggcatagcgcccgccatgacacgctgcccgtgcccc

SEQ ID NO: 3207 - DNA, 201 bp, Homo sapiens
cccagctgggggaccccatgcaggctgatgggccccggggctgccgttttgctgggcagtggttcccagagagtcagagctggcacccctcagtgcccccktttggagagatgagctgtatcacctgcagatgtggggcaggggtgcctcactgtgagcgggatgactgttcactgccactgtcctgtggctcggggaagg

SEQ ID NO: 3208 - DNA, 201 bp, Homo sapiens
cccaggagcgcagcagttcggagcggcagccgagcggcctgtccttcgagtatccgcgggacccggagcatcgcagttatagcgaccgcggggagccaggmgctgaggagcgggcccgtggtgacggccacacggacttcgtggcgctgctgacagggccgaggtcgcaggcggtggcacgagcccgagtctcgctgctgc

SEQ ID NO: 3209 - DNA, 201 bp, Homo sapiens
cgcgccagctgccgggacactgctgccagacctgcccccaggagcgcagcagttcggagcggcagccgagcggcctgtccttcgagtatccgcgggacccsgagcatcgcagttatagcgaccgcggggagccaggcgctgaggagcgggcccgtggtgacggccacacggacttcgtggcgctgctgacagggccgaggt

SEQ ID NO: 3210 - DNA, 201 bp, Homo sapiens
agcccaggaaccaggctttgctgaggtgctgcccaacctgacagtccaggagatggactggctggtgctgggggagctgcagatggccctggagtgggcargcaggccagggctgcgcatcagtggacacattgctgccaggaagagctgcgacgtcctgcaaagtgtcctttgtggggctgatgccctgatcccagtcca

SEQ ID NO: 3211 - DNA, 201 bp, Homo sapiens
gcggctgctgaagggattctatggctcagaggcccagggtgtggtgaaggacctggagccggaactgctgcggcacctggcaaaaggcatggcctccctgmtgatcaccaccaagggtagccccagaggggagctccgagggcaggtgcacatagccaaccaatgtgaggttggcggactgcgcctggaggcggccggggc

SEQ ID NO: 3212 - DNA, 201 bp, Homo sapiens
caagaacatcaaaccagagtgcccaaccccggcctgtgggcagccgcgccagctgccgggacactgctgccagacctgcccccaggagcgcagcagttcgragcggcagccgagcggcctgtccttcgagtatccgcgggacccggagcatcgcagttatagcgaccgcggggagccaggcgctgaggagcgggcccgtgg

SEQ ID NO: 3213 - DNA, 201 bp, Homo sapiens
gtggctcagaacaaggcactgtcactgcccacctccttgggcctcctggaacgccagggcctcggcggctgctgaagggattctatggctcagaggcccarggtgtggtgaaggacctggagccggaactgctgcggcacctggcaaaaggcatggcctccctgatgatcaccaccaagggtagccccagaggggagctcc

SEQ ID NO: 3214 - DNA, 201 bp, Homo sapiens
gtcccgttcgcgtcatgccgagcctcccggccccgccggccccgctgctgctcctcgggctgctgctgctcggctcccggccggcccgcggcgccggcccmgagccccccgtgctgcccatccgttctgagaaggagccgctgcccgttcggggagcggcaggctgcaccttcggcgggaaggtctatgccttggacgaga

SEQ ID NO: 3215 - DNA, 201 bp, Homo sapiens
ggacgagacgtggcacccggacctaggggagccattcggggtgatgcgctgcgtgctgtgcgcctgcgaggcgcctcagtggggtcgccgtaccaggggcyctggcagggtcagctgcaagaacatcaaaccagagtgcccaaccccggcctgtgggcagccgcgccagctgccgggacactgctgccagacctgccccca

SEQ ID NO: 3216 - DNA, 201 bp, Homo sapiens
tggctggactccagccaggaggacacacggccgtgggtatctgccctgggctgggtgcccgaggggctcatatgctgctgcagaatgagctcttcctgaaygtgggcaccaaggacttcccagacggagagcttcgggggcacgtggctgccctgccctactgtgggcatagcgcccgccatgacacgctgcccgtgcccc

SEQ ID NO: 3217 - DNA, 201 bp, Homo sapiens; identical to SEQ ID NO: 3207

SEQ ID NO: 3218 - DNA, 201 bp, Homo sapiens; identical to SEQ ID NO: 3208

SEQ ID NO: 3219 - DNA, 201 bp, Homo sapiens; identical to SEQ ID NO: 3209

SEQ ID NO: 3220 - DNA, 201 bp, Homo sapiens; identical to SEQ ID NO: 3210

SEQ ID NO: 3221 - DNA, 201 bp, Homo sapiens; identical to SEQ ID NO: 3211

SEQ ID NO: 3222 - DNA, 201 bp, Homo sapiens; identical to SEQ ID NO: 3212

SEQ ID NO: 3223 - DNA, 201 bp, Homo sapiens; identical to SEQ ID NO: 3213

SEQ ID NO: 3224 - DNA, 201 bp, Homo sapiens; identical to SEQ ID NO: 3214

SEQ ID NO: 3225 - DNA, 201 bp, Homo sapiens; identical to SEQ ID NO: 3215

SEQ ID NO: 3226 - DNA, 201 bp, Homo sapiens; identical to SEQ ID NO: 3216

SEQ ID NO: 3227 - DNA, 201 bp, Homo sapiens; identical to SEQ ID NO: 3211

SEQ ID NO: 3228 - DNA, 201 bp, Homo sapiens; identical to SEQ ID NO: 3207

SEQ ID NO: 3229 - DNA, 201 bp, Homo sapiens; identical to SEQ ID NO: 3208

SEQ ID NO: 3230 - DNA, 201 bp, Homo sapiens; identical to SEQ ID NO: 3214

SEQ ID NO: 3231 - DNA, 201 bp, Homo sapiens; identical to SEQ ID NO: 3213

SEQ ID NO: 3232 - DNA, 201 bp, Homo sapiens; identical to SEQ ID NO: 3212

SEQ ID NO: 3233 - DNA, 201 bp, Homo sapiens; identical to SEQ ID NO: 3215

SEQ ID NO: 3234 - DNA, 201 bp, Homo sapiens; identical to SEQ ID NO: 3210

SEQ ID NO: 3235 - DNA, 201 bp, Homo sapiens; identical to SEQ ID NO: 3209

SEQ ID NO: 3236 - DNA, 201 bp, Homo sapiens; identical to SEQ ID NO: 3216

SEQ ID NO: 3237 - DNA, 105 bp, Homo sapiens
aacaygtgagaaggttagggagagcacctgtctcagaaaggcccacatgtgcggccttgcaggactaacccaggttcccttgaggctccagattctacaccaggg

SEQ ID NO: 3238 - DNA, 201 bp, Homo sapiens; identical to SEQ ID NO: 3211

SEQ ID NO: 3239 - DNA, 106 bp, Homo sapiens
aacacrtgagaaggttagggagagcacctgtctcagaaaggcccacatgtgcggccttgcaggactaacccaggttcccttgaggctccagattctacaccagggg

SEQ ID NO: 3240 - DNA, 201 bp, Homo sapiens; identical to SEQ ID NO: 3213

SEQ ID NO: 3241 - DNA, 201 bp, Homo sapiens
tccccaggaaccaggctttgctgaggtgctgcccaacctgacagtccaggagatggactggctggtgctgggggagctgcagatggccctggagtgggcargcaggccagggctgcgcatcagtggacacattgctgccaggaagagctgcgacgtcctgcaaagtgtcctttgtggggctgatgccctgatcccagtcca

SEQ ID NO: 3242 - DNA, 201 bp, Homo sapiens; identical to SEQ ID NO: 3216

SEQ ID NO: 3243 - DNA, 201 bp, Homo sapiens; identical to SEQ ID NO: 3207

SEQ ID NO: 3244 - DNA, 201 bp, Homo sapiens; identical to SEQ ID NO: 3208

SEQ ID NO: 3245 - DNA, 201 bp, Homo sapiens; identical to SEQ ID NO: 3209

SEQ ID NO: 3246 - DNA, 201 bp, Homo sapiens; identical to SEQ ID NO: 3210

SEQ ID NO: 3247 - DNA, 201 bp, Homo sapiens; identical to SEQ ID NO: 3211

SEQ ID NO: 3248 - DNA, 201 bp, Homo sapiens; identical to SEQ ID NO: 3212

SEQ ID NO: 3249 - DNA, 201 bp, Homo sapiens; identical to SEQ ID NO: 3213

SEQ ID NO: 3250 - DNA, 201 bp, Homo sapiens; identical to SEQ ID NO: 3214

SEQ ID NO: 3251 - DNA, 201 bp, Homo sapiens; identical to SEQ ID NO: 3215

SEQ ID NO: 3252 - DNA, 201 bp, Homo sapiens; identical to SEQ ID NO: 3214

SEQ ID NO: 3253 - DNA, 201 bp, Homo sapiens; identical to SEQ ID NO: 3206

SEQ ID NO: 3254 - DNA, 201 bp, Homo sapiens; identical to SEQ ID NO: 3207

SEQ ID NO: 3255 - DNA, 201 bp, Homo sapiens; identical to SEQ ID NO: 3208

SEQ ID NO: 3256 - DNA, 201 bp, Homo sapiens; identical to SEQ ID NO: 3209

SEQ ID NO: 3257 - DNA, 201 bp, Homo sapiens; identical to SEQ ID NO: 3210

SEQ ID NO: 3258 - DNA, 201 bp, Homo sapiens; identical to SEQ ID NO: 3211

SEQ ID NO: 3259 - DNA, 201 bp, Homo sapiens; identical to SEQ ID NO: 3212

SEQ ID NO: 3260 - DNA, 201 bp, Homo sapiens; identical to SEQ ID NO: 3213

SEQ ID NO: 3261 - DNA, 201 bp, Homo sapiens; identical to SEQ ID NO: 3214

SEQ ID NO: 3262 - DNA, 201 bp, Homo sapiens; identical to SEQ ID NO: 3215

SEQ ID NO: 3263 - DNA, 162 bp, Homo sapiens
agcagctcttcataagccggcgctcggcgagttctcccaggagaaggccatgttcagttcgrgcgccaagatcgtgaaacccaacggcgagaagccggaggagttcgagtccggcatctcccaggctcttctggagctggagatgaactcagaactcaaggc

SEQ ID NO: 3264 - DNA, 201 bp, Homo sapiens
tgccatccttgaggacttggtcttcccaagtgaaattgtgggcaagaaaatccgcgtcaaactagatggcagccggctcataaaggttcatttggacaaarcacaacagaacaatgtggaacacaaggttgaaactttttctggtgtctataagaagctcatgggcaaggatgttaattgtgaattcccagagtttcaata

SEQ ID NO: 3265 - DNA, 201 bp, Homo sapiens
ggtggtcggaaagctatcataatacttgttcccgttactcaactgaaatctttccagaaaatccaaatccggctagtaagtgaattggagaaaaagttcaktgggaagcatgtcgtctttatcgctcagaggagaattctgcctaagccaactcgaaaaagctgtacaaaaaataagcaaaagcgtcccaggagcagcact

SEQ ID NO: 3266 - DNA, 201 bp, Homo sapiens
cccaggagcagcactgtgacagctgtgcacgatgccatccttgaggacttggtcttcccaagtgaaattgtgggcaagaaaatccgcgtcaaactagatgrcagccggctcataaaggttcatttggacaaagcacaacagaacaatgtggaacacaaggttgaaactttttctggtgtctataagaagctcatgggcaag

SEQ ID NO: 3267 - DNA, 201 bp, Homo sapiens
tcagttcgagcgccaagatcgtgaaacccaacggcgagaagccggaggagttcgagtccggcatctcccaggctcttctggagctggagatgaactcagamctcaaggctcagctcagagagctgaatattacggcagccaaggaaattgaagttggtggtggtcggaaagctatcataatacttgttcccgttactcaac

SEQ ID NO: 3268 - DNA, 201 bp, Homo sapiens
agcgacggcgctacggcatgaatgcagccatcaacacgggccctgcccctgctgtcaccaagactgagactgaggtccagaatccagatgttctgtgggakttggacatccccgaaggcaggagccatgctgaccaagacagcaaccccaaggcggaagcccctgctcccctgcaacctgcactgcagctggctccacagc

SEQ ID NO: 3269 - DNA, 201 bp, Homo sapiens
ctgaaccactctgtctcctatcctttggccacctgtcctgaaaggaatgttctcttccattccctcctgaatctggcccaggaagaccatagcttcaatgycaagccttttccttcagaactgtagcctcctctcactgaaggtgggagctgcaggaatcaggtgcagagtaggaaatggaactaacctcaggaaggtggt

SEQ ID NO: 3270 - DNA, 180 bp, Homo sapiens
ctgaaaggaatgttctcttccattccctcctgaatctggcccaggaagaccatagcttcaatgccaagccttttccttcagaactgtagcctcctctcacygaaggtgggagctgcaggaatcaggtgcagagtaggaaatggaactaacctcaggaaggtggtattgacagaggtcagg

SEQ ID NO: 3271 - DNA, 201 bp, Homo sapiens
ggcagatgggtgggtgagttccctctccccagagccatcggccaggtaccaaagctcagctgtatggattcccaacaggaggacctgcgcttccctgggargtgggtctcattgtactttggaatcctggggctgtgttctgtgataactggagggtgcattatctttctgcactggaggaagaacttgaggcgggaagag

SEQ ID NO: 3272 - DNA, 201 bp, Homo sapiens
ggcccaggttcgtggctctcgcgttccccggggtctgggcctgcgccggcggcggggcgtcttccacccagtgatgtggcgatgcctcccgggctcatggyggaatgtcgggtcggcttcgcgctgggcccacggcctcctcccggtgagacgccctcagggctcccccatctcagcgcccgggacgccgcagccatctcg

SEQ ID NO: 3273 - DNA, 201 bp, Homo sapiens
ggtttcaaagaggccaagacgtccgtggcttccttcaggagaaagcggcaaaacccacgcccagatccgttgtgctttcagcttttcaccaggaaactcarttttctatgtaagagcaagcgagttccacagcgcggggaggccagtggagaggagcgcggccttgcctggctcatgtcctgtttccagcttgccctgaaa

SEQ ID NO: 3274 - DNA, 201 bp, Homo sapiens
ccagtgatgtggcgatgcctcccgggctcatgggggaatgtcgggtcggcttcgcgctgggcccacggcctcctcccggtgagacgccctcagggctcccmcatctcagcgcccgggacgccgcagccatctcggtgggctgaagggaagtaagattcttgcagagggcgcctgccccagaaaacaaatttcatgtacagg

SEQ ID NO: 3275 - DNA, 148 bp, Homo sapiens
cttcttctctcaagtcctcacacaggtattcaggaataccaggatggygtgcccaagattccaacagcctgtattacggtggaagatgcagaaatgatgtcaagaatggcttctcatgggatcaaaattgtcattcagctaaagatgg

SEQ ID NO: 3276 - DNA, 159 bp, Homo sapiens
aggaatcattctcccctccctcccaccacatagaatcaacatatggtagggattacagtgggggcatttctttatatcacctcttaaaaacattgtttccmctttaaaagtaaacacttaataaatttttggaagatctctgatttttatgtgttcatt

SEQ ID NO: 3277 - DNA, 201 bp, Homo sapiens
ttcaaagcacaactctatttcatgctttctgttattatctttcttgatactttccaaattctctgattctagaaaaaggaatcattctcccctccctcccmccacatagaatcaacatatggtagggattacagtgggggcatttctttatatcacctcttaaaaacattgtttccactttaaaagtaaacacttaataaa

SEQ ID NO: 3278 - DNA, 201 bp, Homo sapiens
tggaagctgccaaggtgggggctttggcatctctcattcgatccgtggcctccttctccatctacagtcctcacacaggtattcaggaataccaggatggygtgcccaagattccaacagcctgtattacggtggaagatgcagaaatgatgtcaagaatggcttctcatgggatcaaaattgtcattcagctaaagatgg

SEQ ID NO: 3279 - DNA, 201 bp, Homo sapiens
ctggagccagtgagaataccccactgggagaggggagaagaatcagctgtgatgctggagccaagaattcataagatagccatcctgggtcttggcagcarcattgggactcctccagaaggcattacagcagaagttctggtggtgacctctttcgatgaactgcagagaagggcctcagaagcaagagggaagattgtt

SEQ ID NO: 3280 - DNA, 201 bp, Homo sapiens
cagaagcaagagggaagattgttgtttataaccaaccttacatcaactactcaaggacggtgcaataccgaacgcagggggcggtggaagctgccaaggtkggggctttggcatctctcattcgatccgtggcctccttctccatctacagtcctcacacaggtattcaggaataccaggatggcgtgcccaagattccaa

SEQ ID NO: 3281 - DNA, 159 bp, Homo sapiens; identical to SEQ ID NO: 3276

SEQ ID NO: 3282 - DNA, 201 bp, Homo sapiens; identical to SEQ ID NO: 3277

SEQ ID NO: 3283 - DNA, 201 bp, Homo sapiens
gactgagtggctccaagaacctagaaaaagccatccaaattatgtaccaaaacctgcagcaagatgggctggagaaagttcacctggagccagtgagaatmccccactgggagaggggagaagaatcagctgtgatgctggagccaagaattcataagatagccatcctgggtcttggcagcagcattgggactcctccag

SEQ ID NO: 3284 - DNA, 201 bp, Homo sapiens
attccttatcttcgcatttttcggtggtgttcaccttttatccctgtgctctgggaaagctatatgcaagaatggcatctctaagaggacttttgaagaartaaaagaagaaatagccagctgtggagatgttgctaaagcaatcatcaacctagctgtttatggtaaagcccagaacagatcctatgagcgattggcact

SEQ ID NO: 3285 - DNA, 201 bp, Homo sapiens; identical to SEQ ID NO: 3278

SEQ ID NO: 3286 - DNA, 201 bp, Homo sapiens; identical to SEQ ID NO: 3279

SEQ ID NO: 3287 - DNA, 201 bp, Homo sapiens; identical to SEQ ID NO: 3280

SEQ ID NO: 3288 - DNA, 201 bp, Homo sapiens
gagccacagcccagaagctgagaagccttccggccgatctgtggccctgaggtcgcccttggagggcgagtgagaaccccccaggcgttccggaggtggcscccagcccgaacccggcgcccgccccggcttcccgagtcaggtctttgccccgcctctcggccccgcggcctggccggcaagcagggctgcagtcacggg

SEQ ID NO: 3289 - DNA, 159 bp, Homo sapiens; identical to SEQ ID NO: 3276

SEQ ID NO: 3290 - DNA, 201 bp, Homo sapiens; identical to SEQ ID NO: 3277

SEQ ID NO: 3291 - DNA, 201 bp, Homo sapiens; identical to SEQ ID NO: 3283

SEQ ID NO: 3292 - DNA, 201 bp, Homo sapiens; identical to SEQ ID NO: 3284

SEQ ID NO: 3293 - DNA, 201 bp, Homo sapiens
gggatttggagcagacattggaatagaaaagtttcttaacatcaaatcccagtattccggtctccaccctcacgtggtggtgcttgttgccactgtcagcrctctaaagatgcacaggggtggccctatggtcactgctggaatgcctcttcccaaggcttacatagaggagaacctggagctggttgaaaaaggcttcag

SEQ ID NO: 3294 - DNA, 201 bp, Homo sapiens
gcctaaaggatgcttggaactcatgaaagagacaggggtgcagattgccagaaggcatgctgtggtggttgggtgcagtaaaatagtcagggccctgatgygtgacttgcttctgtggaacaatgccacagtgaccacctgccactccaagactgccaatctggatgaggaggtaaataaaggcgacatcctggtggttgc

SEQ ID NO: 3295 - DNA, 201 bp, Homo sapiens
gcttctgtggaacaatgccacagtgaccacctgccactccaagactgccaatctggatgaggaggtaaataaaggcgacatcctggtggttgcaactggtyggcctgaaatggttaaaggggaatggatcaaacctagcaatagtcatcaactgtggaatcaattatgtcccagatgataaaaaaaacaaatgggagaaaa

SEQ ID NO: 3296 - DNA, 201 bp, Homo sapiens
aagttgtgggtgatgtggcatacgacgaggcccgttcctggtggcttagggctcatgacggttgcaatgctcatgcagagcactgtagagagtgccaagcrtttcctggagaaatttaagccaggaaagtggatgattcagtataacaaccttaacctcaagacacctgttccaagtgacattgatatatcacgatcttgt

SEQ ID NO: 3297 - DNA, 201 bp, Homo sapiens
cccatctgcatggccaaaacacacttgtccttgtctcacaacccagagcgaaaaggtgtccctacaggattcattctgcccattcgcaacatccatgccarcatcggggctggttttctgtaccctttagtaggaacgatgagcacaatggactccccacccagccctgtttttatgatactgatttggaccctgaaacag

SEQ ID NO: 3298 - DNA, 201 bp, Homo sapiens
ctggagctggttgaaaaaggcttcagtaacttgaagaaacaaactgaaaatgccagaatgtttggaattccagtagtagtggccgtgaatgcattcaagayagatacagagactgagctggacctcatcggctgcctttccagagaacagagggcttttgatgccgtgaagtgcactcactggcagaagggggcaagggta

SEQ ID NO: 3299 - DNA, 201 bp, Homo sapiens
gattgggatgaaagccactgacattaagttaccaagaacaaccacagaatctgaggtgatcaagtacatcatatctttgaatgaagactctactgtacacrggttcgtagtgcagctatctctagactcagacaatacactgaaggagtgatcaatgctattgcacctgaaaaggatgtggatggattgactagcatcagt

SEQ ID NO: 3300 - DNA, 201 bp, Homo sapiens
gtcagcgctctaaagatgcacaggggtggccctatggtcactgctggaatgcctcttcccaaggcttacatagaggagaacctggagctggttgaaaaagkcttcagtaacttgaagaaacaaactgaaaatgccagaatgtttggaattccagtagtagtggccgtgaatgcattcaagacagatacagagactgagctg

SEQ ID NO: 3301 - DNA, 201 bp, Homo sapiens
agtggtgcattgatagtgcttatgaaggacacaatcaagcccaatctcatgcagagattggagggcactccagtgtttgtccatgcaggcccatttgccawcatcgcacacggcaattcctctatcattgcagaccggatcacactctagcttgttggcccagaagggtttgtagtgacggaggcgggatttggagcagac

SEQ ID NO: 3302 - DNA, 201 bp, Homo sapiens
ctctggcttcacgcctcgcgcgggcacaccttctcccgggcactgaggcccagttattaggggaggcagagtccttctggagtttgacccttggattccayccagagcagcctccaaaatgacacctttgaagttgtgtatcgagctgggggatgtaaagggaggagaagaaagaagatgaagagataccagccagcctta

SEQ ID NO: 3303 - DNA, 201 bp, Homo sapiens
tcctacactgctggtaaaaggcagccgcactgcctgctggaagacctgccagcttgggcttcagagcacttctgcctcagatccacgacgatcccttctgwcatcgtgggacctttcctgggatttgatttagggcgacgcttcctcctgtctgtgtcctgagtcctgccttccctggctggtcctctttgcttagtcacc

SEQ ID NO: 3304 - DNA, 201 bp, Homo sapiens
atgtctcctctcttctcacctgctgagaggtccttctgggcagggactcgggcagattcattcctgcctgccccacatttccctagcccagggcctggccygttgcagtgctgaaggatgattctggtaagaaacaaggtactccagctcacatcttgcaatgattatgcctcccccactctcccttctccttgcagttct

SEQ ID NO: 3305 - DNA, 201 bp, Homo sapiens
cagaagggggagaccaaggttccagctcaaccaataactattgcacaaccacctgtccctgcctcagttccctcttctgtaacatgaagtcgttgtgaggrttaaaggcagtaacaggtataaagtacttagaaaagcaaagggtgctacgtacatgtgaggcatcattacgcagacgtaactgggatatgtttactataa

SEQ ID NO: 3306 - DNA, 201 bp, Homo sapiens
catgccgcttgctccggagaagcccaggtgtggcctcactcacatcccactctgagtccaaatgttctctccctggaagatatcaatgtttctgtctgttygtgaggactccgtgcccaccacggcctctttcagcgccgacatgctcaatgtcaccttgcaagggcccactcttaacgggacctttgcccagagcaaatg

SEQ ID NO: 3307 - DNA, 201 bp, Homo sapiens
ggactgttcctgtctcagcaaccaagggattgttcctgtcaatcaatggtttattggaaggtggcccagtatgagccctagaagagtgtgaaaaggaatgrcaatggtgttcaccatcggcagtgccagggcagcactcattcacttgataaatgaatatttattagctggttggagagctagaacctggagagctagaac

SEQ ID NO: 3308 - DNA, 201 bp, Homo sapiens
gttccctcttctgtaacatgaagtcgttgtgagggttaaaggcagtaacaggtataaagtacttagaaaagcaaagggtgctacgtacatgtgaggcatcwttacgcagacgtaactgggatatgtttactataaggaaaagacactgaggtctagaaatagctccgtggagcagaatcagtattgggagccggtggcggt

SEQ ID NO: 3309 - DNA, 201 bp, Homo sapiens
agcacttgctgtatatgcagtattgagcactgtaggcaagagggaagaaagagaaggagccatctccatcttgaaggaactcaaagactcaagtgggaacractgggcactgccaccaccagaaagctgttcgacgagacggtcgagcagggtgctgtgggtgatatggacagcagaagggggagaccaaggttccagctc

SEQ ID NO: 3310 - DNA, 201 bp, Homo sapiens
tgaacctggagggctagaacctggagaatgagaaaaatttacatggcaaagagcccataaatcctgaccaatccaactctgaattttaaagcaaaagcgtsaaaaaaaagattccctccttacccccaacccactcttttttcccaccacccactctcctctgcctcagtaagtatctggaggaagaaaacaggtgaaaga

SEQ ID NO: 3311 - DNA, 201 bp, Homo sapiens
tattcatcatctgctggctgcccttccagatcagcaccttcctggatacgctgcatcgcctcggcatcctctccagctgccaggacgagcgcatcatcgaygtaatcacacagatcgcctccttcatggcctacagcaacagctgcctcaacccactggtgtacgtgatcgtgggcaagcgcttccgaaagaagtcttggg

SEQ ID NO: 3312 - DNA, 174 bp, Homo sapiens
cttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaagcccaggtgtggcctcactcacatccc

SEQ ID NO: 3313 - DNA, 201 bp, Homo sapiens
agtggaggaggcctgggggcagggagaggagtgactgagcttccctcccgtgtgttctccgtccctgccccagcaagacaacttagatctccaggagaacygccatccagctttggtgcaatggctgagtgcacaagtgagttgttgccctgggtttctttaatctattcagctagaactttgaaggacaatttcttgcat

SEQ ID NO: 3314 - DNA, 201 bp, Homo sapiens
tgggcttcctgctgcccctgagtgtcatcaccttctgcacgatgcagatcatgcaggtgctgcggaacaacgagatgcagaagttcaaggagatccagacrgagaggagggccacggtgctagtcctggttgtgctgctgctattcatcatctgctggctgcccttccagatcagcaccttcctggatacgctgcatcgcc

SEQ ID NO: 3315 - DNA, 201 bp, Homo sapiens
agctgttcgacgagacggtcgagcagggtgctgtgggtgatatggacagcagaagggggagaccaaggttccagctcaaccaataactattgcacaaccayctgtccctgcctcagttccctcttctgtaacatgaagtcgttgtgagggttaaaggcagtaacaggtataaagtacttagaaaagcaaagggtgctacgt

SEQ ID NO: 3316 - DNA, 201 bp, Homo sapiens
gcctacagcaacagctgcctcaacccactggtgtacgtgatcgtgggcaagcgcttccgaaagaagtcttgggaggtgtaccagggagtgtgccagaaagrgggctgcaggtcagaacccattcagatggagaactccatgggcacactgcggacctccatctccgtggaacgccagattcacaaactgcaggactgggca

SEQ ID NO: 3317 - DNA, 201 bp, Homo sapiens
ggggagaccaaggttccagctcaaccaataactattgcacaaccacctgtccctgcctcagttccctcttctgtaacatgaagtcgttgtgagggttaaargcagtaacaggtataaagtacttagaaaagcaaagggtgctacgtacatgtgaggcatcattacgcagacgtaactgggatatgtttactataaggaaaa

SEQ ID NO: 3318 - DNA, 186 bp, Homo sapiens
gctcaatctgttaacaggcttctggcatgtagatcagtggtctccaagcttttgtgattgtatattcctataggaaaaaaagaattgattatgcatacccrgtatgtatacttattaatctgtatgaagatgtacattctaaaatataatcaaccagtagaaatttaagaaagaagatgtaaaaaa

SEQ ID NO: 3319 - DNA, 201 bp, Homo sapiens
ttgggagccggtggcggtgtgaagcaccagtgtctggcacacagtaggtgctcattggctcccttccacctgtcattcccaccaccctgaggccccaaccrccacacacacaggagcatttggagagaaggccatgtcttcaaagtctgatttgtgatgaggcagaggaagatatttctaatcggtcttgcccagaggatc

SEQ ID NO: 3320 - DNA, 201 bp, Homo sapiens
aaaagcaaagggtgctacgtacatgtgaggcatcattacgcagacgtaactgggatatgtttactataaggaaaagacactgaggtctagaaatagctccrtggagcagaatcagtattgggagccggtggcggtgtgaagcaccagtgtctggcacacagtaggtgctcattggctcccttccacctgtcattcccacca

SEQ ID NO: 3321 - DNA, 201 bp, Homo sapiens
ggtataaagtacttagaaaagcaaagggtgctacgtacatgtgaggcatcattacgcagacgtaactgggatatgtttactataaggaaaagacactgagktctagaaatagctccgtggagcagaatcagtattgggagccggtggcggtgtgaagcaccagtgtctggcacacagtaggtgctcattggctcccttcca

SEQ ID NO: 3322 - DNA, 201 bp, Homo sapiens; identical to SEQ ID NO: 3305

SEQ ID NO: 3323 - DNA, 201 bp, Homo sapiens; identical to SEQ ID NO: 3306

SEQ ID NO: 3324 - DNA, 201 bp, Homo sapiens; identical to SEQ ID NO: 3307

SEQ ID NO: 3325 - DNA, 201 bp, Homo sapiens; identical to SEQ ID NO: 3308

SEQ ID NO: 3326 - DNA, 153 bp, Homo sapiens
cagagctcagctggaggcggagggggaagtgcccaggaggctgatgacatcaytacccagcccttgaaagatgagctgttcccgccgccactccagctctggcttctgggctccgaggaggggtggggacggtggggacggtggggacatcag

SEQ ID NO: 3327 - DNA, 201 bp, Homo sapiens; identical to SEQ ID NO: 3309

SEQ ID NO: 3328 - DNA, 201 bp, Homo sapiens; identical to SEQ ID NO: 3310

SEQ ID NO: 3329 - DNA, 201 bp, Homo sapiens; identical to SEQ ID NO: 3311

SEQ ID NO: 3330 - DNA, 201 bp, Homo sapiens
ggaggctgatgacatcactacccagcccttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaagcccaggtgtggcctcactcacatccc

SEQ ID NO: 3331 - DNA, 201 bp, Homo sapiens; identical to SEQ ID NO: 3313

SEQ ID NO: 3332 - DNA, 201 bp, Homo sapiens; identical to SEQ ID NO: 3314

SEQ ID NO: 3333 - DNA, 201 bp, Homo sapiens; identical to SEQ ID NO: 3315

SEQ ID NO: 3334 - DNA, 133 bp, Homo sapiens
cagagctcagctggaggcggagggggaagtgcycaggaggctgatgacatcactacccagcccttgaaagatgagctgttcccgccgccactccagctctggcttctgggctccgaggaggggtggggacggt

SEQ ID NO: 3335 - DNA, 201 bp, Homo sapiens; identical to SEQ ID NO: 3316

SEQ ID NO: 3336 - DNA, 201 bp, Homo sapiens; identical to SEQ ID NO: 3317

SEQ ID NO: 3337 - DNA, 201 bp, Homo sapiens; identical to SEQ ID NO: 3319

SEQ ID NO: 3338 - DNA, 186 bp, Homo sapiens; identical to SEQ ID NO: 3318

SEQ ID NO: 3339 - DNA, 201 bp, Homo sapiens; identical to SEQ ID NO: 3320

SEQ ID NO: 3340 - DNA, 201 bp, Homo sapiens; identical to SEQ ID NO: 3321

SEQ ID NO: 3341 - DNA, 201 bp, Homo sapiens
ggagtgatgcttcggggctcaggcatccagtgggacctgcggaagacccagccctatgatgtttacgaccaggttgagtttgatgttcctgttggttctcraggggactgctatgataggtacctgtgccgggtggaggagatgcgccagtccctgagaattatcgcacagtgtctaaacaagatgcctcctggggagatc

SEQ ID NO: 3342 - DNA, 201 bp, Homo sapiens
ggcagatgtcgttgccatcataggtacccaagatattgtatttggagaagtagatcggtgagcaggggagcagcgtttgatcccccctgcctatcagcttyttctgtggagcctgttcctcactggaaattggcctctgtgtgtgtgtgtgtgtgtgtgtgtgtgtgtatgttcatgtacacttggctgtcaggctttctg

SEQ ID NO: 3343 - DNA, 201 bp, Homo sapiens
tggcagatgtcgttgccatcataggtacccaagatattgtatttggagaagtagatcggtgagcaggggagcagcgtttgatcccccctgcctatcagctycttctgtggagcctgttcctcactggaaattggcctctgtgtgtgtgtgtgtgtgtgtgtgtgtgtgtatgttcatgtacacttggctgtcaggctttct

SEQ ID NO: 3344 - DNA, 201 bp, Homo sapiens
atactgccattgaggctcccaagggagagtttggggtgtacctggtgtctgatggcagcagccgcccttatcgatgcaagatcaaggctcctggttttgcycatctggctggtttggacaagatgtctaagggacacatgttggcagatgtcgttgccatcataggtacccaagatattgtatttggagaagtagatcggt

SEQ ID NO: 3345 - DNA, 201 bp, Homo sapiens
tcctgttggttctcgaggggactgctatgataggtacctgtgccgggtggaggagatgcgccagtccctgagaattatcgcacagtgtctaaacaagatgsctcctggggagatcaaggttgatgatgccaaagtgtctccacctaagcgagcagagatgaagacttccatggagtcactgattcatcactttaagttgta

SEQ ID NO: 3346 - DNA, 201 bp, Homo sapiens
ggggccatgacccctttcttctggctgtttgaagaaagggagaagatgtttgagttctacgagcgagtgtctggagcccgaatgcatgctgcttatatccrgccaggaggagtgcaccaggacctaccccttgggcttatggatgacatttatcagttttctaagaacttctctcttcggcttgatgagttggaggagttg

SEQ ID NO: 3347 - DNA, 201 bp, Homo sapiens
gagcagcgtttgatcccccctgcctatcagcttcttctgtggagcctgttcctcactggaaattggcctctgtgtgtgtgtgtgtgtgtgtgtgtgtgtgkatgttcatgtacacttggctgtcaggctttctgtgcatgtactaaaaaaggagaaattataataaattagccgtcttgcggcccctaggcctaaacttct

SEQ ID NO: 3348 - DNA, 169 bp, Homo sapiens
gggacagagccccaggagaggcagagagtgagggaaagggcctggccggcatgcacagataggatcackgtcctgggagaattcctgctcttatagtctaacctaccatggcttctcttttctcaaggctccctcatgctgccctttggccctagtggctggtttccag

SEQ ID NO: 3349 - DNA, 201 bp, Homo sapiens
gccatgacccctttcttctggctgtttgaagaaagggagaagatgtttgagttctacgagcgagtgtctggagcccgaatgcatgctgcttatatccggcmaggaggagtgcaccaggacctaccccttgggcttatggatgacatttatcagttttctaagaacttctctcttcggcttgatgagttggaggagttgctg

SEQ ID NO: 3350 - DNA, 201 bp, Homo sapiens; identical to SEQ ID NO: 3341

SEQ ID NO: 3351 - DNA, 201 bp, Homo sapiens; identical to SEQ ID NO: 3342

SEQ ID NO: 3352 - DNA, 201 bp, Homo sapiens; identical to SEQ ID NO: 3343

SEQ ID NO: 3353 - DNA, 201 bp, Homo sapiens; identical to SEQ ID NO: 3344

SEQ ID NO: 3354 - DNA, 201 bp, Homo sapiens; identical to SEQ ID NO: 3345

SEQ ID NO: 3355 - DNA, 201 bp, Homo sapiens; identical to SEQ ID NO: 3346

SEQ ID NO: 3356 - DNA, 201 bp, Homo sapiens; identical to SEQ ID NO: 3347

SEQ ID NO: 3357 - DNA, 201 bp, Homo sapiens; identical to SEQ ID NO: 3349

SEQ ID NO: 3358 - DNA, 201 bp, Homo sapiens
cttcctccttcacaaggagattctcaatcacttgacattccaaacactgctgattctttgggagggctgtcctttgagccagggttggtcagaacctgtartaatcctgtttgtcctccaaatcacgtagtgtccctaacgaacaatctcattggtaggcgggttcccacagatcttcagatctaaacagcggttggcttt

SEQ ID NO: 3359 - DNA, 201 bp, Homo sapiens
acaaaatgtagccaaataccagagcacatctgcaaattcactgaagcgactcccttctgcccctgattataatctgttagtggaaaagcaaacacacactycagtgtaccctagtttaaattcatcttctgtattccagccaaatcctgacaatcatagtgtaaatgatgagaaatgcattttggatgaacaggaaactgt

SEQ ID NO: 3360 - DNA, 201 bp, Homo sapiens
cttagagctacatggggttcctctacagaacatgaaaaccgggggtcacctcctaaaggtaacctcaagggccagttcagaaagggcacagtcagaacccytcctccttcacaaggagattctcaatcacttgacattccaaacactgctgattctttgggagggctgtcctttgagccagggttggtcagaacctgtaat

SEQ ID NO: 3361 - DNA, 201 bp, Homo sapiens
cagttcaaacaataacaaagacactcataaaatatttggaaaagaacttaatggtaaccagttaatggaaaaaagagaaactgaaggcaaagacagcaaayggaactactactctagaggtcaccgttctattccaggtgttgctatagatggagagaacaacatgaggcagtcaccccaaacagttttctccttgccagc

SEQ ID NO: 3362 - DNA, 201 bp, Homo sapiens
aggaactactactctagaggtcaccgttctattccaggtgttgctatagatggagagaacaacatgaggcagtcaccccaaacagttttctccttgccagytaactgcgattggaaaccgcggtggcttagagctacatggggttcctctacagaacatgaaaaccgggggtcacctcctaaaggtaacctcaagggccag

SEQ ID NO: 3363 - DNA, 201 bp, Homo sapiens
tctccttgccagctaactgcgattggaaaccgcggtggcttagagctacatggggttcctctacagaacatgaaaaccgggggtcacctcctaaaggtaayctcaagggccagttcagaaagggcacagtcagaacccttcctccttcacaaggagattctcaatcacttgacattccaaacactgctgattctttgggag

SEQ ID NO: 3364 - DNA, 201 bp, Homo sapiens
actaagaaaggtttgctttaagaaatagtgctcccttcagaatggaagaatttatctgcctcttatttgatgtggatcagagctaagatggctgactaaaraaacatgggggactggaatctccttggagatactctggaggaagttcacatccactccaccatgattggaaagatctggctcaccatcctgttcatattt

SEQ ID NO: 3365 - DNA, 201 bp, Homo sapiens
acaatgcaagacctggatatattgaatgtgaagagcacgttccagtttggtatcctggctcccacaccctcccctcactctggctcagggccctcaatcaygatccttccccagaatccagacctggccatacctgatgaagagggtgcacaggaggaagatgatgaggcccacaatgctcggggcatcccaccactgggt

SEQ ID NO: 3366 - DNA, 201 bp, Homo sapiens
aagagggtgcacaggaggaagatgatgaggcccacaatgctcggggcatcccaccactgggtctcatagccctcggggcctgccacaactgtctcgttgcycagctgggttggcaaatgggggttgcatttctgttctggagatgggagcacaatcaccctcagcccatgcaggccaggcctaggtagccaagtggccctg

SEQ ID NO: 3367 - DNA, 201 bp, Homo sapiens
ggctgtcagtgatgctgacatgcgaaagcagataaagcatatgatggctttcattgaataagaagccaatgagaaagcagaagaaatagatgcaaaggcaraagaagagttcaacatagagaaaggtcagcttgtggaaacccaaagactaaagattatggaatatcatgagaagaaagagaaacagattgagtagcagaa

SEQ ID NO: 3368 - DNA, 201 bp, Homo sapiens
aaaacaatgttgatgtccaaatcgaccaggagtcctacctgcctgaggacatagctggtggagttgagatctataatggtaatcataaaataaaggtttcyaaaaccccagaaagccagctggatctcatagcccagcagatgatgctagaagtccagggagccttctttggtgcaaaagccaacaggaaatttttggact

SEQ ID NO: 3369 - DNA, 201 bp, Homo sapiens
actcagcaaggtggtaaaagatacaaccaggtaccaagtgctgctagatggactggttctccagggtttgtaccagttgctggagcaccgaatgattgttygttgcaggaaacaagaccttcctctggtaaaggctgcggtgcaaaaggcaatccctatgtacaaaattgccaccaaaaacaatgttgatgtccaaatcga

SEQ ID NO: 3370 - DNA, 201 bp, Homo sapiens
gatgatgagaacttcatcctaaaacatacaggtcctggcatcttgtccacggcaaatgctggacccaacacaaattgttcctggtttttcatctccattgmgaagactgagagtttggatggccagcacgtggtctttggcaatatgaaagaaggcatgaatgttgtggaggccatggagccctttgggttcaggaatggc

SEQ ID NO: 3371 - DNA, 201 bp, Homo sapiens
agttttcatcagtgcctgtatctgtggtcagcgatagctatgacatttataatgcgtgtgagaaaatatggggtgaagatctaagacatttaatagtatcragaagtacacaggcaccactaataatcagacctgattctggaaaccctcttgacactgtgttaaaggttttggagattttaggtaagaagtttcctgtta

SEQ ID NO: 3372 - DNA, 201 bp, Homo sapiens
tgctttcccactactccagcctaaggtaaacagctgcaatagaagccaaatgagaatcgcaaagcccaaaatgtttattaacctgccctttacacaaaatyacacaaaaagtttcctgatctctgttctaagaaaaggagtgtgccttgcatttaaaaggaaatgttggtttctagggaagggaggaggctaaataattga

SEQ ID NO: 3373 - DNA, 201 bp, Homo sapiens
agcatgacatgtgtttcaatagaagaatcttaagttggctaaattcaaagtgcttgacatcaaaatgttctagagtgattagctactagattctgaatcakacatcacatctgactagagaccagtttctttcgaatgattcttttatgtatgtagatctgttcttctgaggcagcggttggccaactatagcccaaaggc

SEQ ID NO: 3374 - DNA, 201 bp, Homo sapiens
gaggatcaggagggacaagagggatggaggcgaaaggctggatccttaatccaggccggagacaaagccgcgccagggagctcgcggcgcgcggcccctgwcctccggcccgagatgaatcctgcggcagaagccgagttcaacatcctcctggccaccgactcctacaaggttactcactataaacaatatccacccaac

SEQ ID NO: 3375 - DNA, 201 bp, Homo sapiens; identical to SEQ ID NO: 3371

SEQ ID NO: 3376 - DNA, 201 bp, Homo sapiens; identical to SEQ ID NO: 3372

SEQ ID NO: 3377 - DNA, 201 bp, Homo sapiens; identical to SEQ ID NO: 3373

SEQ ID NO: 3378 - DNA, 201 bp, Homo sapiens
ctccgccgaccgagcagtgacttaagcaacggagcgcggtgaagctcatttttctccttcctcgcagccgcgccagggagctcgcggcgcgcggcccctgwcctccggcccgagatgaatcctgcggcagaagccgagttcaacatcctcctggccaccgactcctacaaggttactcactataaacaatatccacccaac

SEQ ID NO: 3379 - DNA, 167 bp, Homo sapiens
agttttcatcagtgcctgtatctgtggtcagcgatagctatgacatttataatgcgtgtgagaaaatatggggtgaagatctaagacatttaatagtatcragaagtacacaggcaccactaataatcagacctgattctggaaaccctcttgacactgtgttaaag

SEQ ID NO: 3380 - DNA, 201 bp, Homo sapiens; identical to SEQ ID NO: 3378

SEQ ID NO: 3381 - DNA, 201 bp, Homo sapiens; identical to SEQ ID NO: 3371

SEQ ID NO: 3382 - DNA, 201 bp, Homo sapiens; identical to SEQ ID NO: 3372

SEQ ID NO: 3383 - DNA, 201 bp, Homo sapiens; identical to SEQ ID NO: 3373

SEQ ID NO: 3384 - DNA, 134 bp, Homo sapiens
ccgcgccagggagctcgcggcgcgcggcccctgwcctccggcccgagatgaatcctgcggcagaagccgagttcaacatcctcctggccaccgactcctacaaggttactcactataaacaatatccacccaac

SEQ ID NO: 3385 - DNA, 201 bp, Homo sapiens; identical to SEQ ID NO: 3371

SEQ ID NO: 3386 - DNA, 201 bp, Homo sapiens; identical to SEQ ID NO: 3372

SEQ ID NO: 3387 - DNA, 201 bp, Homo sapiens; identical to SEQ ID NO: 3373

SEQ ID NO: 3388 - DNA, 201 bp, Homo sapiens; identical to SEQ ID NO: 3374

SEQ ID NO: 3389 - DNA, 201 bp, Homo sapiens; identical to SEQ ID NO: 3371

SEQ ID NO: 3390 - DNA, 201 bp, Homo sapiens; identical to SEQ ID NO: 3372

SEQ ID NO: 3391 - DNA, 201 bp, Homo sapiens; identical to SEQ ID NO: 3373

SEQ ID NO: 3392 - DNA, 201 bp, Homo sapiens; identical to SEQ ID NO: 3378

SEQ ID NO: 3393 - DNA, 201 bp, Homo sapiens
tactccaccactgtcacaggaagaacttgccaagcttggtcatctatgacaccacaccagcatagtcggaccccagaaaactacccaaatgctggcctgascaggaactactgcaggaatccagatgctgagattcgcccttggtgttacaccatggatcccagtgtcaggtgggagtactgcaacctgacacaatgcctg

SEQ ID NO: 3394 - DNA, 201 bp, Homo sapiens
tgtttgggaatgggaaaggataccggggcaagaaggcaaccactgttactgggacgccatgccaggaatgggctgcccaggagccccatagacacagcacrttcattccagggacaaataaatgggcaggtctggaaaaaaattactgccgtaaccctgatggtgacatcaatggtccctggtgctacacaatgaatccaa

SEQ ID NO: 3395 - DNA, 201 bp, Homo sapiens
caccggcatcagaggaccccagaaaactacccaaatgatggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagccta

SEQ ID NO: 3396 - DNA, 201 bp, Homo sapiens
agggcctccttctgaacaagactgtatgtttgggaatgggaaaggataccggggcaagaaggcaaccactgttactgggacgccatgccaggaatgggctkcccaggagccccatagacacagcacgttcattccagggacaaataaatgggcaggtctggaaaaaaattactgccgtaaccctgatggtgacatcaatgg

SEQ ID NO: 3397 - DNA, 201 bp, Homo sapiens
cactgacagttgccagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagc

SEQ ID NO: 3398 - DNA, 201 bp, Homo sapiens
ggattgctaccatggtgatggacggagttatcgaggcatatcctccaccactgtcacaggaaggacctgtcaatcttggtcatctatgataccacactggyatcagaggaccccagaaaactacccaaatgctggcctgaccgagaactactgcaggaatccagattctgggaaacaaccctggtgttacacaaccgatcc

SEQ ID NO: 3399 - DNA, 201 bp, Homo sapiens
gaatccagatgctgagattcgcccttggtgttataccatggatcccagtgtcagatgggagtactgcaacctgacgcaatgtccagtgatggaatcaactstcctcacaactcccacggtggtcccagttccaagcacagagcttccttctgaagaagcaccaactgaaaacagcactggggtccaggactgctaccgagg

SEQ ID NO: 3400 - DNA, 201 bp, Homo sapiens
agtactgcaacctgacgcgatgctcagacacagaagggactgtggtcgctcctccgactgtcatccaggttccaagcctagggcctccttctgaacaagaytgtatgtttgggaatgggaaaggataccggggcaagaaggcaaccactgttactgggacgccatgccaggaatgggctgcccaggagccccatagacaca

SEQ ID NO: 3401 - DNA, 201 bp, Homo sapiens
gtggcctgaccaggaactactgcaggaatccagatgctgagattcgcccttggtgttataccatggatcccagtgtcagatgggagtactgcaacctgacrcaatgtccagtgatggaatcaactctcctcacaactcccacggtggtcccagttccaagcacagagcttccttctgaagaagcaccaactgaaaacagca

SEQ ID NO: 3402 - DNA, 201 bp, Homo sapiens
cccagttccaagcacagagcttccttctgaagaagcaccaactgaaaacagcactggggtccaggactgctaccgaggtgatggacagagttatcgaggcmcactctccaccactatcacaggaagaacatgtcagtcttggtcgtctatgacaccacattggcatcggaggatcccattatactatccaaatgctggcct

SEQ ID NO: 3403 - DNA, 201 bp, Homo sapiens
gagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatggtggcctgaccaggaactactgcaggaatccagatgctgagattagtcct

SEQ ID NO: 3404 - DNA, 201 bp, Homo sapiens
cacaactcccacggtggtcccagttccaagcacagagcttccttctgaagaagcaccaactgaaaacagcactggggtccaggactgctaccgaggtgatrgacagagttatcgaggcacactctccaccactatcacaggaagaacatgtcagtcttggtcgtctatgacaccacattggcatcggaggatcccattata

SEQ ID NO: 3405 - DNA, 201 bp, Homo sapiens
aactcccacagtggccccggttccaagcacagaggctccttctgaacaagcaccacctgagaaaagccctgtggtccaggattgctaccatggtgatggayggagttatcgaggcatatcctccaccactgtcacaggaaggacctgtcaatcttggtcatctatgataccacactggcatcagaggaccccagaaaacta

SEQ ID NO: 3406 - DNA, 201 bp, Homo sapiens
ctttttgactactgtgatatccctctctgtgcatcctcttcatttgattgtgggaagcctcaagtggagccgaagaaatgtcctggaagcattgtaggggkgtgtgtggcccacccacattcctggccctggcaagtcagtctcagaacaaggtttggaaagcacttctgtggaggcaccttaatatccccagagtgggtg

SEQ ID NO: 3407 - DNA, 201 bp, Homo sapiens
cgaggcacactctccaccactatcacaggaagaacatgtcagtcttggtcgtctatgacaccacattggcatcggaggatcccattatactatccaaatgrtggcctgaccaggaactactgcaggaatccagatgctgagattcgcccttggtgttacaccatggatcccagtgtcaggtgggagtactgcaacctgaca

SEQ ID NO: 3408 - DNA, 201 bp, Homo sapiens
ctgtggtcgctcctccgactgtcatccaggttccaagcctagggcctccttctgaacaagactgtatgtttgggaatgggaaaggataccggggcaagaargcaaccactgttactgggacgccatgccaggaatgggctgcccaggagccccatagacacagcacgttcattccagggacaaataaatgggcaggtctgg

SEQ ID NO: 3409 - DNA, 201 bp, Homo sapiens
gttacaccatggatcccagtgtcaggtgggagtactgcaacctgacacaatgcctggtgacagaatcaagtgtccttgcaactctcacggtggtcccagayccaagcacagaggcttcttctgaagaagcaccaacggagcaaagccccggggtccaggattgctaccatggtgatggacagagttatcgaggctcattct

SEQ ID NO: 3410 - DNA, 201 bp, Homo sapiens
aaactttttgactactgtgatatccctctctgtgcatcctcttcatttgattgtgggaagcctcaagtggagccgaagaaatgtcctggaagcattgtagsggggtgtgtggcccacccacattcctggccctggcaagtcagtctcagaacaaggtttggaaagcacttctgtggaggcaccttaatatccccagagtgg

SEQ ID NO: 3411 - DNA, 201 bp, Homo sapiens
accgatccgtgtgtgaggtgggagtactgcaatctgacacaatgctcagaaacagaatcaggtgtcctagagactcccactgttgttccagttccaagcayggaggctcattctgaagcagcaccaactgagcaaacccctgtggtccggcagtgctaccatggtaatggccagagttatcgaggcacattctccaccact

SEQ ID NO: 3412 - DNA, 201 bp, Homo sapiens
tcccagtgtcagatgggagtactgcaacctgacgcaatgtccagtgatggaatcaactctcctcacaactcccacggtggtcccagttccaagcacagagsttccttctgaagaagcaccaactgaaaacagcactggggtccaggactgctaccgaggtgatggacagagttatcgaggcacactctccaccactatcac

SEQ ID NO: 3413 - DNA, 201 bp, Homo sapiens
ctgctgctcactgcttgaagaagtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggcctgccgtcatcactgacaaagtaatgccagcttgtc

SEQ ID NO: 3414 - DNA, 201 bp, Homo sapiens
gaaggaaacccggcgctcgacggatcttggcaagacagccttgctctctaaaaaggctggtgggagctctgttaagtctgtctgtaagaacaccggggacracgaggcagagagaggccaccagcctccagcttcccagcagccaaatgcaaatacaacgggaaaagagcagcttgtcaccaaggaccctgcttctgccaa

SEQ ID NO: 3415 - DNA, 201 bp, Homo sapiens
cctttgacagattcctggaaaaaacttctagattctaaactgggtgaaagactggacatcattttccttgtcaggtgttgcatttttccgttagaggtggraagctccacgatgccctgtgtctgtgggctcatgttccctcatcttgtagcttggagaggaaagaagttgccttctgccaaaagccaatggtggtatgtt

SEQ ID NO: 3416 - DNA, 201 bp, Homo sapiens
ggtgggttctcaaagcagtaccactctcatctgctcagtacatctgcggcaactggctgccttcgatgctgtcattgcgttcagcccagcacatcacagcyccatcagtgtgtagccaccgctctcgtttttctgtatcgcttttatctcctgaaaaagatgcaccaaataagagatcatctatatcaggaattgaatgtc

SEQ ID NO: 3417 - DNA, 201 bp, Homo sapiens
gatttagacatttagccttgtgaaagttaccacagtgctccatgtgattcattgactgtgagcctgttgtccattgcactcagccctgtactcacttcttyactcgctgtcctggttttactgttcagattttggtgggttctcaaagcagtaccactctcatctgctcagtacatctgcggcaactggctgccttcgatg

SEQ ID NO: 3418 - DNA, 201 bp, Homo sapiens
tttttctgtatcgcttttatctcctgaaaaagatgcaccaaataagagatcatctatatcaggaattgaatgtctaactcaaacctctcatttttgtttartaggtagatctcatttgaagtctcctatctgaatctctgaaacaattatagtttgattagacaaaggtttttaataacacttcttttttgctgtagtcaa

SEQ ID NO: 3419 - DNA, 201 bp, Homo sapiens
gcacaaaataatcaccaacagtaatgttgtatctgtaatgtttgtttgctttttaaagttttattcttgatttcttgtaaacatccattgcactgaggccrtatcattccttaagacagccctacatcttgccttggtaatcccttagataatgtggaaactcaaaccgttaggctccagtcatcttagaccatttcccat

SEQ ID NO: 3420 - DNA, 201 bp, Homo sapiens
gccctacatcttgccttggtaatcccttagataatgtggaaactcaaaccgttaggctccagtcatcttagaccatttcccatccgttttgtattttctcktcctgaaagcagctgaactgaaagtaagtaataatatgctggaccagtgggaacggatgtgggagtatttgtggtgtgctaaaatactgtaattatctgt

SEQ ID NO: 3421 - DNA, 201 bp, Homo sapiens
gaaagtaagtaataatatgctggaccagtgggaacggatgtgggagtatttgtggtgtgctaaaatactgtaattatctgtgaggctgcctgacacgcttytgcaatcttgttttcatcattcattctgcaaacgtttatggagggccttctttgagcacagaggcaaaactgaaagcttcagggatttgctgtagctgag

SEQ ID NO: 3422 - DNA, 201 bp, Homo sapiens
atgagacggatgtgggatttgaggggaacattgtcattcccttaaaataactatcatgaaaaaaatagcaacagtatgtaaagggaccaagagtggcagcytttagggaaaatggagcagagaagagctgtgaacaaagctcatttatttgaaataagcgtgctttatttcacatagaggggcatcagacgttacatttca

SEQ ID NO: 3423 - DNA, 201 bp, Homo sapiens
ggtggcaggcagtctgcagagaaatcctcaaaaaagttatcttctagcatgcaaacctctgcacggccttctcaaaaacctcagtgatatttctgcaatcraagtgttttatctgtaaagatgtttatttatttagaacccctgccctcccaccaaagcctcctgtgcttttgttttgtacttttttgagtcacgtgcccg

SEQ ID NO: 3424 - DNA, 201 bp, Homo sapiens
aggaattcatttaaacaacaacctaaaccacttgaaatttggcttggattatcatagactgtcttctcctacacaaacagcagcaaagcaggggaaaatgkattctcccacatcaagagcaggcagcgacaagattgtcctgttggtgtgtaaccgagcctgcactgggcaacaagggaaaagggcattaaaatcttgtgg

SEQ ID NO: 3425 - DNA, 201 bp, Homo sapiens
cttgcggaacctttctagcagttaccaggaaccaagcgacagtcatagtcgccgtgagcacaaggctgtgggccgggcccctctggctgtcatggaaggcrtgttcaaagacgaatcggacacccgcagattgaactccagtgtcgtagatacacagagcaaacattcagcacaaggggaccgcctgcccccgctctctgg

SEQ ID NO: 3426 - DNA, 201 bp, Homo sapiens
taacaacgaaacaaatcgagggaaaaactcttgctttctgcactttcgccccatctaccagtctttgtaaagggcaatattttaacactaatgtttctcargtatatactcagctagtctaggatggttgcacaccagtaaatggattaaagaggaaggtgccatgtgggtgactgtgtcatttctcctactgccacagat

SEQ ID NO: 3427 - DNA, 201 bp, Homo sapiens
ttagcaattgtacatatttctttctagagaactctaatgactttctttggatatgagggttttgaaacctgtgaaccagaaaagctaccattagtgcgtaraaggaggaaggagctgactcgtgtttcttctgagcaggacttgtccttactgtggattgtgggtggcaccaggagctctaaaaactgtgactctaacaac

SEQ ID NO: 3428 - DNA, 201 bp, Homo sapiens
ccagcctccagcttcccagcagccaaatgcaaatacaacgggaaaagagcagcttgtcaccaaggaccctgcttctgccaaacattccctgctgtccgctygcaaatccaagtcttcccaactagactctggagttccctcgtctccgggtggcaggcagtctgcagagaaatcctcaaaaaagttatcttctagcatgca

SEQ ID NO: 3429 - DNA, 201 bp, Homo sapiens
gtgttttatctgtaaagatgtttatttatttagaacccctgccctcccaccaaagcctcctgtgcttttgttttgtacttttttgagtcacgtgcccgackgtgtgtgtgtgtgtgagtgtatgcgtgtgtgtgtctaattcaattgcaaattgttcaaagcgtcgccttattctgccattgaaccaaataacagccatag

SEQ ID NO: 3430 - DNA, 201 bp, Homo sapiens
ataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctggga

SEQ ID NO: 3431 - DNA, 201 bp, Homo sapiens
aagagcaggcagcgacaagattgtcctgttggtgtgtaaccgagcctgcactgggcaacaagggaaaagggcattaaaatcttgtggaccaggtggcactrctcatgtgaaattagtagtcgagtgggacaaggagacaagagatttcttatttgtaaatactgaggatgagtatattcctgatgcagaaagtgttcgtct

SEQ ID NO: 3432 - DNA, 201 bp, Homo sapiens
cccttggtgcacagatccatatataacctcccttttcagtattgctgtgtgtgaattaactacaacacatatgcatgcatagctgtgaattctgcactacyttttttttcttttttccccccaagaatatctcttgggaaaagtttttagtacgttacttaactttattttgctgctaatttgcgcattagccggtaactt

SEQ ID NO: 3433 - DNA, 201 bp, Homo sapiens
ctcaaaaaagttatcttctagcatgcaaacctctgcacggccttctcaaaaacctcagtgatatttctgcaatcgaagtgttttatctgtaaagatgtttrtttatttagaacccctgccctcccaccaaagcctcctgtgcttttgttttgtacttttttgagtcacgtgcccgactgtgtgtgtgtgtgtgagtgtatg

SEQ ID NO: 3434 - DNA, 201 bp, Homo sapiens
tatcccagtgtttccaactgtacaccaaagaggagcggcttgcccccgatgatgcctggcgttgcccacactgtaagcagctgcagcagggaagcattacrttaagcctctggactctgcctgatgtgcttattatacatctaaagagatttcggcaggaaggagacaggcgcatgaaacttcagaacatggtcaaattcc

SEQ ID NO: 3435 - DNA, 201 bp, Homo sapiens
aagattggggaggcagcagatgacaaggtctccatctcttgctttggtagcttgcggaacctttctagcagttaccaggaaccaagcgacagtcatagtckccgtgagcacaaggctgtgggccgggcccctctggctgtcatggaaggcgtgttcaaagacgaatcggacacccgcagattgaactccagtgtcgtagat

SEQ ID NO: 3436 - DNA, 201 bp, Homo sapiens; identical to SEQ ID NO: 3414

SEQ ID NO: 3437 - DNA, 201 bp, Homo sapiens; identical to SEQ ID NO: 3415

SEQ ID NO: 3438 - DNA, 201 bp, Homo sapiens; identical to SEQ ID NO: 3416

SEQ ID NO: 3439 - DNA, 201 bp, Homo sapiens; identical to SEQ ID NO: 3417

SEQ ID NO: 3440 - DNA, 201 bp, Homo sapiens; identical to SEQ ID NO: 3418

SEQ ID NO: 3441 - DNA, 201 bp, Homo sapiens; identical to SEQ ID NO: 3419

SEQ ID NO: 3442 - DNA, 201 bp, Homo sapiens; identical to SEQ ID NO: 3420

SEQ ID NO: 3443 - DNA, 201 bp, Homo sapiens; identical to SEQ ID NO: 3421

SEQ ID NO: 3444 - DNA, 201 bp, Homo sapiens; identical to SEQ ID NO: 3422

SEQ ID NO: 3445 - DNA, 201 bp, Homo sapiens; identical to SEQ ID NO: 3423

SEQ ID NO: 3446 - DNA, 130 bp, Homo sapiens
cacaaacagcagcaaagcaggggaaaatgkattctcccacatcaagagcaggcagcgacaagattgtcctgttggtgtgtaaccgagcctgcactgggcaacaagggaaaagatttggactgccttttgt

SEQ ID NO: 3447 - DNA, 201 bp, Homo sapiens; identical to SEQ ID NO: 3425

SEQ ID NO: 3448 - DNA, 201 bp, Homo sapiens; identical to SEQ ID NO: 3426

SEQ ID NO: 3449 - DNA, 201 bp, Homo sapiens; identical to SEQ ID NO: 3427

SEQ ID NO: 3450 - DNA, 201 bp, Homo sapiens; identical to SEQ ID NO: 3428

SEQ ID NO: 3451 - DNA, 201 bp, Homo sapiens; identical to SEQ ID NO: 3429

SEQ ID NO: 3452 - DNA, 201 bp, Homo sapiens; identical to SEQ ID NO: 3430

SEQ ID NO: 3453 - DNA, 201 bp, Homo sapiens
cagtgttgttggaataacatatttgctgccccaggaggagcagcccttgtgccacccaatagtagaaagggcattaaaatcttgtggaccaggtggcactrctcatgtgaaattagtagtcgagtgggacaaggagacaagagatttcttatttgtaaatactgaggatgagtatattcctgatgcagaaagtgttcgtct

SEQ ID NO: 3454 - DNA, 201 bp, Homo sapiens
agtatttcttgaggcccacggtttgcattcaggtgtgtccattcagcttgcgtgtggtcagtgttgttggaataacatatttgctgccccaggaggagcakcccttgtgccacccaatagtagaaagggcattaaaatcttgtggaccaggtggcactgctcatgtgaaattagtagtcgagtgggacaaggagacaagag

SEQ ID NO: 3455 - DNA, 201 bp, Homo sapiens; identical to SEQ ID NO: 3432

SEQ ID NO: 3456 - DNA, 201 bp, Homo sapiens; identical to SEQ ID NO: 3433

SEQ ID NO: 3457 - DNA, 201 bp, Homo sapiens; identical to SEQ ID NO: 3434

SEQ ID NO: 3458 - DNA, 201 bp, Homo sapiens; identical to SEQ ID NO: 3435

SEQ ID NO: 3459 - DNA, 201 bp, Homo sapiens
ggagtgccacaggtgaggcctggcaggagattatgctgtcatgccttggggagaagggctgtgagcctgacaccaccgcaccatcagggcagaacgagaaygaacgctgcggcaccgatctggcctacgtgtactttgtctccttcatcttcttctgctccttcttgatgctcaacctgtttgtggccgtcatcatggaca

SEQ ID NO: 3460 - DNA, 201 bp, Homo sapiens
ccagcaggaccccgtttcaggcctgagtggccggagtggatacccttcgatgagtccactctctccccaggatatattccagttggcttgtatggaccccrccgatgacggacagttccaagaacggcagtctctggtggtgacagaccctagctccatgagacgttcattttccactattcgggataagcgttcaaattc

SEQ ID NO: 3461 - DNA, 201 bp, Homo sapiens
ccatgcattatcagagaagaggaagtaaaggacaatcagaacaccagtcaaacccaccaaattgctttattcccctttgcaagatgggcactgccatagtyctgcctctttgctggggaaagaaaccaggaacgtggagggttattactgcgggagaagggacacgaggatggctttgcttccccttgccccttcccactt

SEQ ID NO: 3462 - DNA, 201 bp, Homo sapiens
tgcctcaggagatcattgctaatgccaaagccctgccttacctccagcaggaccccgtttcaggcctgagtggccggagtggatacccttcgatgagtccmctctctccccaggatatattccagttggcttgtatggaccccgccgatgacggacagttccaagaacggcagtctctggtggtgacagaccctagctcca

SEQ ID NO: 3463 - DNA, 201 bp, Homo sapiens
gtcatgggggaaccctgagggtgtgggtagagtagcaggggccacctaagagattaaaaacagagtctgttttccaaccagtgtggaagcaattaaatatrcgtaacagtgctacggccacaccagcacctcctggctgaaggtcagcccacactctggtccatgaggcagcaaggccagtgctgtgccaagcccggtaag

SEQ ID NO: 3464 - DNA, 101 bp, Homo sapiens
tattcaccttcccttgaccaagaaattgggtttcttttccctcagcctgcacttactcttctattaagaccagaaaataaaataattttccgttgagtcam

SEQ ID NO: 3465 - DNA, 201 bp, Homo sapiens
agaagaaggagaagcgtgagacaggcaaagccatggtgccccacagctcaatgttcatcttcagcaccaccaacccgatccggagggcctgccactacatygtgaacctgcgctactttgagatgtgcatcctcctggtgattgcagccagcagcatcgccctggcggcagaggaccccgtcctgaccaactcggagcgca

SEQ ID NO: 3466 - DNA, 201 bp, Homo sapiens
gtcggcagctcccacccgtcccgccaaagccccggcccctcctttcctacagctccctgattcgacacgcgggcagcatctctccacctgctgatggaagygaggagggctccccgctgacctcccaagctctggagagcaacaatgcttgcctgaccgagtcttccaactctccgcacccccagcagagccaacatgcct

SEQ ID NO: 3467 - DNA, 201 bp, Homo sapiens
ccaaagccctgccttacctccagcaggaccccgtttcaggcctgagtggccggagtggatacccttcgatgagtccactctctccccaggatatattccarttggcttgtatggaccccgccgatgacggacagttccaagaacggcagtctctggtggtgacagaccctagctccatgagacgttcattttccactattc

SEQ ID NO: 3468 - DNA, 201 bp, Homo sapiens
gccaacatgcctccccacagcgctacatctccgagccctacttggccctgcacgaagactcccacgcctcagactgtggtgaggaggagacgctcactttygaagcagccgtggctactagcctgggccgttccaacaccatcggctcagccccacccctgcggcatagctggcagatgcccaacgggcactatcggcggc

SEQ ID NO: 3469 - DNA, 201 bp, Homo sapiens
tttatcggcgacccagggccattgagggcctggccctgggcctggccctggagaagttcgaggaggagcgcatcagccgtggggggtccctcaagggggawggaggggaccgatccagtgccctggacaaccagaggacccctttgtccctgggccagcgggagccaccatggctggccaggccctgtcatggaaactgtg

SEQ ID NO: 3470 - DNA, 201 bp, Homo sapiens
gagggcaggtcacagacgcccaacagacagggcacaggttccctaagtgagagctccatcccctctgtctctgacaccagcaccccaagaagaagtcgtcrgcagctcccacccgtcccgccaaagccccggcccctcctttcctacagctccctgattcgacacgcgggcagcatctctccacctgctgatggaagcgag

SEQ ID NO: 3471 - DNA, 201 bp, Homo sapiens
gaggagccggacagaggccatgactcgagactccagtgatgagcactgtgttgatatctcctctgtgggcacacctctggcccgagccagtatcaaaagtkcaaaggtagacggggtctcttatttccggcacaaggaaaggcttctgcgcatctccattcgccacatggttaaatcccaggtgttttactggattgtgct

SEQ ID NO: 3472 - DNA, 119 bp, Homo sapiens
gtgaatcttatccttcttrtccacagggaatttgccaaagagagagagagagtggagaaccgaagggctttcatgaagctgcggcgccagcagcagattgagcgtgagctgaatggcta

SEQ ID NO: 3473 - DNA, 201 bp, Homo sapiens
ttgctgtcatcgcagttcagctcttcaagggaaagttcttttattgcacggacagttccaaggacacagagaaggagtgcataggcaactatgtagatcaygagaaaaacaagatggaggtgaagggccgggaatggaagcgccatgaattccactacgacaacattatctgggccctgctgaccctcttcaccgtctcca

SEQ ID NO: 3474 - DNA, 201 bp, Homo sapiens
gggaaggatggcctcaagttctgcagcactctgtagatgtgacagaggaagaccgaggcccaagccgcagcaaccgcatggagatgtctatcttttatgtrgtctactttgtggtcttccccttcttctttgtcaatatctttgtggctctcatcatcatcaccttccaggagcaaggggataagatgatggaggagtgca

SEQ ID NO: 3475 - DNA, 201 bp, Homo sapiens
gccagcagcagattgagcgtgagctgaatggctaccgtgcctggatagacaaagcagaggaagtcatgctcgctgaagaaaataaaaatgctggaacatcmgccttagaagtgcttcgaagggcaaccatcaagaggagccggacagaggccatgactcgagactccagtgatgagcactgtgttgatatctcctctgtgg

SEQ ID NO: 3476 - DNA, 201 bp, Homo sapiens; identical to SEQ ID NO: 3459

SEQ ID NO: 3477 - DNA, 201 bp, Homo sapiens
ccagcaggaccccgtttcaggcctgagtggccggagtggatacccttcgatgagtccactctctccccaggatatattccagttggcttgtatggaccccrccgatgacggacagttccaagaacggcagtctctggagccagaggttagtgaattaaaaagcgtgcagccctctaaccatggcatctaccttccttcgga

SEQ ID NO: 3478 - DNA, 201 bp, Homo sapiens; identical to SEQ ID NO: 3461

SEQ ID NO: 3479 - DNA, 201 bp, Homo sapiens; identical to SEQ ID NO: 3463

SEQ ID NO: 3480 - DNA, 101 bp, Homo sapiens; identical to SEQ ID NO: 3464

SEQ ID NO: 3481 - DNA, 201 bp, Homo sapiens
tgcctcaggagatcattgctaatgccaaagccctgccttacctccagcaggaccccgtttcaggcctgagtggccggagtggatacccttcgatgagtccmctctctccccaggatatattccagttggcttgtatggaccccgccgatgacggacagttccaagaacggcagtctctggagccagaggttagtgaattaa

SEQ ID NO: 3482 - DNA, 201 bp, Homo sapiens
tcttttgctttgaagctgggatcaaaattgtggccctggggttcatcttccataagggctcttacctccgcaatggctggaatgtcatggacttcatcgtsgtcctcagtggcatcctggccactgcaggaacccacttcaatactcacgtggacctgaggaccctccgggctgtgcgtgtcctgcggcctttgaagctcg

SEQ ID NO: 3483 - DNA, 201 bp, Homo sapiens
ccatggtacctcttctgcagattggccttctgctcttctttgccatcctgatgtttgctatcattggtttggagttctacagtggcaagttacatcgagcrtgcttcatgaacaattcaggtattctagaaggatttgacccccctcacccatgtggtgtgcagggctgcccagctggttatgaatgcaaggactggatcg

SEQ ID NO: 3484 - DNA, 201 bp, Homo sapiens; identical to SEQ ID NO: 3465

SEQ ID NO: 3485 - DNA, 201 bp, Homo sapiens
ccaaagccctgccttacctccagcaggaccccgtttcaggcctgagtggccggagtggatacccttcgatgagtccactctctccccaggatatattccarttggcttgtatggaccccgccgatgacggacagttccaagaacggcagtctctggagccagaggttagtgaattaaaaagcgtgcagccctctaaccatg

SEQ ID NO: 3486 - DNA, 201 bp, Homo sapiens; identical to SEQ ID NO: 3466

SEQ ID NO: 3487 - DNA, 201 bp, Homo sapiens; identical to SEQ ID NO: 3469

SEQ ID NO: 3488 - DNA, 201 bp, Homo sapiens; identical to SEQ ID NO: 3468

SEQ ID NO: 3489 - DNA, 201 bp, Homo sapiens; identical to SEQ ID NO: 3470

SEQ ID NO: 3490 - DNA, 201 bp, Homo sapiens; identical to SEQ ID NO: 3471

SEQ ID NO: 3491 - DNA, 201 bp, Homo sapiens; identical to SEQ ID NO: 3473

SEQ ID NO: 3492 - DNA, 201 bp, Homo sapiens; identical to SEQ ID NO: 3474

SEQ ID NO: 3493 - DNA, 201 bp, Homo sapiens; identical to SEQ ID NO: 3475

SEQ ID NO: 3494 - DNA, 201 bp, Homo sapiens; identical to SEQ ID NO: 3459

SEQ ID NO: 3495 - DNA, 201 bp, Homo sapiens; identical to SEQ ID NO: 3477

SEQ ID NO: 3496 - DNA, 201 bp, Homo sapiens; identical to SEQ ID NO: 3461

SEQ ID NO: 3497 - DNA, 201 bp, Homo sapiens; identical to SEQ ID NO: 3463

SEQ ID NO: 3498 - DNA, 101 bp, Homo sapiens; identical to SEQ ID NO: 3464

SEQ ID NO: 3499 - DNA, 201 bp, Homo sapiens; identical to SEQ ID NO: 3481

SEQ ID NO: 3500 - DNA, 201 bp, Homo sapiens; identical to SEQ ID NO: 3482

SEQ ID NO: 3501 - DNA, 201 bp, Homo sapiens; identical to SEQ ID NO: 3483

SEQ ID NO: 3502 - DNA, 201 bp, Homo sapiens; identical to SEQ ID NO: 3465

SEQ ID NO: 3503 - DNA, 201 bp, Homo sapiens; identical to SEQ ID NO: 3485

SEQ ID NO: 3504 - DNA, 201 bp, Homo sapiens; identical to SEQ ID NO: 3466

SEQ ID NO: 3505 - DNA, 201 bp, Homo sapiens; identical to SEQ ID NO: 3469

SEQ ID NO: 3506 - DNA, 201 bp, Homo sapiens; identical to SEQ ID NO: 3468

SEQ ID NO: 3507 - DNA, 201 bp, Homo sapiens; identical to SEQ ID NO: 3470

SEQ ID NO: 3508 - DNA, 201 bp, Homo sapiens; identical to SEQ ID NO: 3471

SEQ ID NO: 3509 - DNA, 201 bp, Homo sapiens; identical to SEQ ID NO: 3473

SEQ ID NO: 3510 - DNA, 201 bp, Homo sapiens; identical to SEQ ID NO: 3474

SEQ ID NO: 3511 - DNA, 201 bp, Homo sapiens; identical to SEQ ID NO: 3475

SEQ ID NO: 3512 - DNA, 201 bp, Homo sapiens; identical to SEQ ID NO: 3459

SEQ ID NO: 3513 - DNA, 201 bp, Homo sapiens; identical to SEQ ID NO: 3460

SEQ ID NO: 3514 - DNA, 201 bp, Homo sapiens; identical to SEQ ID NO: 3461

SEQ ID NO: 3515 - DNA, 201 bp, Homo sapiens; identical to SEQ ID NO: 3463

SEQ ID NO: 3516 - DNA, 101 bp, Homo sapiens; identical to SEQ ID NO: 3464

SEQ ID NO: 3517 - DNA, 201 bp, Homo sapiens; identical to SEQ ID NO: 3462

SEQ ID NO: 3518 - DNA, 201 bp, Homo sapiens; identical to SEQ ID NO: 3482

SEQ ID NO: 3519 - DNA, 201 bp, Homo sapiens; identical to SEQ ID NO: 3483

SEQ ID NO: 3520 - DNA, 201 bp, Homo sapiens; identical to SEQ ID NO: 3465

SEQ ID NO: 3521 - DNA, 201 bp, Homo sapiens; identical to SEQ ID NO: 3467

SEQ ID NO: 3522 - DNA, 201 bp, Homo sapiens; identical to SEQ ID NO: 3466

SEQ ID NO: 3523 - DNA, 201 bp, Homo sapiens; identical to SEQ ID NO: 3469

SEQ ID NO: 3524 - DNA, 201 bp, Homo sapiens; identical to SEQ ID NO: 3468

SEQ ID NO: 3525 - DNA, 201 bp, Homo sapiens; identical to SEQ ID NO: 3470

SEQ ID NO: 3526 - DNA, 201 bp, Homo sapiens; identical to SEQ ID NO: 3471

SEQ ID NO: 3527 - DNA, 201 bp, Homo sapiens; identical to SEQ ID NO: 3473

SEQ ID NO: 3528 - DNA, 201 bp, Homo sapiens; identical to SEQ ID NO: 3474

SEQ ID NO: 3529 - DNA, 201 bp, Homo sapiens; identical to SEQ ID NO: 3475

SEQ ID NO: 3530 - DNA, 201 bp, Homo sapiens; identical to SEQ ID NO: 3459

SEQ ID NO: 3531 - DNA, 201 bp, Homo sapiens; identical to SEQ ID NO: 3477

SEQ ID NO: 3532 - DNA, 201 bp, Homo sapiens; identical to SEQ ID NO: 3461

SEQ ID NO: 3533 - DNA, 201 bp, Homo sapiens; identical to SEQ ID NO: 3481

SEQ ID NO: 3534 - DNA, 201 bp, Homo sapiens; identical to SEQ ID NO: 3463

SEQ ID NO: 3535 - DNA, 101 bp, Homo sapiens; identical to SEQ ID NO: 3464

SEQ ID NO: 3536 - DNA, 201 bp, Homo sapiens; identical to SEQ ID NO: 3465

SEQ ID NO: 3537 - DNA, 201 bp, Homo sapiens; identical to SEQ ID NO: 3466

SEQ ID NO: 3538 - DNA, 201 bp, Homo sapiens; identical to SEQ ID NO: 3485

SEQ ID NO: 3539 - DNA, 201 bp, Homo sapiens; identical to SEQ ID NO: 3468

SEQ ID NO: 3540 - DNA, 201 bp, Homo sapiens; identical to SEQ ID NO: 3469

SEQ ID NO: 3541 - DNA, 201 bp, Homo sapiens; identical to SEQ ID NO: 3470

SEQ ID NO: 3542 - DNA, 201 bp, Homo sapiens; identical to SEQ ID NO: 3471

SEQ ID NO: 3543 - DNA, 119 bp, Homo sapiens; identical to SEQ ID NO: 3472

SEQ ID NO: 3544 - DNA, 201 bp, Homo sapiens; identical to SEQ ID NO: 3473

SEQ ID NO: 3545 - DNA, 201 bp, Homo sapiens; identical to SEQ ID NO: 3474

SEQ ID NO: 3546 - DNA, 201 bp, Homo sapiens; identical to SEQ ID NO: 3475

SEQ ID NO: 3547 - DNA, 201 bp, Homo sapiens; identical to SEQ ID NO: 3459

SEQ ID NO: 3548 - DNA, 201 bp, Homo sapiens; identical to SEQ ID NO: 3460

SEQ ID NO: 3549 - DNA, 201 bp, Homo sapiens; identical to SEQ ID NO: 3461

SEQ ID NO: 3550 - DNA, 201 bp, Homo sapiens; identical to SEQ ID NO: 3463

SEQ ID NO: 3551 - DNA, 101 bp, Homo sapiens; identical to SEQ ID NO: 3464

SEQ ID NO: 3552 - DNA, 201 bp, Homo sapiens; identical to SEQ ID NO: 3462

SEQ ID NO: 3553 - DNA, 201 bp, Homo sapiens; identical to SEQ ID NO: 3482

SEQ ID NO: 3554 - DNA, 201 bp, Homo sapiens; identical to SEQ ID NO: 3483

SEQ ID NO: 3555 - DNA, 201 bp, Homo sapiens; identical to SEQ ID NO: 3465

SEQ ID NO: 3556 - DNA, 201 bp, Homo sapiens; identical to SEQ ID NO: 3467

SEQ ID NO: 3557 - DNA, 201 bp, Homo sapiens; identical to SEQ ID NO: 3466

SEQ ID NO: 3558 - DNA, 201 bp, Homo sapiens; identical to SEQ ID NO: 3469

SEQ ID NO: 3559 - DNA, 201 bp, Homo sapiens; identical to SEQ ID NO: 3468

SEQ ID NO: 3560 - DNA, 201 bp, Homo sapiens; identical to SEQ ID NO: 3470

SEQ ID NO: 3561 - DNA, 201 bp, Homo sapiens; identical to SEQ ID NO: 3471

SEQ ID NO: 3562 - DNA, 201 bp, Homo sapiens; identical to SEQ ID NO: 3473

SEQ ID NO: 3563 - DNA, 201 bp, Homo sapiens; identical to SEQ ID NO: 3474

SEQ ID NO: 3564 - DNA, 201 bp, Homo sapiens; identical to SEQ ID NO: 3475

SEQ ID NO: 3565 - DNA, 201 bp, Homo sapiens; identical to SEQ ID NO: 3459

SEQ ID NO: 3566 - DNA, 201 bp, Homo sapiens; identical to SEQ ID NO: 3460

SEQ ID NO: 3567 - DNA, 201 bp, Homo sapiens; identical to SEQ ID NO: 3461

SEQ ID NO: 3568 - DNA, 201 bp, Homo sapiens; identical to SEQ ID NO: 3462

SEQ ID NO: 3569 - DNA, 201 bp, Homo sapiens; identical to SEQ ID NO: 3463

SEQ ID NO: 3570 - DNA, 101 bp, Homo sapiens; identical to SEQ ID NO: 3464

SEQ ID NO: 3571 - DNA, 201 bp, Homo sapiens; identical to SEQ ID NO: 3465

SEQ ID NO: 3572 - DNA, 201 bp, Homo sapiens; identical to SEQ ID NO: 3466

SEQ ID NO: 3573 - DNA, 201 bp, Homo sapiens; identical to SEQ ID NO: 3467

SEQ ID NO: 3574 - DNA, 201 bp, Homo sapiens; identical to SEQ ID NO: 3468

SEQ ID NO: 3575 - DNA, 201 bp, Homo sapiens; identical to SEQ ID NO: 3469

SEQ ID NO: 3576 - DNA, 201 bp, Homo sapiens; identical to SEQ ID NO: 3470

SEQ ID NO: 3577 - DNA, 201 bp, Homo sapiens; identical to SEQ ID NO: 3471

SEQ ID NO: 3578 - DNA, 119 bp, Homo sapiens; identical to SEQ ID NO: 3472

SEQ ID NO: 3579 - DNA, 201 bp, Homo sapiens; identical to SEQ ID NO: 3473

SEQ ID NO: 3580 - DNA, 201 bp, Homo sapiens; identical to SEQ ID NO: 3474

SEQ ID NO: 3581 - DNA, 201 bp, Homo sapiens; identical to SEQ ID NO: 3475

SEQ ID NO: 3582 - DNA, 201 bp, Homo sapiens
tgccctgcacggagctgtccctgggccagcacctgctgcgggccaccgccgacgaggacctgcggacggccatcctgctgctggcacacggctcccgggaygaggtgaacgagacctgcggggagggagacggccgcacggcgctgcatctggcctgccgcaaggggaatgtggtcctggcgcagctcctgatctggtacg

SEQ ID NO: 3583 - DNA, 201 bp, Homo sapiens
cagctctggcctacgcccggcaggcctccagccaggagtgcatcgacgtgctgctgcagtacggctgccccgacgagcgcttcgtgctcatggccaccccyaacctgtccaggagaaacaataaccggaacaacagcagtgggagggtgcccaccatcatctgaggaacagccgtgcccgcctgctcgccgcacctgggac

SEQ ID NO: 3584 - DNA, 201 bp, Homo sapiens
cgctgcatctggcctgccgcaaggggaatgtggtcctggcgcagctcctgatctggtacggagtggacgtcacggcccgagatgcccacgggaacacagckctggcctacgcccggcaggcctccagccaggagtgcatcgacgtgctgctgcagtacggctgccccgacgagcgcttcgtgctcatggccacccctaacc

SEQ ID NO: 3585 - DNA, 201 bp, Homo sapiens
agcagtgggagggtgcccaccatcatctgaggaacagccgtgcccgcctgctcgccgcacctgggacgcggcagcctcgccgcattctcgctcagaagtcrcagcacgtgagtcccgtcgcatcccctccctcttcctggtggccacctccctcccgcccacccactctcaccccaaacaaaatcacaaaacctggacatc

SEQ ID NO: 3586 - DNA, 201 bp, Homo sapiens
caaactcggccatcagcagtgacacagggctgggtgactccgtatgctccagccccagtatctccagcaccaccagccccaagctcgacccgcccccctcycctcacgccaacagaaagaagcaccgaaggaagaaaagcactagcaacttcaaagccgacggcctgtccggcactgctgaagaacaagaagaaaattttg

SEQ ID NO: 3587 - DNA, 201 bp, Homo sapiens
aagtggctccttttcataaactcccctaaaccacacacaggagagagcgacgggcctcggccctttgatgatagcacatggcgcaggacccttgtcctggkggctcaagggatggggacgcgagggggaggggaggcgaggaacaaggagaaggggcaactttccttaactggcagttgagcacatagtacatttcccctc

SEQ ID NO: 3588 - DNA, 201 bp, Homo sapiens
ccagcaccagccagaaggaacttcggatcgatgttcctcccactgccaacacgcccacgcccgttcgcaagcagtctaagcgccggtccaacctgttcacytctcggaaagggagcgacccagacaaagagaagaaaggcctggagagtcgtgcggacagcattgggagcggccgagccatcccaattaaacagggcatgc

SEQ ID NO: 3589 - DNA, 201 bp, Homo sapiens
gaacttgggagccctcatgtgcatcgaatgctcagggatccaccggaatcttggcacccacctttcccgagtccgatctctggacctggatgactggccartcgagctcatcaaggtgatgtcatccatcgggaacgagctagccaacagcgtctgggaagagagcagccaggggcggacgaaaccatcggtagactccac

SEQ ID NO: 3590 - DNA, 201 bp, Homo sapiens; identical to SEQ ID NO: 3582

SEQ ID NO: 3591 - DNA, 201 bp, Homo sapiens; identical to SEQ ID NO: 3583

SEQ ID NO: 3592 - DNA, 201 bp, Homo sapiens; identical to SEQ ID NO: 3584

SEQ ID NO: 3593 - DNA, 201 bp, Homo sapiens; identical to SEQ ID NO: 3585

SEQ ID NO: 3594 - DNA, 201 bp, Homo sapiens
tacacatctcacccaattcagacacagggctgggtgactccgtatgctccagccccagtatctccagcaccaccagccccaagctcgacccgcccccctcycctcacgccaacagaaagaagcaccgaaggaagaaaagcactagcaacttcaaagccgacggcctgtccggcactgctgaagaacaagaagaaaattttg

SEQ ID NO: 3595 - DNA, 201 bp, Homo sapiens; identical to SEQ ID NO: 3587

SEQ ID NO: 3596 - DNA, 201 bp, Homo sapiens; identical to SEQ ID NO: 3588

SEQ ID NO: 3597 - DNA, 201 bp, Homo sapiens; identical to SEQ ID NO: 3589

SEQ ID NO: 3598 - DNA, 201 bp, Homo sapiens
gtggaggaggaaaaggaatgaggattgttagatcagaacaagaatttcaagaacagttagagtcagcacggagagaagctaagaagtctttcaatgatgaygctatgctgatcgagaagtttgtagacacaccgaggcatgtagaagtccaggtgtttggtgatcaccatggcaatgctgtgtacttgtttgaaagagact

SEQ ID NO: 3599 - DNA, 201 bp, Homo sapiens
gaactgacttggtggagtggcagcttagaattgcagcaggagagaagattcctttgagccaggaagaaataactctgcagggccatgccttcgaagctagmatatatgcagaagatcctagcaataacttcatgcctgtggcaggcccattagtgcacctctctactcctcgagcagacccttccaccaggattgaaactg

SEQ ID NO: 3600 - DNA, 201 bp, Homo sapiens
gcataccataaagtctccaaaggatggcacagtaaagaaagtgttctacagagaaggtgctcaggccaacagacacactcctttagtcgagtttgaggagraagaatcagacaaaagggaatcggaataaactccagcaaggaaatggccagttaagtagtgtcttctctctccaccaaaaagaggaagtgcctccagctt

SEQ ID NO: 3601 - DNA, 201 bp, Homo sapiens
gaccccatgattgcgaagctggtcgtgtgggcagcagatcgccaggcggcattgacaaaactgaggtacagccttcgtcagtacaatattgttggactgcmcaccaacattgacttcttactcaacctgtctggccacccagagtttgaagctgggaacgtgcacactgatttcatccctcaacaccacaaacagttgttg

SEQ ID NO: 3602 - DNA, 140 bp, Homo sapiens
ggatcagcccaaaggtaggctcaggctccgacggtggccsgcgggggtcacgaggcttcgtagtggaggaacgggtttggcgtgtgggacgcagctgcctctgtactggggagtcacggagtggccgggctccagggaca

SEQ ID NO: 3603 - DNA, 187 bp, Homo sapiens
ggatcagcccaaaggtaggctcaggctccgacggtggcccgcgggggtcacgaggcttcgtagtggaggaacgggtttggcgtgtgrgacgcagctgcctctgtactggggagtcacggagtggccgggctccagggacatggcggcggcctctgcggtgtcggtgctgctggtggcggcggagagg

SEQ ID NO: 3604 - DNA, 201 bp, Homo sapiens
cacctctctactcctcgagcagacccttccaccaggattgaaactggagtacggcaaggagacgaagtttccgtgcattatgaccccatgattgcgaagcyggtcgtgtgggcagcagatcgccaggcggcattgacaaaactgaggtacagccttcgtcagtacaatattgttggactgcccaccaacattgacttctta

SEQ ID NO: 3605 - DNA, 201 bp, Homo sapiens
gctgcagccaaagagtctttatgccaggcagccctgggtctcatcctcaaggagaaagccatgaccgacactttcactcttcaggcacatgatcaattctytccattttcgtctagcagtggaagaagactgaatatctcgtataccagaaacatgactcttaaagatggtaaaaacaatgtagccatagctgtaacgtat

SEQ ID NO: 3606 - DNA, 201 bp, Homo sapiens
gtaggctcaggctccgacggtggcccgcgggggtcacgaggcttcgtagtggaggaacgggtttggcgtgtgggacgcagctgcctctgtactggggagtmacggagtggccgggctccagggacatggcggcggcctctgcggtgtcggtgctgctggtggcggcggagaggaaccggtggcatcgtctcccgagcctgc

SEQ ID NO: 3607 - DNA, 201 bp, Homo sapiens
actcttcaggcacatgatcaattctctccattttcgtctagcagtggaagaagactgaatatctcgtataccagaaacatgactcttaaagatggtaaaamcaatgtagccatagctgtaacgtataaccatgatgggtcttatagcatgcagattgaagataaaactttccaagtccttggtaatctttacagcgaggga

SEQ ID NO: 3608 - DNA, 201 bp, Homo sapiens
aagagtctttatgccaggcagccctgggtctcatcctcaaggagaaagccatgaccgacactttcactcttcaggcacatgatcaattctctccattttcrtctagcagtggaagaagactgaatatctcgtataccagaaacatgactcttaaagatggtaaaaacaatgtagccatagctgtaacgtataaccatgatg

SEQ ID NO: 3609 - DNA, 201 bp, Homo sapiens
tcctggcccctgacatcctgcggagtgaccaggaggaggctgaggggccccgggctgaggaggacaagccagacgggcaggcacacgagcccatgcccgayagccacgtgggccgagagctgacccgcaagaagggcatcctcttgcagtaccgcctgcgctccaccgcacacctcccgggcccgctgctctccatgcggg

SEQ ID NO: 3610 - DNA, 201 bp, Homo sapiens
cgcaactttggcagcgctctgggcagcagtgggaggcaggccccgtgtggggagacggacagcaccctcctcatctggcaggtgcccttgatgctatagcrcctcccctctcccctcagagggcacagctgcaggcctgaccaaggccacgcccggctctcgtgctctaggacctgcacgggacttgtggatgggcctgga

SEQ ID NO: 3611 - DNA, 201 bp, Homo sapiens
ctgcccgtgcctcggctggaaggcatccccaagatcacagggaaaggcatggtctcactcaacgggcactgtgggcctgtggccttcctggctgtggctaycagcatcctggcccctgacatcctgcggagtgaccaggaggaggctgaggggccccgggctgaggaggacaagccagacgggcaggcacacgagcccatg

SEQ ID NO: 3612 - DNA, 201 bp, Homo sapiens
tggcctgctgcatccctgccttctcctcccgggcactcagcctgcagcttggggccctggtccacagtcctgtcaactgtcccctgctgggtttctcagcmgtcagcacctcccttccacagggctacctctgggtcgggggcggacaggaaggcgcagggggccaggtggaaatcttttccttgaaccggccctcgcccc

SEQ ID NO: 3613 - DNA, 201 bp, Homo sapiens
gtgaccgcgggcagctaattaagtccaaggagcgtcgggtcttcctgctcaacgacatgcttgtctgtgccaacatcaacttcaagggccagctggagatyagcagcctggtgcccctggggcccaagtatgtggtgaagtggaacacggcgctgccccaggtgcaggtggtggaggtgggccaggacggtggcacctatg

SEQ ID NO: 3614 - DNA, 201 bp, Homo sapiens
atggccttctttttaaaagcaaaaaacacaaaacctcacaactgcctggcaagcccagtatcacttgtttgggccctagcgggactccaaggcagccacaygcccctcctggaagggtgtgtgcgtgtgagtgtgtgcgagtgtgtgggctggtgtgtgaatatctataaataagtatatatggtgtatattatatgtgta

SEQ ID NO: 3615 - DNA, 159 bp, Homo sapiens
accgtgtcaccctctacgggctgatggtcaagcccatccagaggttcccacagttcatmctcctgcttcaggacatgctgaagaacacccccaggggccatccggacaggctgtcgctgcagctggccctcacagagctggagacgctggctgagaagc

SEQ ID NO: 3616 - DNA, 201 bp, Homo sapiens
aggctcagaataaggtgtacctcggccccccacgcctcttccaggagctgcaggacctgcagaaggacctggccgtggtggagcagatcacgcttctcatyagcacgctgcacggcacctaccagaacctgaacatgactgtggctcaagactggtgcctggccctgcagaggctgatgcgggtgaaggaggaagagatcc

SEQ ID NO: 3617 - DNA, 201 bp, Homo sapiens
acgacatgcttgtctgtgccaacatcaacttcaagggccagctggagatcagcagcctggtgcccctggggcccaagtatgtggtgaagtggaacacggcrctgccccaggtgcaggtggtggaggtgggccaggacggtggcacctatgacaaggacaatgtgctcatccagcactcaggcgccaagaaggcctctgcct

SEQ ID NO: 3618 - DNA, 201 bp, Homo sapiens
cggccacggtgcatccaaccatctgcctcgggctccaggatggcagcatcctcctctacagcagtgtggacactggcacccagtgcctggtgagctgcagragcccaggtctgcagcctgtgctctgcctgcgacacagccccttccacctgctcgctggcctgcaggatgggacccttgctgcttaccctcggaccagcg

SEQ ID NO: 3619 - DNA, 201 bp, Homo sapiens
tgctctgggtgggcactgaccagggtgtcatcgtcctgctgcccgtgcctcggctggaaggcatccccaagatcacagggaaaggcatggtctcactcaaygggcactgtgggcctgtggccttcctggctgtggctaccagcatcctggcccctgacatcctgcggagtgaccaggaggaggctgaggggccccgggctg

SEQ ID NO: 3620 - DNA, 201 bp, Homo sapiens
gcacctcccttccacagggctacctctgggtcgggggcggacaggaaggcgcagggggccaggtggaaatcttttccttgaaccggccctcgccccgcacygtcaagtccttcccactggcagcccctgtgctctgcatggagtatatcccggagctggaggaggaggcggagagcagagacgagagcccgacagttgctg

SEQ ID NO: 3621 - DNA, 201 bp, Homo sapiens
cactggcagcccctgtgctctgcatggagtatatcccggagctggaggaggaggcggagagcagagacgagagcccgacagttgctgacccctcggccacrgtgcatccaaccatctgcctcgggctccaggatggcagcatcctcctctacagcagtgtggacactggcacccagtgcctggtgagctgcaggagcccag

SEQ ID NO: 3622 - DNA, 201 bp, Homo sapiens
cccgctgctctccatgcgggagccggcgcctgctgatggcgcagctttggagcacagcgaggaggacggctccatttacgagatggccgacgaccccgacrtctgggtgcgcagccggccctgcgcccgcgacgcccaccgcaaggagatttgctctgtggccatcatctccggcgggcagggctaccgcaactttggcag

SEQ ID NO: 3623 - DNA, 201 bp, Homo sapiens; identical to SEQ ID NO: 3609

SEQ ID NO: 3624 - DNA, 201 bp, Homo sapiens; identical to SEQ ID NO: 3610

SEQ ID NO: 3625 - DNA, 201 bp, Homo sapiens; identical to SEQ ID NO: 3614

SEQ ID NO: 3626 - DNA, 201 bp, Homo sapiens; identical to SEQ ID NO: 3616

SEQ ID NO: 3627 - DNA, 201 bp, Homo sapiens; identical to SEQ ID NO: 3619

SEQ ID NO: 3628 - DNA, 201 bp, Homo sapiens; identical to SEQ ID NO: 3620

SEQ ID NO: 3629 - DNA, 201 bp, Homo sapiens; identical to SEQ ID NO: 3611

SEQ ID NO: 3630 - DNA, 201 bp, Homo sapiens; identical to SEQ ID NO: 3613

SEQ ID NO: 3631 - DNA, 201 bp, Homo sapiens; identical to SEQ ID NO: 3612

SEQ ID NO: 3632 - DNA, 192 bp, Homo sapiens
acaaaggcgcgggcccgggcagccgaggtgggtgtgtagctgggacggtgctggtctgagctggaccttgtctgatggcttcctccaaccckcctccacagcctgccataggagatcagctggttccaggagtcccaggcccctcctctgaggcagaggacgacccaggagaggcgtttgagtttgatgaca

SEQ ID NO: 3633 - DNA, 201 bp, Homo sapiens
tccatcgtgcagagcgaaggcagctacgtggagtctctgaagcggatactccaggactaccgcaaccccctgatggagatggagcccaaggcgctgagcgyccgcaagtgccaggtggtgttcttccgcgtgaaggagatcctgcactgccactccatgttccagatcgccctgtcctcccgcgtggctgagtgggattcc

SEQ ID NO: 3634 - DNA, 201 bp, Homo sapiens
agcctgccttcctcgagttcctcaaggtgggcctccatggtgaccgtgtcaccctctacgggctgatggtcaagcccatccagaggttcccacagttcatmctcctgcttcaggacatgctgaagaacacccccaggggccatccggacaggctgtcgctgcagctggccctcacagagctggagacgctggctgagaagc

SEQ ID NO: 3635 - DNA, 201 bp, Homo sapiens
tgagtttgatgacagtgatgatgaagaggacaccagcgcagccctgggcgtccccagccttgctcctgagagggacacagaccccccactgatccacttgractccatccctgtcactgacccagacccagcagctgctccacccggcacaggggtgccagcctgggtgagcaatggggatgcagcggacgcagccttctc

SEQ ID NO: 3636 - DNA, 201 bp, Homo sapiens
gatcagctggttccaggagtcccaggcccctcctctgaggcagaggacgacccaggagaggcgtttgagtttgatgacagtgatgatgaagaggacaccarcgcagccctgggcgtccccagccttgctcctgagagggacacagaccccccactgatccacttggactccatccctgtcactgacccagacccagcagct

SEQ ID NO: 3637 - DNA, 201 bp, Homo sapiens; identical to SEQ ID NO: 3617

SEQ ID NO: 3638 - DNA, 201 bp, Homo sapiens; identical to SEQ ID NO: 3618

SEQ ID NO: 3639 - DNA, 201 bp, Homo sapiens; identical to SEQ ID NO: 3621

SEQ ID NO: 3640 - DNA, 201 bp, Homo sapiens; identical to SEQ ID NO: 3622

SEQ ID NO: 3641 - DNA, 201 bp, Homo sapiens; identical to SEQ ID NO: 3609

SEQ ID NO: 3642 - DNA, 201 bp, Homo sapiens; identical to SEQ ID NO: 3610

SEQ ID NO: 3643 - DNA, 201 bp, Homo sapiens; identical to SEQ ID NO: 3614

SEQ ID NO: 3644 - DNA, 201 bp, Homo sapiens; identical to SEQ ID NO: 3616

SEQ ID NO: 3645 - DNA, 201 bp, Homo sapiens; identical to SEQ ID NO: 3619

SEQ ID NO: 3646 - DNA, 201 bp, Homo sapiens; identical to SEQ ID NO: 3620

SEQ ID NO: 3647 - DNA, 201 bp, Homo sapiens; identical to SEQ ID NO: 3611

SEQ ID NO: 3648 - DNA, 201 bp, Homo sapiens
taattaagtccaaggagcgtcgggtcttcctgctcaacgacatgcttgtctgtgccaacatcaacttcaagcctgccaaccacaggggccagctggagatyagcagcctggtgcccctggggcccaagtatgtggtgaagtggaacacggcgctgccccaggtgcaggtggtggaggtgggccaggacggtggcacctatg

SEQ ID NO: 3649 - DNA, 201 bp, Homo sapiens; identical to SEQ ID NO: 3612

SEQ ID NO: 3650 - DNA, 192 bp, Homo sapiens; identical to SEQ ID NO: 3632

SEQ ID NO: 3651 - DNA, 201 bp, Homo sapiens; identical to SEQ ID NO: 3633

SEQ ID NO: 3652 - DNA, 201 bp, Homo sapiens
ccttcctcgagttcctcaagcgacggcaggtgtgcagcccagaccgtgtcaccctctacgggctgatggtcaagcccatccagaggttcccacagttcatmctcctgcttcaggacatgctgaagaacacccccaggggccatccggacaggctgtcgctgcagctggccctcacagagctggagacgctggctgagaagc

SEQ ID NO: 3653 - DNA, 201 bp, Homo sapiens; identical to SEQ ID NO: 3635

SEQ ID NO: 3654 - DNA, 201 bp, Homo sapiens; identical to SEQ ID NO: 3636

SEQ ID NO: 3655 - DNA, 201 bp, Homo sapiens
gtgccaacatcaacttcaagcctgccaaccacaggggccagctggagatcagcagcctggtgcccctggggcccaagtatgtggtgaagtggaacacggcrctgccccaggtgcaggtggtggaggtgggccaggacggtggcacctatgacaaggacaatgtgctcatccagcactcaggcgccaagaaggcctctgcct

SEQ ID NO: 3656 - DNA, 201 bp, Homo sapiens; identical to SEQ ID NO: 3618

SEQ ID NO: 3657 - DNA, 201 bp, Homo sapiens; identical to SEQ ID NO: 3621

SEQ ID NO: 3658 - DNA, 201 bp, Homo sapiens; identical to SEQ ID NO: 3622

SEQ ID NO: 3659 - DNA, 201 bp, Homo sapiens; identical to SEQ ID NO: 3609

SEQ ID NO: 3660 - DNA, 201 bp, Homo sapiens; identical to SEQ ID NO: 3610

SEQ ID NO: 3661 - DNA, 201 bp, Homo sapiens; identical to SEQ ID NO: 3614

SEQ ID NO: 3662 - DNA, 201 bp, Homo sapiens; identical to SEQ ID NO: 3616

SEQ ID NO: 3663 - DNA, 201 bp, Homo sapiens; identical to SEQ ID NO: 3619

SEQ ID NO: 3664 - DNA, 201 bp, Homo sapiens; identical to SEQ ID NO: 3620

SEQ ID NO: 3665 - DNA, 201 bp, Homo sapiens; identical to SEQ ID NO: 3611

SEQ ID NO: 3666 - DNA, 201 bp, Homo sapiens
ggcagctaattaagtccaaggagcgtcgggtcttcctgctcaacgacatgcttgtctgtgccaacatcaacttcaattccaacaggggccagctggagatyagcagcctggtgcccctggggcccaagtatgtggtgaagtggaacacggcgctgccccaggtgcaggtggtggaggtgggccaggacggtggcacctatg

SEQ ID NO: 3667 - DNA, 201 bp, Homo sapiens; identical to SEQ ID NO: 3612

SEQ ID NO: 3668 - DNA, 192 bp, Homo sapiens; identical to SEQ ID NO: 3632

SEQ ID NO: 3669 - DNA, 201 bp, Homo sapiens; identical to SEQ ID NO: 3633

SEQ ID NO: 3670 - DNA, 201 bp, Homo sapiens; identical to SEQ ID NO: 3652

SEQ ID NO: 3671 - DNA, 201 bp, Homo sapiens; identical to SEQ ID NO: 3635

SEQ ID NO: 3672 - DNA, 201 bp, Homo sapiens; identical to SEQ ID NO: 3636

SEQ ID NO: 3673 - DNA, 201 bp, Homo sapiens
ttgtctgtgccaacatcaacttcaattccaacaggggccagctggagatcagcagcctggtgcccctggggcccaagtatgtggtgaagtggaacacggcrctgccccaggtgcaggtggtggaggtgggccaggacggtggcacctatgacaaggacaatgtgctcatccagcactcaggcgccaagaaggcctctgcct

SEQ ID NO: 3674 - DNA, 201 bp, Homo sapiens; identical to SEQ ID NO: 3618

SEQ ID NO: 3675 - DNA, 201 bp, Homo sapiens; identical to SEQ ID NO: 3621

SEQ ID NO: 3676 - DNA, 201 bp, Homo sapiens; identical to SEQ ID NO: 3622

SEQ ID NO: 3677 - DNA, 201 bp, Homo sapiens; identical to SEQ ID NO: 3609

SEQ ID NO: 3678 - DNA, 201 bp, Homo sapiens; identical to SEQ ID NO: 3610

SEQ ID NO: 3679 - DNA, 201 bp, Homo sapiens; identical to SEQ ID NO: 3614

SEQ ID NO: 3680 - DNA, 201 bp, Homo sapiens; identical to SEQ ID NO: 3616

SEQ ID NO: 3681 - DNA, 201 bp, Homo sapiens; identical to SEQ ID NO: 3619

SEQ ID NO: 3682 - DNA, 201 bp, Homo sapiens; identical to SEQ ID NO: 3620

SEQ ID NO: 3683 - DNA, 201 bp, Homo sapiens; identical to SEQ ID NO: 3611

SEQ ID NO: 3684 - DNA, 201 bp, Homo sapiens; identical to SEQ ID NO: 3613

SEQ ID NO: 3685 - DNA, 201 bp, Homo sapiens; identical to SEQ ID NO: 3612

SEQ ID NO: 3686 - DNA, 192 bp, Homo sapiens; identical to SEQ ID NO: 3632

SEQ ID NO: 3687 - DNA, 201 bp, Homo sapiens; identical to SEQ ID NO: 3633

SEQ ID NO: 3688 - DNA, 201 bp, Homo sapiens; identical to SEQ ID NO: 3652

SEQ ID NO: 3689 - DNA, 201 bp, Homo sapiens; identical to SEQ ID NO: 3635

SEQ ID NO: 3690 - DNA, 201 bp, Homo sapiens; identical to SEQ ID NO: 3636

SEQ ID NO: 3691 - DNA, 201 bp, Homo sapiens; identical to SEQ ID NO: 3617

SEQ ID NO: 3692 - DNA, 201 bp, Homo sapiens; identical to SEQ ID NO: 3618

SEQ ID NO: 3693 - DNA, 201 bp, Homo sapiens; identical to SEQ ID NO: 3621

SEQ ID NO: 3694 - DNA, 201 bp, Homo sapiens; identical to SEQ ID NO: 3622

SEQ ID NO: 3695 - DNA, 201 bp, Homo sapiens; identical to SEQ ID NO: 3609

SEQ ID NO: 3696 - DNA, 201 bp, Homo sapiens; identical to SEQ ID NO: 3610

SEQ ID NO: 3697 - DNA, 201 bp, Homo sapiens; identical to SEQ ID NO: 3614

SEQ ID NO: 3698 - DNA, 201 bp, Homo sapiens; identical to SEQ ID NO: 3616

SEQ ID NO: 3699 - DNA, 201 bp, Homo sapiens; identical to SEQ ID NO: 3619

SEQ ID NO: 3700 - DNA, 201 bp, Homo sapiens; identical to SEQ ID NO: 3620

SEQ ID NO: 3701 - DNA, 201 bp, Homo sapiens; identical to SEQ ID NO: 3611

SEQ ID NO: 3702 - DNA, 201 bp, Homo sapiens; identical to SEQ ID NO: 3648

SEQ ID NO: 3703 - DNA, 201 bp, Homo sapiens; identical to SEQ ID NO: 3612

SEQ ID NO: 3704 - DNA, 192 bp, Homo sapiens; identical to SEQ ID NO: 3632

SEQ ID NO: 3705 - DNA, 201 bp, Homo sapiens; identical to SEQ ID NO: 3633

SEQ ID NO: 3706 - DNA, 201 bp, Homo sapiens; identical to SEQ ID NO: 3652

SEQ ID NO: 3707 - DNA, 201 bp, Homo sapiens; identical to SEQ ID NO: 3635

SEQ ID NO: 3708 - DNA, 201 bp, Homo sapiens; identical to SEQ ID NO: 3636

SEQ ID NO: 3709 - DNA, 201 bp, Homo sapiens; identical to SEQ ID NO: 3655

SEQ ID NO: 3710 - DNA, 201 bp, Homo sapiens; identical to SEQ ID NO: 3618

SEQ ID NO: 3711 - DNA, 201 bp, Homo sapiens; identical to SEQ ID NO: 3621

SEQ ID NO: 3712 - DNA, 201 bp, Homo sapiens; identical to SEQ ID NO: 3622

SEQ ID NO: 3713 - DNA, 201 bp, Homo sapiens
aattctcttacactagtgaggatgaggcctggaagacgtacctagaaaacccgttgacagctgccacaaaggccatgatgagagtcaatggagatgatgasagtgttgcggccttgagcttcctctatgattactacatgggtcccaaggagaagcggatattgtcctccagcactgggggcaggaatgaccaaggaaaga

SEQ ID NO: 3714 - DNA, 201 bp, Homo sapiens
agggggccttgcccacccctggcaaggcagctcccctccctgcaggccccagcaagctggaggccggctctgtggacagctacctgttacccaccactgayatgtatgataatggctccctcaactccttgtttgagagcattcatggggtgccgcccacacagcgctggcagccagacagcaccttcaaagatgacccac

SEQ ID NO: 3715 - DNA, 201 bp, Homo sapiens
atgtcaccatggttaccacctacccagaagactgttccctcctcccaagacccttgtctgcagtggtgctcctgcaggctgcccgttaagatggtggcggsacacgctccctcccgcagcaccacgccagctggtgcggcccccactctctgtcttccttcaacttcagacaaaggatttctcaacctttggtcagttaac

SEQ ID NO: 3716 - DNA, 201 bp, Homo sapiens
ctcaagaagaataacctgatgagcttggagggggccttgcccacccctggcaaggcagctcccctccctgcaggccccagcaagctggaggccggctctgyggacagctacctgttacccaccactgatatgtatgataatggctccctcaactccttgtttgagagcattcatggggtgccgcccacacagcgctggcag

SEQ ID NO: 3717 - DNA, 201 bp, Homo sapiens
ggaacaaagtgaccgctgtgtaaaactactgccttgccactcactgttgtatacatttcttatttacgattttcatttgttatatatatatataaatataytgtatatatatgcaacattttatatttttcatggatatgtttttatcatttcaaaaaatgtgtatttcacatttcttggactttttttagctgttattca

SEQ ID NO: 3718 - DNA, 201 bp, Homo sapiens
ggttccctgaagagaacatttacaaagtctacaagaaatgcaagcgaggaatcttagtcaacatggacaacaacatcattcagcattacagcaaccacgtygccttcctgctggacatgggggagctggacggcaaaattcagatcatccttaaggagctgtaaggcctctcgagcatccaaaccctcacgacctgcaagg

SEQ ID NO: 3719 - DNA, 201 bp, Homo sapiens
cactgtcctttgtgtggaacgtgaatgaagaggccaaggtgttcatcggcgtaaactgtctgagcacagacttttcctcacaaaagggggtgaagggtgtscccctgaacctgcagattgacacctatgactgtggcttgggcactgagcgcctggtacaccgtgctgtctgccagatcaagatcttctgtgacaagggag

SEQ ID NO: 3720 - DNA, 201 bp, Homo sapiens
accctgggctcccccaaagccatccacatcaagtcaggcgagtcacccatggcctacctcaacaaaggccagttctaccccgtcaccctgcggaccccagsaggtggcaaaggccttgccttgtcctccaacaaagtcaagagtgtggtgatggttgtcttcgacaatgagaaggtcccagtagagcagctgcgcttctgg

SEQ ID NO: 3721 - DNA, 201 bp, Homo sapiens
cggctgctaaagaacgacccagtcaacttgcagaaattctcttacactagtgaggatgaggcctggaagacgtacctagaaaacccgttgacagctgccasaaaggccatgatgagagtcaatggagatgatgacagtgttgcggccttgagcttcctctatgattactacatgggtcccaaggagaagcggatattgtcc

SEQ ID NO: 3722 - DNA, 201 bp, Homo sapiens
gatttgctcaagaagaataacctgatgagcttggagggggccttgcccacccctggcaaggcagctcccctccctgcaggccccagcaagctggaggccgyctctgtggacagctacctgttacccaccactgatatgtatgataatggctccctcaactccttgtttgagagcattcatggggtgccgcccacacagcgc

SEQ ID NO: 3723 - DNA, 201 bp, Homo sapiens
ccctgaagagaacatttacaaagtctacaagaaatgcaagcgaggggaaacttctctcctccacccacgcctgtctcgccaccccccacctgactgtcttwaatgttcccatcctgtgactcaagtgaggaacatgggttttggagatggattttggaggcagagggacctggattcaaatcccagccccaccaccgtcaa

SEQ ID NO: 3724 - DNA, 201 bp, Homo sapiens
gaacgtgtctggaaccccagagtacccagatttgctcaagaagaataacctgatgagcttggagggggccttgcccacccctggcaaggcagctcccctcyctgcaggccccagcaagctggaggccggctctgtggacagctacctgttacccaccactgatatgtatgataatggctccctcaactccttgtttgagag

SEQ ID NO: 3725 - DNA, 201 bp, Homo sapiens
actgtggagcacattgaggaggtggcctataatgcactgtcctttgtgtggaacgtgaatgaagaggccaaggtgttcatcggcgtaaactgtctgagcasagacttttcctcacaaaagggggtgaagggtgtccccctgaacctgcagattgacacctatgactgtggcttgggcactgagcgcctggtacaccgtgct

SEQ ID NO: 3726 - DNA, 201 bp, Homo sapiens
ggactaccccagcctcaaaagtgactttgaatacaccctgggctcccccaaagccatccacatcaagtcaggcgagtcacccatggcctacctcaacaaasgccagttctaccccgtcaccctgcggaccccagcaggtggcaaaggccttgccttgtcctccaacaaagtcaagagtgtggtgatggttgtcttcgacaa

SEQ ID NO: 3727 - DNA, 201 bp, Homo sapiens
gacagctgccacaaaggccatgatgagagtcaatggagatgatgacagtgttgcggccttgagcttcctctatgattactacatgggtcccaaggagaagyggatattgtcctccagcactgggggcaggaatgaccaaggaaagaggtactaccatggcatggaatatgagacggacctcactccccttgaaagccccac

SEQ ID NO: 3728 - DNA, 201 bp, Homo sapiens
ggcaaaattcagatcatccttaaggagctgtaaggcctctcgagcatccaaaccctcacgacctgcaaggggccagcagggacgtggccccacgccacacscaacctctccacatgcctcagcgctgttacttgaatgccttccctgagggaagaggcccttgagtcacagacccacagacgtcagggccagggagagacc

SEQ ID NO: 3729 - DNA, 201 bp, Homo sapiens
acccagaagactgttccctcctcccaagacccttgtctgcagtggtgctcctgcaggctgcccgttaagatggtggcggcacacgctccctcccgcagcaycacgccagctggtgcggcccccactctctgtcttccttcaacttcagacaaaggatttctcaacctttggtcagttaacttgaaaactcttgattttcag

SEQ ID NO: 3730 - DNA, 201 bp, Homo sapiens
cctggaagacgtacctagaaaacccgttgacagctgccacaaaggccatgatgagagtcaatggagatgatgacagtgttgcggccttgagcttcctctaygattactacatgggtcccaaggagaagcggatattgtcctccagcactgggggcaggaatgaccaaggaaagaggtactaccatggcatggaatatgaga

SEQ ID NO: 3731 - DNA, 201 bp, Homo sapiens
gacgccacccgtgctgttcatccccaatgtgcacttctccagcctgcagcgctctggaggggcagccccctcggcaggacccagcagctccaacaggctgyctctgaagcgtacctgctcgcccttcactgaggagtttgagcctctgccctccaagcaggccaaggaaggcgaccttcagagagttctgctgtatgtgcg

SEQ ID NO: 3732 - DNA, 201 bp, Homo sapiens
ccttgcccacccctggcaaggcagctcccctccctgcaggccccagcaagctggaggccggctctgtggacagctacctgttacccaccactgatatgtasgataatggctccctcaactccttgtttgagagcattcatggggtgccgcccacacagcgctggcagccagacagcaccttcaaagatgacccacaggagt

SEQ ID NO: 3733 - DNA, 201 bp, Homo sapiens
ccacatcaagtcaggcgagtcacccatggcctacctcaacaaaggccagttctaccccgtcaccctgcggaccccagcaggtggcaaaggccttgccttgscctccaacaaagtcaagagtgtggtgatggttgtcttcgacaatgagaaggtcccagtagagcagctgcgcttctggaagcactggcattcccggcaacc

SEQ ID NO: 3734 - DNA, 201 bp, Homo sapiens; identical to SEQ ID NO: 3713

SEQ ID NO: 3735 - DNA, 201 bp, Homo sapiens; identical to SEQ ID NO: 3714

SEQ ID NO: 3736 - DNA, 201 bp, Homo sapiens; identical to SEQ ID NO: 3715

SEQ ID NO: 3737 - DNA, 201 bp, Homo sapiens; identical to SEQ ID NO: 3716

SEQ ID NO: 3738 - DNA, 201 bp, Homo sapiens; identical to SEQ ID NO: 3717

SEQ ID NO: 3739 - DNA, 201 bp, Homo sapiens; identical to SEQ ID NO: 3718

SEQ ID NO: 3740 - DNA, 201 bp, Homo sapiens; identical to SEQ ID NO: 3719

SEQ ID NO: 3741 - DNA, 201 bp, Homo sapiens; identical to SEQ ID NO: 3720

SEQ ID NO: 3742 - DNA, 201 bp, Homo sapiens
gacccgacctttcaggagaccttgaagtatcaggtggcccctgcccagctggtgacccggcagctgcaggtctcggtgtggcatctgggcacgctggcccrgagagtgtttcttggagaagtgatcattcctctggccacgtgggactttgaagacagcacaacacagtccttccgctggcatccgctccgggccaaggcg

SEQ ID NO: 3743 - DNA, 201 bp, Homo sapiens
ctttcttcttctaaggagtatgacacagttaaaaaggaaaaaagaaccacaagcaaaacagttgccagtgaaataggagagggagctctttaaacaaggcyggctgcagctggcctccgccgctcatctgcagggcgtgagcgcttggtccatgcagtgaagctcttccaacctgggtcaacgaaaacggagaagaaatgg

SEQ ID NO: 3744 - DNA, 201 bp, Homo sapiens
aaaccatctcgaggaggttaggtgacccatggagcaccatgtcttgggttggtcagctccaacttaccagtgtacccccagggacaccacggcccctcacraaacctggccagaggacagcatagagcccagacgagtcggcggtagccctcccaccccacacacaagcacacacccgtgctgcttcgtgcctttgcaaag

SEQ ID NO: 3745 - DNA, 201 bp, Homo sapiens
cgaagacagcgttcctcagagtaatggagagctcacagtccgggctaagctggttctcccttcacggcccagaaaactccaagaggctcaagaagggacaratcagccatcacttcatggtcaactttgtttggtagtgctaggagccaagaatttacctgtgcggccagatggcaccttgaactcatttgttaagggctg

SEQ ID NO: 3746 - DNA, 201 bp, Homo sapiens
tggcttgaaaattacttctgctttgcagaaattatctgcttgcagctgtggataatttataacaatctctggtgaaacctcagaaaagagatatgcttttrtcttagatggatgtcagcagctgctgcagaacccggtgaaaacaccccccgggtagcacgaggctctgcgagccgtaactccgacaaacgcagaacttct

SEQ ID NO: 3747 - DNA, 201 bp, Homo sapiens
agatggcaccttgaactcatttgttaagggctgtctcactctgccagaccaacaaaaactgagactgaagtcgccagtcctgaggaagcaggcttgccccyagtggaaacactcatttgtcttcagtggcgtaaccccagctcagctgaggcagtcgagcttggagttaactgtctgggatcaggccctctttggaatgaa

SEQ ID NO: 3748 - DNA, 201 bp, Homo sapiens
aaaatttgtttctgtctcttgctacccacgtgaaaaagctctccaaatcccagaatgatatgacttctgagaagcatcttctcgccacgggccccaggcastgtgtgggacagacagagagacggagccagtctgacactgcggtcaacgtcaccaccaggaaggtcagtgcaccagatattctgaaacctctcaatcaag

SEQ ID NO: 3749 - DNA, 201 bp, Homo sapiens
agtggaaacactcatttgtcttcagtggcgtaaccccagctcagctgaggcagtcgagcttggagttaactgtctgggatcaggccctctttggaatgaaygaccgcttgcttggaggaaccagacttggttcaaagggagacacagctgttggcggggatgcatgctcacaatcgaagctccagtggcagaaagtccttt

SEQ ID NO: 3750 - DNA, 201 bp, Homo sapiens
aactgagactgaagtcgccagtcctgaggaagcaggcttgcccccagtggaaacactcatttgtcttcagtggcgtaaccccagctcagctgaggcagtcragcttggagttaactgtctgggatcaggccctctttggaatgaacgaccgcttgcttggaggaaccagacttggttcaaagggagacacagctgttggcg

SEQ ID NO: 3751 - DNA, 201 bp, Homo sapiens
ctgtctcactctgccagaccaacaaaaactgagactgaagtcgccagtcctgaggaagcaggcttgcccccagtggaaacactcatttgtcttcagtggcrtaaccccagctcagctgaggcagtcgagcttggagttaactgtctgggatcaggccctctttggaatgaacgaccgcttgcttggaggaaccagacttgg

SEQ ID NO: 3752 - DNA, 201 bp, Homo sapiens
gtctgggatcaggccctctttggaatgaacgaccgcttgcttggaggaaccagacttggttcaaagggagacacagctgttggcggggatgcatgctcacwatcgaagctccagtggcagaaagtcctttccagccccaatctatggacagacatgactcttgtcctgcactgacatgaaggcctcaaggttccaggttgc

SEQ ID NO: 3753 - DNA, 201 bp, Homo sapiens
ggagctctttaaacaaggctggctgcagctggcctccgccgctcatctgcagggcgtgagcgcttggtccatgcagtgaagctcttccaacctgggtcaaygaaaacggagaagaaatggcccaagaaatagatctgagtgctctcaaggagttagaacgcgaggccattctccaggtcctgtaccgagaccaggcggttc

SEQ ID NO: 3754 - DNA, 161 bp, Homo sapiens
gattcgagaataatcgcgagaatcaggcctgcttggcactattacaactggggaaaacaaaccagggcgcctccctggttcccagcccagaatgtttctgytgggtaactgctttctaaaggaactgggatctgagggagttcctagacttggagcactaa

SEQ ID NO: 3755 - DNA, 201 bp, Homo sapiens
tatcacttgtatataaatagtatatagctgatcattaataaggtgtataagtacaatgtattctaaaactgttaagccaaaaaaaaaaaaactaaaaaaawatccaagtgtcctcctccaccactcacgctggtgatcactgtgctctctgccagctgcgtggagtgacgggaggagggaatcactgtgtgtgcgagagtg

SEQ ID NO: 3756 - DNA, 201 bp, Homo sapiens
tcaggtggcccctgcccagctggtgacccggcagctgcaggtctcggtgtggcatctgggcacgctggcccggagagtgtttcttggagaagtgatcattyctctggccacgtgggactttgaagacagcacaacacagtccttccgctggcatccgctccgggccaaggcggagaaatacgaagacagcgttcctcagag

SEQ ID NO: 3757 - DNA, 201 bp, Homo sapiens
acaaatctgtattatcacttgtatataaatagtatatagctgatcattaataaggtgtataagtacaatgtattctaaaactgttaagccaaaaaaaaaaraactaaaaaaatatccaagtgtcctcctccaccactcacgctggtgatcactgtgctctctgccagctgcgtggagtgacgggaggagggaatcactgtg

SEQ ID NO: 3758 - DNA, 201 bp, Homo sapiens
cgtgctgcttcgtgcctttgcaaagcttttatttcatgtctgcggcatggaatccacctgcacatggcatcttagctgtgaaggagaaagcagtgcacgaraaggaatgagtgggcggaaccaacggcctccacaagctgccttccagcagcctgccaaggccatggcagagagagactgcaaacaaacacaagcaaacag

SEQ ID NO: 3759 - DNA, 201 bp, Homo sapiens
acacaagcacacacccgtgctgcttcgtgcctttgcaaagcttttatttcatgtctgcggcatggaatccacctgcacatggcatcttagctgtgaaggaraaagcagtgcacgagaaggaatgagtgggcggaaccaacggcctccacaagctgccttccagcagcctgccaaggccatggcagagagagactgcaaaca

SEQ ID NO: 3760 - DNA, 201 bp, Homo sapiens; identical to SEQ ID NO: 3742

SEQ ID NO: 3761 - DNA, 201 bp, Homo sapiens; identical to SEQ ID NO: 3743

SEQ ID NO: 3762 - DNA, 201 bp, Homo sapiens; identical to SEQ ID NO: 3744

SEQ ID NO: 3763 - DNA, 201 bp, Homo sapiens; identical to SEQ ID NO: 3745

SEQ ID NO: 3764 - DNA, 201 bp, Homo sapiens
catagtcaggtaccagcccagccaggtattgaacgggctgagcttttcatgatggttcctgctgacctggaaacatcttaaatggaagagatatgcttttrtcttagatggatgtcagcagctgctgcagaacccggtgaaaacaccccccgggtagcacgaggctctgcgagccgtaactccgacaaacgcagaacttct

SEQ ID NO: 3765 - DNA, 201 bp, Homo sapiens; identical to SEQ ID NO: 3747

SEQ ID NO: 3766 - DNA, 201 bp, Homo sapiens; identical to SEQ ID NO: 3748

SEQ ID NO: 3767 - DNA, 201 bp, Homo sapiens; identical to SEQ ID NO: 3749

SEQ ID NO: 3768 - DNA, 201 bp, Homo sapiens; identical to SEQ ID NO: 3750

SEQ ID NO: 3769 - DNA, 201 bp, Homo sapiens; identical to SEQ ID NO: 3751

SEQ ID NO: 3770 - DNA, 201 bp, Homo sapiens; identical to SEQ ID NO: 3752

SEQ ID NO: 3771 - DNA, 201 bp, Homo sapiens; identical to SEQ ID NO: 3753

SEQ ID NO: 3772 - DNA, 161 bp, Homo sapiens; identical to SEQ ID NO: 3754

SEQ ID NO: 3773 - DNA, 201 bp, Homo sapiens; identical to SEQ ID NO: 3755

SEQ ID NO: 3774 - DNA, 201 bp, Homo sapiens; identical to SEQ ID NO: 3756

SEQ ID NO: 3775 - DNA, 201 bp, Homo sapiens; identical to SEQ ID NO: 3757

SEQ ID NO: 3776 - DNA, 201 bp, Homo sapiens; identical to SEQ ID NO: 3758

SEQ ID NO: 3777 - DNA, 201 bp, Homo sapiens; identical to SEQ ID NO: 3759

SEQ ID NO: 3778 - DNA, 201 bp, Homo sapiens
cagatgaaggcccaggcccgggaggagaagcatcagaagcagctggagcggcaacagctggaaacagagaagaaaaggagagaaaccgtggagagagagaragagcagatgatgcgcgagaaggaggagttgatgctgcggctgcaggactatgaggagaagacaaagaaggcagagagagagctctcggagcagattcag

SEQ ID NO: 3779 - DNA, 175 bp, Homo sapiens
agcgcactcggcggacgcaagggcggcggggagcacacggagcactgcaggcgccgggttgggacagcgtcttcsctgctgctggatagtcgtgttttcggggatcgaggatactcaccagaaaccgaaaatgccgaaaccaatcaatgtccgagttaccaccatggatgcagag

SEQ ID NO: 3780 - DNA, 201 bp, Homo sapiens
gtgttttcggggatcgaggatactcaccagaaaccgaaaatgccgaaaccaatcaatgtccgagttaccaccatggatgcagagctggagtttgcaatccmgccaaatacaactggaaaacagctttttgatcaggtggtaaagactatcggcctccgggaagtgtggtactttggcctccactatgtggataataaagga

SEQ ID NO: 3781 - DNA, 201 bp, Homo sapiens
acaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgc

SEQ ID NO: 3782 - DNA, 201 bp, Homo sapiens
tggctgaggagctcatccaggacatcacccagaaacttttcttcctccaagtgaaggaaggaatccttagcgatgagatctactgcccccctgagactgcygtgctcttggggtcctacgctgtgcaggccaagtttggggactacaacaaagaagtgcacaagtctgggtacctcagctctgagcggctgatccctcaaa

SEQ ID NO: 3783 - DNA, 201 bp, Homo sapiens
gtgctcatagcgggcgctgccagccccgccacgcttgtctttagtgctccaagtctaggaactccctcagatcccagttcctttagaaagcagttacccarcagaaacattctgggctgggaaccagggaggcgccctggtttgttttccccagttgtaatagtgccaagcaggcctgattctcgcgattattctcgaatc

SEQ ID NO: 3784 - DNA, 201 bp, Homo sapiens
ggaggagctgcacctggtgatgacagcacccccgcccccaccaccccccgtgtacgagccggtgagctaccatgtccaggagagcttgcaggatgagggcscagagcccacgggctacagcgcggagctgtctagtgagggcatccgggatgaccgcaatgaggagaagcgcatcactgaggcagagaagaacgagcgtgt

SEQ ID NO: 3785 - DNA, 201 bp, Homo sapiens
cctcagctctgagcggctgatccctcaaagagtgatggaccagcacaaacttaccagggaccagtgggaggaccggatccaggtgtggcatgcggaacacygtgggatgctcaaagataatgctatgttggaatacctgaagattgctcaggacctggaaatgtatggaatcaactatttcgagataaaaaacaagaaagg

SEQ ID NO: 3786 - DNA, 201 bp, Homo sapiens
cactctcgcacacacagtgattccctcctcccgtcactccacgcagctggcagagagcacagtgatcaccagcgtgagtggtggaggaggacacttggatwtttttttagtttttttttttttggcttaacagttttagaatacattgtacttatacaccttattaatgatcagctatatactatttatatacaagtgata

SEQ ID NO: 3787 - DNA, 201 bp, Homo sapiens
gagaacatgaggcaaggccgggacaagtacaagacgctgcggcagatccggcagggcaacaccaagcagcgcatcgacgagttcgaggccctgtaacagcyaggccaggaccaagggcagaggggtgctcatagcgggcgctgccagccccgccacgcttgtctttagtgctccaagtctaggaactccctcagatcccag

SEQ ID NO: 3788 - DNA, 201 bp, Homo sapiens
cacagtgattccctcctcccgtcactccacgcagctggcagagagcacagtgatcaccagcgtgagtggtggaggaggacacttggatatttttttagttyttttttttttggcttaacagttttagaatacattgtacttatacaccttattaatgatcagctatatactatttatatacaagtgataatacagatttgt

SEQ ID NO: 3789 - DNA, 201 bp, Homo sapiens
ggtgcagcagatgaaggcccaggcccgggaggagaagcatcagaagcagctggagcggcaacagctggaaacagagaagaaaaggagagaaaccgtggagrgagagaaagagcagatgatgcgcgagaaggaggagttgatgctgcggctgcaggactatgaggagaagacaaagaaggcagagagagagctctcggagca

SEQ ID NO: 3790 - DNA, 201 bp, Homo sapiens
ccgggacaagtacaagacgctgcggcagatccggcagggcaacaccaagcagcgcatcgacgagttcgaggccctgtaacagccaggccaggaccaagggyagaggggtgctcatagcgggcgctgccagccccgccacgcttgtctttagtgctccaagtctaggaactccctcagatcccagttcctttagaaagcagt

SEQ ID NO: 3791 - DNA, 193 bp, Homo sapiens
ctgtttgcttgtgtttgtttgcagtctctctctgccatggccttggcaggctgctggaaggcagcttgtggaggccgttggttccgcccactcattccttytcgtgcactgctttctccttcacagctaagatgccatgtgcaggtggattccatgccgcagacatgaaataaaagctttgcaaaggcacgaa

SEQ ID NO: 3792 - DNA, 201 bp, Homo sapiens
gcagatgaaggcccaggcccgggaggagaagcatcagaagcagctggagcggcaacagctggaaacagagaagaaaaggagagaaaccgtggagagagagraagagcagatgatgcgcgagaaggaggagttgatgctgcggctgcaggactatgaggagaagacaaagaaggcagagagagagctctcggagcagattca

SEQ ID NO: 3793 - DNA, 178 bp, Homo sapiens
tgtttgcagtctctctctgccatggccttggcaggctgctggaaggcagcttgtggaggccgttggttccgcccactcattccttctcgtgcactgctttytccttcacagctaagatgccatgtgcaggtggattccatgccgcagacatgaaataaaagctttgcaaaggcacgaa

SEQ ID NO: 3794 - DNA, 201 bp, Homo sapiens; identical to SEQ ID NO: 3778

SEQ ID NO: 3795 - DNA, 187 bp, Homo sapiens
gagtgtcgggcgcggcaggaggacgaggcagggcgggcgggcgctctaagggttctgctctgactccaggttgggacagcgtcttcsctgctgctggatagtcgtgttttcggggatcgaggatactcaccagaaaccgaaaatgccgaaaccaatcaatgtccgagttaccaccatggatgcagag

SEQ ID NO: 3796 - DNA, 201 bp, Homo sapiens; identical to SEQ ID NO: 3780

SEQ ID NO: 3797 - DNA, 201 bp, Homo sapiens; identical to SEQ ID NO: 3781

SEQ ID NO: 3798 - DNA, 201 bp, Homo sapiens; identical to SEQ ID NO: 3782

SEQ ID NO: 3799 - DNA, 201 bp, Homo sapiens; identical to SEQ ID NO: 3783

SEQ ID NO: 3800 - DNA, 201 bp, Homo sapiens; identical to SEQ ID NO: 3784

SEQ ID NO: 3801 - DNA, 201 bp, Homo sapiens; identical to SEQ ID NO: 3785

SEQ ID NO: 3802 - DNA, 201 bp, Homo sapiens; identical to SEQ ID NO: 3786

SEQ ID NO: 3803 - DNA, 201 bp, Homo sapiens; identical to SEQ ID NO: 3787

SEQ ID NO: 3804 - DNA, 201 bp, Homo sapiens; identical to SEQ ID NO: 3788

SEQ ID NO: 3805 - DNA, 201 bp, Homo sapiens; identical to SEQ ID NO: 3789

SEQ ID NO: 3806 - DNA, 201 bp, Homo sapiens; identical to SEQ ID NO: 3790

SEQ ID NO: 3807 - DNA, 193 bp, Homo sapiens; identical to SEQ ID NO: 3791

SEQ ID NO: 3808 - DNA, 201 bp, Homo sapiens; identical to SEQ ID NO: 3792

SEQ ID NO: 3809 - DNA, 178 bp, Homo sapiens; identical to SEQ ID NO: 3793

SEQ ID NO: 3810 - DNA, 201 bp, Homo sapiens
ttccattcaggagcaaagagcaccatgattccaatcttgtgtgtgtttactaacccttccctgaggtttgtgtatgttggatattgtggtgttttagatcmctgagtgtacagaagagagaaattcaaacaaaatattgctgttcttcagttttgtttgtggaatttgaaattactcaaatttaaaataaattactggact

SEQ ID NO: 3811 - DNA, 177 bp, Homo sapiens
gaaaggaagaggaatgaggattgagacatgtgaagacattgtgcattatatcaatgtgcattcctgtagttcattaacaaggtacatgcaatagtctaaaraaccagagtcactactatagtggcttaacatttaatctgtctccaatattttaaccaagtgacaccgaggttttta

SEQ ID NO: 3812 - DNA, 201 bp, Homo sapiens
aatctcttaaatttagtgtatgtaaacagcttacaaatacgtattgtctaaatgcatttaaatctgttttattcaaagaaaagctaaagcaaaaacactgkcatatgaccatgcaagactgtcagtgccaacaaagacaacactaatcagcacatcgtacactggattgcagtgcttcccagattattgaaaaatgttaca

SEQ ID NO: 3813 - DNA, 201 bp, Homo sapiens
atcaccaatgttctacaaaatcctgatttggctctgagaatggctgtacgtaataacttagccggtgctgaagaactctttgcccggaaatttaatgctcwttttgcccagggaaattactcggaggcagcaaaggtggctgctaatgcaccaaagggaattcttcgtactccagacactatccgtcggttccagagtgtc

SEQ ID NO: 3814 - DNA, 201 bp, Homo sapiens
agaattcaagcctctgttgttaaatgatttgctgatggtgctgtctccacggttggatcacactcgtgcagtcaattatttcagcaaggttaaacagctaycactggtgaaaccgtatttgcgttcagttcagaaccataacaacaaatctgtgaatgaatcattgaacaatctttttattacagaagaagattatcaggc

SEQ ID NO: 3815 - DNA, 201 bp, Homo sapiens
tgctagtatgttttgctcacttcatatgtaacaggtgcccttatgttgtgctgtatcctgtgctttttctgtgggaccattccattcaggagcaaagagcmccatgattccaatcttgtgtgtgtttactaacccttccctgaggtttgtgtatgttggatattgtggtgttttagatcactgagtgtacagaagagagaa

SEQ ID NO: 3816 - DNA, 201 bp, Homo sapiens; identical to SEQ ID NO: 3814

SEQ ID NO: 3817 - DNA, 201 bp, Homo sapiens
taaaacttaaaatccctgtcccaccaggtgtggtggctcatgcctgtaatcccagcactttgggaggctgaggcaggcggattgcttgaggccaggagttygagacaagcctgaccaacatggtgactccatctctactaaaaataaaaaatcagccaggtgtgatggtggatgcctataagatcctagctgctactcagg

SEQ ID NO: 3818 - DNA, 201 bp, Homo sapiens; identical to SEQ ID NO: 3810

SEQ ID NO: 3819 - DNA, 201 bp, Homo sapiens
gaaaggaagaggaatgaggattgagacatgtgaagacattgtgcattatatcaatgtgcattcctgtagttcattaacaaggtacatgcaatagtctaaaraaccagagtcactactatagtggcttaacatttaatctgtctccaatattttaaccaagtgacaccgaggtttttatcgaagcatttcacttaaatgaac

SEQ ID NO: 3820 - DNA, 201 bp, Homo sapiens; identical to SEQ ID NO: 3812

SEQ ID NO: 3821 - DNA, 201 bp, Homo sapiens; identical to SEQ ID NO: 3813

SEQ ID NO: 3822 - DNA, 201 bp, Homo sapiens; identical to SEQ ID NO: 3815

SEQ ID NO: 3823 - DNA, 201 bp, Homo sapiens
acaatggtgcccctgctttgatttgtgggaggtgccatcagttttccccaccactgcttttgcaccctcagtgcaaatatcaacacagagaaaaaaaaaawtaatagtattatgaaaacattgactctgtggagaccctgtgggttctgcagagtatactttgaaaactataagattatgagttctataaaataccaagta

SEQ ID NO: 3824 - DNA, 201 bp, Homo sapiens; identical to SEQ ID NO: 3810

SEQ ID NO: 3825 - DNA, 177 bp, Homo sapiens; identical to SEQ ID NO: 3811

SEQ ID NO: 3826 - DNA, 201 bp, Homo sapiens; identical to SEQ ID NO: 3812

SEQ ID NO: 3827 - DNA, 201 bp, Homo sapiens; identical to SEQ ID NO: 3813

SEQ ID NO: 3828 - DNA, 201 bp, Homo sapiens; identical to SEQ ID NO: 3814

SEQ ID NO: 3829 - DNA, 201 bp, Homo sapiens; identical to SEQ ID NO: 3815

SEQ ID NO: 3830 - DNA, 201 bp, Homo sapiens
ggaaatgcatgtacacccctaagatgcccatcgcgcagccctgcaacatttttgactgccctaaatggctggcacaggagtggtctccgtgcacagtgacrtgtggccagggcctcagataccgtgtggtcctctgcatcgaccatcgaggaatgcacacaggaggctgtagcccaaaaacaaagccccacataaaagagg

SEQ ID NO: 3831 - DNA, 201 bp, Homo sapiens
ccctatggaagtagacatattcgccttgtcttaaaaggtcctgatcacttatatctggaaaccaaaaccctccaggggactaaaggtgaaaacagtctcarctccacaggaactttccttgtggacaattctagtgtggacttccagaaatttccagacaaagagatactgagaatggctggaccactcacagcagatttc

SEQ ID NO: 3832 - DNA, 201 bp, Homo sapiens
aatgctgccgtcgggcaactcctggcacactgctcctctttctggctttcctgctcctgagttccaggaccgcacgctccgaggaggaccgggacggcctrtgggatgcctggggcccatggagtgaatgctcacgcacctgcgggggtggggcctcctactctctgaggcgctgcctgagcagcaagagctgtgaaggaa

SEQ ID NO: 3833 - DNA, 201 bp, Homo sapiens
tcctgctcctgagttccaggaccgcacgctccgaggaggaccgggacggcctatgggatgcctggggcccatggagtgaatgctcacgcacctgcgggggwggggcctcctactctctgaggcgctgcctgagcagcaagagctgtgaaggaagaaatatccgatacagaacatgcagtaatgtggactgcccaccagaag

SEQ ID NO: 3834 - DNA, 135 bp, Homo sapiens
ctgccctttatgtttccacatctgcaaagtgaactggttgtacctgatgatctgagatcccatgacttgctcacatgtcccatgattctttattttgtagkcagaagcattaaacagctactcctgctgctgtgt

SEQ ID NO: 3835 - DNA, 164 bp, Homo sapiens
aactagctctgtggcctagggcgaggtgtctgccctttatgtttccacatctgcaaagtgaactggttgtacctgatgatctgagatcccatgacttgctyacatgtcccatgattctttattttgtaggcagaagcattaaacagctactcctgctgctgtgt

SEQ ID NO: 3836 - DNA, 201 bp, Homo sapiens; identical to SEQ ID NO: 3830

SEQ ID NO: 3837 - DNA, 201 bp, Homo sapiens; identical to SEQ ID NO: 3831

SEQ ID NO: 3838 - DNA, 201 bp, Homo sapiens; identical to SEQ ID NO: 3832

SEQ ID NO: 3839 - DNA, 201 bp, Homo sapiens; identical to SEQ ID NO: 3833

SEQ ID NO: 3840 - DNA, 201 bp, Homo sapiens
gccaagttgccatggttcaaacaagctcaagagctagaagaaggagctgctgtgtcagaggagccctcgtaagttgtaaaagcacagactgttctatattkgaaactgttttgtttaaagaaagcagtgtctcactggttgtagctttcatgggttctgaactaagtgtaatcatctcaccaaagctttttggctctcaaa

SEQ ID NO: 3841 - DNA, 201 bp, Homo sapiens
cagcgagtggcttctctcagactggacagagtgttccacaagctgcggggaaggcacccagactcgaagcgccatttgccgaaagatgctgaaaaccggcmtctcaacggttgtcaattccaccctgtgcccgcccctgcctttctcttcctccatcaggccctgtatgctggcaacctgtgcaaggcccgggcggccatc

SEQ ID NO: 3842 - DNA, 201 bp, Homo sapiens; identical to SEQ ID NO: 3830

SEQ ID NO: 3843 - DNA, 201 bp, Homo sapiens
agagcaagtgctcctgcacctgcccttcaccatggtgaccgagcagcggcgcctggacgacatcctggggaacctctcccagcagcccgaggagctgcgcracctctacagcaagcacctggtggcccagctggcccaggagatcttccgcagccacctggagcaccaggacacgctcctgaagccctcggagcgcaggac

SEQ ID NO: 3844 - DNA, 201 bp, Homo sapiens
cttcctccatcaggccctgtatgctggcaacctgtgcaaggcccgggcggccatccacgaagcacagcccgcacatcgcggccgccaggaaggtctacatmcagactcgcaggcagaggaagctgcacttcgtggtggggggcttcgcctacctgctccccaagacggcggtggtgctgcgctgcccggcgcgcagggtcc

SEQ ID NO: 3845 - DNA, 201 bp, Homo sapiens; identical to SEQ ID NO: 3832

SEQ ID NO: 3846 - DNA, 201 bp, Homo sapiens
ccgccaacccggggagccgctacgacgacctcgtctcccggctgctggagcagggcggctggcccggagagctgctggcctcgtgggaggcgcaggactcygcggaaaggaacacgacctcggaggaggacccgggtgcagagcaagtgctcctgcacctgcccttcaccatggtgaccgagcagcggcgcctggacgaca

SEQ ID NO: 3847 - DNA, 201 bp, Homo sapiens
gaaaaccggcatctcaacggttgtcaattccaccctgtgcccgcccctgcctttctcttcctccatcaggccctgtatgctggcaacctgtgcaaggcccrggcggccatccacgaagcacagcccgcacatcgcggccgccaggaaggtctacatccagactcgcaggcagaggaagctgcacttcgtggtggggggctt

SEQ ID NO: 3848 - DNA, 201 bp, Homo sapiens
tgtctggcttcagcagctccctgcggacctcctccaccggggacgccgggggaggctctcgaaggccacaccgcaagcccaccatcctgcgcaagatctcrgcggcccagcagctctcagcctcggaggtggtcacccacctggggcagacggtggccctggccagcgggacactgagtgttcttctgcactgtgaggcca

SEQ ID NO: 3849 - DNA, 201 bp, Homo sapiens
tgtgcccgcccctgcctttctcttcctccatcaggccctgtatgctggcaacctgtgcaaggcccgggcggccatccacgaagcacagcccgcacatcgcrgccgccaggaaggtctacatccagactcgcaggcagaggaagctgcacttcgtggtggggggcttcgcctacctgctccccaagacggcggtggtgctgc

SEQ ID NO: 3850 - DNA, 201 bp, Homo sapiens
aggcaggggtgctcatgcagaaggcatctttagtgatccaagattactggtggtctgtggacagactggcaacctgctcagcctcctgtggtaaccggggrgttcagcagccccgcttgaggtgcctgctgaacagcacggaggtcaaccctgcccactgcgcagggaaggttcgccctgcggtgcagcccatcgcgtgca

SEQ ID NO: 3851 - DNA, 201 bp, Homo sapiens; identical to SEQ ID NO: 3831

SEQ ID NO: 3852 - DNA, 201 bp, Homo sapiens; identical to SEQ ID NO: 3833

SEQ ID NO: 3853 - DNA, 201 bp, Homo sapiens
ttaacttatcaacatcaacccattaactagtcactgtgccagagagtatctgtcaggctgtcaggctgtcaggttgtagcaacctcttcattccagagctrgcccagggaccggggtgggacaatgggtttatgcgtgtccacagtacaccctccctctcccagcctccaccccagggtctgcaggtcctccggcatgtag

SEQ ID NO: 3854 - DNA, 201 bp, Homo sapiens
tgaggctcatggaccagctctgatcccatgcatgtgcgcatgctcagagccctgctgcccacaacagagcactgcgctgcgtgggagtccccacttcccargctatcagagtcaacgtcctgcctgtgcagctgcagcaaagccagtgagaggtgggtctcgccatgcagtaaggccaccctggcacctctttatctaaat

SEQ ID NO: 3855 - DNA, 201 bp, Homo sapiens
gccccaccgggtaccctgagcagctccacactcttcttgaggtgtctagaagcctaccagcttagctcctggagtaggaatgccccaaatccagcatgacsaaaagtaaatgatgtttttttaaagtgtctttcttcaagtttcttcaagaagcctctattgttccccagataatgttccctcaaatagcacggggaagca

SEQ ID NO: 3856 - DNA, 201 bp, Homo sapiens; identical to SEQ ID NO: 3831

SEQ ID NO: 3857 - DNA, 201 bp, Homo sapiens; identical to SEQ ID NO: 3832

SEQ ID NO: 3858 - DNA, 201 bp, Homo sapiens; identical to SEQ ID NO: 3833

SEQ ID NO: 3859 - DNA, 122 bp, Homo sapiens
gcaatataatttagctataatcgtagtttaaattttttgatatccatgtaggggtatttcccatatttttggaagtagcggtcattagcaaagtaactaartaaaatacagtgctggtagtc

SEQ ID NO: 3860 - DNA, 201 bp, Homo sapiens
ctaaatggctggcacaggagtggtctccggtaactgtgccttctttctttgttcattaggagagtaagtccactcttccctctcatcatcatggccccacygggtaccctgagcagctccacactcttcttgaggtgtctagaagcctaccagcttagctcctggagtaggaatgccccaaatccagcatgaccaaaagta

SEQ ID NO: 3861 - DNA, 201 bp, Homo sapiens
agcatgaccaaaagtaaatgatgtttttttaaagtgtctttcttcaagtttcttcaagaagcctctattgttccccagataatgttccctcaaatagcacrgggaagcaactgcctttcaagggtaattgaggctgaatgaatgatcccgaatctgtaaaagctgctttgatgatagagctcagtagaccagaagtttgat

SEQ ID NO: 3862 - DNA, 201 bp, Homo sapiens; identical to SEQ ID NO: 3850

SEQ ID NO: 3863 - DNA, 201 bp, Homo sapiens; identical to SEQ ID NO: 3853

SEQ ID NO: 3864 - DNA, 201 bp, Homo sapiens; identical to SEQ ID NO: 3854

SEQ ID NO: 3865 - DNA, 201 bp, Homo sapiens
tctttcacctgttttcttcctccagatacttactgaggcagaggagagtgggtggtgggaaaaaagagtgggttgggggtaaggagggaatcttttttttsacgcttttgctttaaaattcagagttggattggtcaggatttatgggctctttgccatgtaaatttttctcattctccaggttctagccctccaggttca

SEQ ID NO: 3866 - DNA, 201 bp, Homo sapiens
cgaccatcatggaaaacatccgctttgggaagctggaagcttccgatgaagaggtgtacacagccgcccgggaagcgaatgctcacgagttcatcaccagyttccccgagggctacaacacggtcgtcggtgaacggggcactaccctgtctgggggccagaagcagcgcctggccatcgcccgagcccttatcaagcagc

SEQ ID NO: 3867 - DNA, 201 bp, Homo sapiens
gggactgctgaccttcgggtacctggtgctgctgtcccacgttggcgagcgcatggctgtggacatgcggagggccctcttcagctccctgctccgacaaracatcaccttctttgacgccaataagacagggcagctggtgagccgcttgacaactgacgtgcaggagtttaagtcatccttcaagcttgtcatctccca

SEQ ID NO: 3868 - DNA, 201 bp, Homo sapiens
gtccatgctgtcgacacgcctcacgctgctgctgatggtggccacaccagccctgatgggagtgggcaccctgatgggctcaggcctccgaaaattgtctygccagtgtcaggagcagatcgccagggcaatgggcgtagcagacgaggccctgggcaatgtgcggactgtgcgtgccttcgccatggagcaacgggaaga

SEQ ID NO: 3869 - DNA, 201 bp, Homo sapiens
gtccgggggctgagtgcaggtgcccgggtctttgagtacatggccctgaacccctgcatcccactgtctgggggctgctgcgtccccaaagagcagctgcktggctccgttacatttcagaacgtctgcttcagctacccctgccgccccggcttcgaggtgctgaaagacttcaccctgacgctgccccctggcaagatc

SEQ ID NO: 3870 - DNA, 201 bp, Homo sapiens
tctgggaggctgggacacatgaagagctcctgaagaaaggcgggctatacgccgagctcatccggaggcaggccctggatgccccgaggacagcggccccmccgcccaaaaagccagaaggccccaggagccaccagcacaagtcctgagaagggccccctgaggtgtggtcgctgccaagcatcagtgttagggctgggg

SEQ ID NO: 3871 - DNA, 201 bp, Homo sapiens
tcctggctccggggccaggttgtcggcttcatcagccaggagcccgtcctgtttgggacgaccatcatggaaaacatccgctttgggaagctggaagcttscgatgaagaggtgtacacagccgcccgggaagcgaatgctcacgagttcatcaccagcttccccgagggctacaacacggtcgtcggtgaacggggcact

SEQ ID NO: 3872 - DNA, 201 bp, Homo sapiens
aggagaagaggtggtacctgcaatgcaccttcacagccaggcaagcattctggatttaccctgtgtaaagaagggtggtaccctctttcaggggtgtgatrcagtgcattgatggagcagctggtgctgctgggaggccagcctggaagaggcagcagtggctcaagtttgcgtgcaggagccagagtgggacccacgggc

SEQ ID NO: 3873 - DNA, 201 bp, Homo sapiens
gaggccaatccctccctcccctccccagtcctgccggctgcctccctcccaccagagtctgccagagtcattgggctgcaatgggcagagacagagttccmcgagacacctccactctattctccctttgcccagacccctccagacctctcaagagacgttctggccagtctccctgccccacccagcagcttcaaattg

SEQ ID NO: 3874 - DNA, 201 bp, Homo sapiens
tgggctcaggcctccgaaaattgtctcgccagtgtcaggagcagatcgccagggcaatgggcgtagcagacgaggccctgggcaatgtgcggactgtgcgwgccttcgccatggagcaacgggaagaggagcgctatggggcagagctggaagcctgccgctgccgggcagaggagctgggccgcggcatcgccttgttcc

SEQ ID NO: 3875 - DNA, 201 bp, Homo sapiens
ccctgacgctgccccctggcaagatcgtggccctcgtgggccagtctggcggaggaaagaccaccgtggcttccctgctggagcgcttctacgaccccacrgcaggcgtggtgatgctggatgggcgggacctgcgcacccttgacccctcctggctccggggccaggttgtcggcttcatcagccaggagcccgtcctgt

SEQ ID NO: 3876 - DNA, 201 bp, Homo sapiens
acccttgctaggacctcacttccctagactggcgactgactccctctcctgtgtccccactccctccatgggagaaggagcctatcccctggctcaccccrggacccacagtccccatcttccaaacaacctccctcctttctccctgcacagtgaacacagtcctgatttctagatttcacctcccctccccacccacaa

SEQ ID NO: 3877 - DNA, 201 bp, Homo sapiens
gaagagctcctgaagaaaggcgggctatacgccgagctcatccggaggcaggccctggatgccccgaggacagcggccccaccgcccaaaaagccagaagkccccaggagccaccagcacaagtcctgagaagggccccctgaggtgtggtcgctgccaagcatcagtgttagggctggggctcagcctgggggagcctac

SEQ ID NO: 3878 - DNA, 201 bp, Homo sapiens
ccccacggcaggcgtggtgatgctggatgggcgggacctgcgcacccttgacccctcctggctccggggccaggttgtcggcttcatcagccaggagcccrtcctgtttgggacgaccatcatggaaaacatccgctttgggaagctggaagcttccgatgaagaggtgtacacagccgcccgggaagcgaatgctcacga

SEQ ID NO: 3879 - DNA, 201 bp, Homo sapiens; identical to SEQ ID NO: 3867

SEQ ID NO: 3880 - DNA, 201 bp, Homo sapiens
ccctcctgccagctccacaccccatgtcgtggggtctcgctttaactggaagctcttctggcagtttctgcacccccacctgctggtcctgggggtagccrtcgtgctggccttgggtgcggcactcgtgaatgtacagatccccctgctcctgggccagctggtagaggtcgtggccaagtacacaagggaccacgtagg

SEQ ID NO: 3881 - DNA, 201 bp, Homo sapiens; identical to SEQ ID NO: 3868

SEQ ID NO: 3882 - DNA, 201 bp, Homo sapiens
agggggagacctcatgtccttcctggtggcctcccagacagtgcaaagcttcctccgtgttgcaccctgtccgaattcccttccgctgcaggctgtgacaytccatgcatggaaggaccatccttgacaggctgtgtgagctgcccttccccatgcctgccacttccagggatgacaagctgacccctgtccccacacacc

SEQ ID NO: 3883 - DNA, 201 bp, Homo sapiens; identical to SEQ ID NO: 3874

SEQ ID NO: 3884 - DNA, 201 bp, Homo sapiens
tttcgggtcgggattcggggtggcccattcccaggcaggctgctaccgcccctccgcttccagacattctcagctgtcaggtactctgatggctaccgcarctcctccctcctccgggccgtggcccacctgcggtcccagctctgggcccacctccctcgagcccccctagctcccagatggagcccctctgcctggtgc

SEQ ID NO: 3885 - DNA, 201 bp, Homo sapiens; identical to SEQ ID NO: 3866

SEQ ID NO: 3886 - DNA, 201 bp, Homo sapiens; identical to SEQ ID NO: 3867

SEQ ID NO: 3887 - DNA, 201 bp, Homo sapiens; identical to SEQ ID NO: 3880

SEQ ID NO: 3888 - DNA, 201 bp, Homo sapiens; identical to SEQ ID NO: 3868

SEQ ID NO: 3889 - DNA, 201 bp, Homo sapiens; identical to SEQ ID NO: 3869

SEQ ID NO: 3890 - DNA, 201 bp, Homo sapiens; identical to SEQ ID NO: 3871

SEQ ID NO: 3891 - DNA, 201 bp, Homo sapiens; identical to SEQ ID NO: 3872

SEQ ID NO: 3892 - DNA, 201 bp, Homo sapiens; identical to SEQ ID NO: 3884

SEQ ID NO: 3893 - DNA, 201 bp, Homo sapiens; identical to SEQ ID NO: 3873

SEQ ID NO: 3894 - DNA, 201 bp, Homo sapiens
actagatggtgctttggggacaagccatccaaaaaccccaggcccacatccaccctgatttgatatcccacttcctgacagatcagaggctgtgtctttargcagtggaggtccaggagcagagcctggggctggttcacagctaaacccctccttagggcagcccagagtagggcctcagctggcaagtccacaagccct

SEQ ID NO: 3895 - DNA, 201 bp, Homo sapiens; identical to SEQ ID NO: 3875

SEQ ID NO: 3896 - DNA, 201 bp, Homo sapiens; identical to SEQ ID NO: 3876

SEQ ID NO: 3897 - DNA, 201 bp, Homo sapiens
gcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatcta

SEQ ID NO: 3898 - DNA, 201 bp, Homo sapiens
ggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatct

SEQ ID NO: 3899 - DNA, 201 bp, Homo sapiens
gggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatc

SEQ ID NO: 3900 - DNA, 201 bp, Homo sapiens; identical to SEQ ID NO: 3870

SEQ ID NO: 3901 - DNA, 201 bp, Homo sapiens; identical to SEQ ID NO: 3874

SEQ ID NO: 3902 - DNA, 201 bp, Homo sapiens; identical to SEQ ID NO: 3877

SEQ ID NO: 3903 - DNA, 201 bp, Homo sapiens; identical to SEQ ID NO: 3878

SEQ ID NO: 3904 - DNA, 201 bp, Homo sapiens; identical to SEQ ID NO: 3867

SEQ ID NO: 3905 - DNA, 201 bp, Homo sapiens; identical to SEQ ID NO: 3866

SEQ ID NO: 3906 - DNA, 201 bp, Homo sapiens; identical to SEQ ID NO: 3868

SEQ ID NO: 3907 - DNA, 201 bp, Homo sapiens
agaggtcgtggccaagtacacaagggaccacgtagggagtttcatgactgagtcccagaatctcagcacccacctgcttatcctctatggtgtccaggtayagccgggagtggggctggggaccgccgaggagccacccgaggcatccctgagtgcactgggctctttcgcagggactgctgaccttcgggtacctggtgc

SEQ ID NO: 3908 - DNA, 201 bp, Homo sapiens; identical to SEQ ID NO: 3869

SEQ ID NO: 3909 - DNA, 201 bp, Homo sapiens; identical to SEQ ID NO: 3870

SEQ ID NO: 3910 - DNA, 201 bp, Homo sapiens; identical to SEQ ID NO: 3871

SEQ ID NO: 3911 - DNA, 201 bp, Homo sapiens; identical to SEQ ID NO: 3872

SEQ ID NO: 3912 - DNA, 201 bp, Homo sapiens; identical to SEQ ID NO: 3873

SEQ ID NO: 3913 - DNA, 201 bp, Homo sapiens; identical to SEQ ID NO: 3874

SEQ ID NO: 3914 - DNA, 201 bp, Homo sapiens; identical to SEQ ID NO: 3875

SEQ ID NO: 3915 - DNA, 201 bp, Homo sapiens; identical to SEQ ID NO: 3876

SEQ ID NO: 3916 - DNA, 201 bp, Homo sapiens; identical to SEQ ID NO: 3877

SEQ ID NO: 3917 - DNA, 201 bp, Homo sapiens; identical to SEQ ID NO: 3878

SEQ ID NO: 3918 - DNA, 201 bp, Homo sapiens; identical to SEQ ID NO: 3866

SEQ ID NO: 3919 - DNA, 201 bp, Homo sapiens; identical to SEQ ID NO: 3867

SEQ ID NO: 3920 - DNA, 201 bp, Homo sapiens; identical to SEQ ID NO: 3880

SEQ ID NO: 3921 - DNA, 201 bp, Homo sapiens; identical to SEQ ID NO: 3868

SEQ ID NO: 3922 - DNA, 201 bp, Homo sapiens; identical to SEQ ID NO: 3869

SEQ ID NO: 3923 - DNA, 201 bp, Homo sapiens; identical to SEQ ID NO: 3870

SEQ ID NO: 3924 - DNA, 201 bp, Homo sapiens; identical to SEQ ID NO: 3871

SEQ ID NO: 3925 - DNA, 201 bp, Homo sapiens
tttcgggtcgggattcggggtggcccattcccaggcaggctgctaccgcccctccgcttccagacattctcagctgtcaggtactctgatggctaccgcarctcctccctcctccgggccgtggcccacctgcggtcccagctctgggcccacctccctcgaccctgctaggccccatggtactgagtaagcatccccacc

SEQ ID NO: 3926 - DNA, 201 bp, Homo sapiens; identical to SEQ ID NO: 3873

SEQ ID NO: 3927 - DNA, 201 bp, Homo sapiens; identical to SEQ ID NO: 3874

SEQ ID NO: 3928 - DNA, 201 bp, Homo sapiens; identical to SEQ ID NO: 3875

SEQ ID NO: 3929 - DNA, 201 bp, Homo sapiens; identical to SEQ ID NO: 3877

SEQ ID NO: 3930 - DNA, 201 bp, Homo sapiens; identical to SEQ ID NO: 3878

SEQ ID NO: 3931 - DNA, 201 bp, Homo sapiens; identical to SEQ ID NO: 3866

SEQ ID NO: 3932 - DNA, 201 bp, Homo sapiens; identical to SEQ ID NO: 3867

SEQ ID NO: 3933 - DNA, 201 bp, Homo sapiens; identical to SEQ ID NO: 3868

SEQ ID NO: 3934 - DNA, 201 bp, Homo sapiens
ctccagtcgccagcaggaggctcctgcgtctgcagccgcgtgtcagccagaaggaggggacgctcggggtcagtgaccacgcccagtccgcactcccgacygggggtcccctttcctggccctggaggtgattgcgcgatttggacgaaaattcttattagtatgaagagacatttaatgtagtggtgcttccaggattca

SEQ ID NO: 3935 - DNA, 201 bp, Homo sapiens
gggtcgggattcggggtggcccattcccaggcaggctgctaccgcccctccgcttccagacattctcagctgtcaggtaaaaacggaaaaacctactcagmgcgggccattgaccgcccggcagggcagtgccggcccgccgggagatggagtccacgagcttgcgcgaggcttgctgggagctgtaggccaggcctaccg

SEQ ID NO: 3936 - DNA, 201 bp, Homo sapiens; identical to SEQ ID NO: 3869

SEQ ID NO: 3937 - DNA, 201 bp, Homo sapiens; identical to SEQ ID NO: 3870

SEQ ID NO: 3938 - DNA, 201 bp, Homo sapiens; identical to SEQ ID NO: 3871

SEQ ID NO: 3939 - DNA, 201 bp, Homo sapiens; identical to SEQ ID NO: 3872

SEQ ID NO: 3940 - DNA, 201 bp, Homo sapiens; identical to SEQ ID NO: 3873

SEQ ID NO: 3941 - DNA, 201 bp, Homo sapiens; identical to SEQ ID NO: 3874

SEQ ID NO: 3942 - DNA, 201 bp, Homo sapiens; identical to SEQ ID NO: 3875

SEQ ID NO: 3943 - DNA, 201 bp, Homo sapiens; identical to SEQ ID NO: 3876

SEQ ID NO: 3944 - DNA, 201 bp, Homo sapiens; identical to SEQ ID NO: 3877

SEQ ID NO: 3945 - DNA, 201 bp, Homo sapiens; identical to SEQ ID NO: 3878

SEQ ID NO: 3946 - DNA, 201 bp, Homo sapiens; identical to SEQ ID NO: 3866

SEQ ID NO: 3947 - DNA, 201 bp, Homo sapiens; identical to SEQ ID NO: 3870

SEQ ID NO: 3948 - DNA, 201 bp, Homo sapiens
gtttctatggactctgtctccataacccctcacccacaggagcccgtcctgtttgggacgaccatcatggaaaacatccgctttgggaagctggaagcttscgatgaagaggtgtacacagccgcccgggaagcgaatgctcacgagttcatcaccagcttccccgagggctacaacacggtcgtcggtgaacggggcact

SEQ ID NO: 3949 - DNA, 201 bp, Homo sapiens; identical to SEQ ID NO: 3872

SEQ ID NO: 3950 - DNA, 201 bp, Homo sapiens; identical to SEQ ID NO: 3873

SEQ ID NO: 3951 - DNA, 201 bp, Homo sapiens; identical to SEQ ID NO: 3876

SEQ ID NO: 3952 - DNA, 201 bp, Homo sapiens; identical to SEQ ID NO: 3877

SEQ ID NO: 3953 - DNA, 201 bp, Homo sapiens
gatagactgtcccattgtgtatggtggcccctccagtttctggggcaaagagaatgtttctatggactctgtctccataacccctcacccacaggagcccrtcctgtttgggacgaccatcatggaaaacatccgctttgggaagctggaagcttccgatgaagaggtgtacacagccgcccgggaagcgaatgctcacga

SEQ ID NO: 3954 - DNA, 201 bp, Homo sapiens; identical to SEQ ID NO: 3867

SEQ ID NO: 3955 - DNA, 201 bp, Homo sapiens; identical to SEQ ID NO: 3880

SEQ ID NO: 3956 - DNA, 201 bp, Homo sapiens; identical to SEQ ID NO: 3868

SEQ ID NO: 3957 - DNA, 201 bp, Homo sapiens
ccctatttattgggggctcccttgtggccggacagcagctgacagggggagacctcatgtccttcctggtggcctcccagacagtgcaaaggctgtgacaytccatgcatggaaggaccatccttgacaggctgtgtgagctgcccttccccatgcctgccacttccagggatgacaagctgacccctgtccccacacacc

SEQ ID NO: 3958 - DNA, 201 bp, Homo sapiens; identical to SEQ ID NO: 3874

SEQ ID NO: 3959 - DNA, 201 bp, Homo sapiens; identical to SEQ ID NO: 3884

SEQ ID NO: 3960 - DNA, 201 bp, Homo sapiens; identical to SEQ ID NO: 3866

SEQ ID NO: 3961 - DNA, 201 bp, Homo sapiens; identical to SEQ ID NO: 3867

SEQ ID NO: 3962 - DNA, 201 bp, Homo sapiens; identical to SEQ ID NO: 3868

SEQ ID NO: 3963 - DNA, 201 bp, Homo sapiens; identical to SEQ ID NO: 3869

SEQ ID NO: 3964 - DNA, 201 bp, Homo sapiens; identical to SEQ ID NO: 3871

SEQ ID NO: 3965 - DNA, 201 bp, Homo sapiens; identical to SEQ ID NO: 3872

SEQ ID NO: 3966 - DNA, 201 bp, Homo sapiens; identical to SEQ ID NO: 3873

SEQ ID NO: 3967 - DNA, 201 bp, Homo sapiens; identical to SEQ ID NO: 3894

SEQ ID NO: 3968 - DNA, 201 bp, Homo sapiens; identical to SEQ ID NO: 3875

SEQ ID NO: 3969 - DNA, 201 bp, Homo sapiens; identical to SEQ ID NO: 3876

SEQ ID NO: 3970 - DNA, 201 bp, Homo sapiens; identical to SEQ ID NO: 3897

SEQ ID NO: 3971 - DNA, 201 bp, Homo sapiens; identical to SEQ ID NO: 3898

SEQ ID NO: 3972 - DNA, 201 bp, Homo sapiens; identical to SEQ ID NO: 3899

SEQ ID NO: 3973 - DNA, 201 bp, Homo sapiens; identical to SEQ ID NO: 3870

SEQ ID NO: 3974 - DNA, 201 bp, Homo sapiens; identical to SEQ ID NO: 3874

SEQ ID NO: 3975 - DNA, 201 bp, Homo sapiens; identical to SEQ ID NO: 3877

SEQ ID NO: 3976 - DNA, 201 bp, Homo sapiens; identical to SEQ ID NO: 3878

SEQ ID NO: 3977 - DNA, 201 bp, Homo sapiens
ccctcctgccagctccacaccccatgtcgtggggtctcgctttaactggaagctcttctggcagtttctgcacccccacctgctggtcctgggggtagccrtcgtggtgaggctttccccacttctccatcctggggacagggcaggacccagagctgcaaagggatggcattcctgcctcgctgcctctcaggggagagc

SEQ ID NO: 3978 - DNA, 164 bp, Homo sapiens
agccacaacctggacaagcgcagtgctcagtagtgggagaggaagggccaagatctggctggggatggggaggagtggctcccccacttaaaacatttgtsccctctgtctccccattccagctggccttgggtgcggcactcgtgaatgtacagatccccctg

SEQ ID NO: 3979 - DNA, 201 bp, Homo sapiens; identical to SEQ ID NO: 3884

SEQ ID NO: 3980 - DNA, 201 bp, Homo sapiens; identical to SEQ ID NO: 3866

SEQ ID NO: 3981 - DNA, 201 bp, Homo sapiens; identical to SEQ ID NO: 3867

SEQ ID NO: 3982 - DNA, 201 bp, Homo sapiens; identical to SEQ ID NO: 3880

SEQ ID NO: 3983 - DNA, 201 bp, Homo sapiens; identical to SEQ ID NO: 3868

SEQ ID NO: 3984 - DNA, 201 bp, Homo sapiens; identical to SEQ ID NO: 3869

SEQ ID NO: 3985 - DNA, 201 bp, Homo sapiens; identical to SEQ ID NO: 3871

SEQ ID NO: 3986 - DNA, 201 bp, Homo sapiens; identical to SEQ ID NO: 3872

SEQ ID NO: 3987 - DNA, 201 bp, Homo sapiens
ctccgcttccagacattctcagctgtcagaaacacatggcgtaatgggaaaactggacagttacacaaggcagaaggagagtactctgatggctaccgcarctcctccctcctccgggccgtggcccacctgcggtcccagctctgggcccacctccctcgagcccccctagctcccagatggagcccctctgcctggtgc

SEQ ID NO: 3988 - DNA, 201 bp, Homo sapiens; identical to SEQ ID NO: 3873

SEQ ID NO: 3989 - DNA, 201 bp, Homo sapiens; identical to SEQ ID NO: 3894

SEQ ID NO: 3990 - DNA, 201 bp, Homo sapiens; identical to SEQ ID NO: 3875

SEQ ID NO: 3991 - DNA, 201 bp, Homo sapiens; identical to SEQ ID NO: 3876

SEQ ID NO: 3992 - DNA, 201 bp, Homo sapiens; identical to SEQ ID NO: 3897

SEQ ID NO: 3993 - DNA, 201 bp, Homo sapiens; identical to SEQ ID NO: 3898

SEQ ID NO: 3994 - DNA, 201 bp, Homo sapiens; identical to SEQ ID NO: 3899

SEQ ID NO: 3995 - DNA, 201 bp, Homo sapiens; identical to SEQ ID NO: 3870

SEQ ID NO: 3996 - DNA, 201 bp, Homo sapiens; identical to SEQ ID NO: 3874

SEQ ID NO: 3997 - DNA, 201 bp, Homo sapiens; identical to SEQ ID NO: 3877

SEQ ID NO: 3998 - DNA, 201 bp, Homo sapiens; identical to SEQ ID NO: 3878

SEQ ID NO: 3999 - DNA, 201 bp, Homo sapiens
agggcggagtggtgattgccgcagacatgctgggatcctacggctccttggctcgtttccgcaacatctctcgcattatgcgagtcaacaacagtaccatkctgggtgcctctggcgactacgctgatttccagtatttgaagcaagttctcggccagatggtgattgatgaggagcttctgggagatggacacagctata

SEQ ID NO: 4000 - DNA, 188 bp, Homo sapiens
aaaggtgttgaaatagagggaccattgtctacagagaccaactgggatattgcccacatgatcagtggctttgaatgaaatacagatgcattatccagaamtgaagttgccctacttttaactttgaacttggctagttcaaagatagactcttcttttgtaaagtaaataaattcttcaaaatgctt

SEQ ID NO: 4001 - DNA, 201 bp, Homo sapiens
tgaaccctttgtggaacaccatggtcatcggaggctatgctgatggagagagcttcctcggttatgtggacatgcttggtgtagcctatgaagccccttcrctggccactggttatggtgcatacttggctcagcctctgctgcgagaagttctggagaagcagccagtgctaagccagaccgaggcccgcgacttagtag

SEQ ID NO: 4002 - DNA, 201 bp, Homo sapiens
ggtgattgatgaggagcttctgggagatggacacagctatagtcctagagctattcattcatggctgaccagggccatgtacagccggcgctcgaagatgwaccctttgtggaacaccatggtcatcggaggctatgctgatggagagagcttcctcggttatgtggacatgcttggtgtagcctatgaagccccttcgct

SEQ ID NO: 4003 - DNA, 201 bp, Homo sapiens
ttgatgaggagcttctgggagatggacacagctatagtcctagagctattcattcatggctgaccagggccatgtacagccggcgctcgaagatgaacccyttgtggaacaccatggtcatcggaggctatgctgatggagagagcttcctcggttatgtggacatgcttggtgtagcctatgaagccccttcgctggcca

SEQ ID NO: 4004 - DNA, 201 bp, Homo sapiens
tcattttttctgctaccgtgactaagatggaagcgtttttggggtcgcggtccggactttgggcggggggtccggccccaggacagttttaccgcattccrtccactcccgattccttcatggatccggcgtctgcactttacagaggtccaatcacgcggacccagaaccccatggtgaccgggacctcagtcctcggcg

SEQ ID NO: 4005 - DNA, 201 bp, Homo sapiens
aagcagccagtgctaagccagaccgaggcccgcgacttagtagaacgctgcatgcgagtgctgtactaccgagatgcccgttcttacaaccggtttcaaaycgccactgtcaccgaaaaaggtgttgaaatagagggaccattgtctacagagaccaactgggatattgcccacatgatcagtggctttgaatgaaataca

SEQ ID NO: 4006 - DNA, 123 bp, Homo sapiens
ggcgcaagcgctttcattttttytgctaccgtgactaagatggaagcgtttttggggtcgcggtccggactttgggcggggggtccggccccaggacagttttaccgcattccgtccactccc

SEQ ID NO: 4007 - DNA, 201 bp, Homo sapiens
ctgggtgtcagaaggtgggctagggcctcctgcagggttgtggggtggaacagggtctcctctccccagccagaaaccccaaagtctgggagctgcacctkccgagtgcaggccatgtgagccctgcctctttaaggagccgcaggacatgaaagatgaccttgtgacactcatgcacagcagccattgcacgtgcatcag

SEQ ID NO: 4008 - DNA, 201 bp, Homo sapiens
caacccccggtgtccactgggtctgccacccattacccatacagcgtgcctctggagactcttcctggtttccaggagacgctggctgaggagctcagaaygtctctaaggaggatgatctcagaccctgtgtattttatggagaggaattatgagatgcccagaggggacacatccagcctaaggtatgattttcgctac

SEQ ID NO: 4009 - DNA, 201 bp, Homo sapiens
tccatccacttttctcctgggggctgggctgggggttagggctgggactgtgcccccacactgcgcctcagcttcccatctctgcccgcttgcttcccctrcccccaacccctgcctcctctataccccaggctctccaactctgcagcagtggcagcagcagtcaaaacaaacacggggggcggtgggtgggatggtgga

SEQ ID NO: 4010 - DNA, 201 bp, Homo sapiens
gtgaggatcgagagcaggtgcgggggtttgaggctgaggaagggttgatgctggcagcggatatcatgcggggggaagatttcacgcctgcggaggagttsgtgccccaggaggagctgggggctgccaagaaggtgccggctgaggaaggggtgatggaagaggcagagctggtgtcagaggagaccgagggctgggagg

SEQ ID NO: 4011 - DNA, 201 bp, Homo sapiens
tgggctgggggttagggctgggactgtgcccccacactgcgcctcagcttcccatctctgcccgcttgcttcccctacccccaacccctgcctcctctatmccccaggctctccaactctgcagcagtggcagcagcagtcaaaacaaacacggggggcggtgggtgggatggtggagcagcctgggggctgacccaggct

SEQ ID NO: 4012 - DNA, 201 bp, Homo sapiens
cctttcccacatgttggaggcttttccaacgtcttcagggacaggcggtaggaaccccggccctcgctctgcagctggtgcaaaagctgtggctgccaggyctgggccacatggcagcccagggggcaggagaagcccgggagaggcccgctggctaccagactcagccctgagcagggaacagggcccagcttccaccgg

SEQ ID NO: 4013 - DNA, 201 bp, Homo sapiens
aggaaccccggccctcgctctgcagctggtgcaaaagctgtggctgccaggcctgggccacatggcagcccagggggcaggagaagcccgggagaggcccrctggctaccagactcagccctgagcagggaacagggcccagcttccaccggcagggagttgtgagcgccttcccaacaatgtgcccctcaccccttgatg

SEQ ID NO: 4014 - DNA, 201 bp, Homo sapiens
tgagactgaaaagttgcagaagcagctggcttcggagaaggaaatccagatgcagctccaggaagagagcgtgtgggtgggttcccagctgcaggacctgygggagaagtacatggattgtgggggcatgctgattgagatgcaggaggaggtgaagaccctccgccagcaacccccggtgtccactgggtctgccaccca

SEQ ID NO: 4015 - DNA, 201 bp, Homo sapiens
tgggttcccagctgcaggacctgcgggagaagtacatggattgtgggggcatgctgattgagatgcaggaggaggtgaagaccctccgccagcaacccccrgtgtccactgggtctgccacccattacccatacagcgtgcctctggagactcttcctggtttccaggagacgctggctgaggagctcagaacgtctctaa

SEQ ID NO: 4016 - DNA, 201 bp, Homo sapiens
tctgtgtgtgggtgggtgagggcccctctgcccagtggtgtgtctcctctccctccctccctcttctgccagtggcctgggggtgtccaggctcccatccrtggcccagcccctctcccctctgtcttgatccccccctccctgcccctggcttcctcttccatgttctgccctttcccacacctttgttcctcaatagct

SEQ ID NO: 4017 - DNA, 184 bp, Homo sapiens
cagactcgagatgcgcccgaggaggttgggccggtgctgcgcggggagccggctcggacccggggacccagcagcactcacctrtgcaccttcgccctcagccagtcccgctccggagccctctgcgcagccgcaggcacggggcactggacagagagtaggatcccgagccacctctggaacc

SEQ ID NO: 4018 - DNA, 201 bp, Homo sapiens
tggattgtgggggcatgctgattgagatgcaggaggaggtgaagaccctccgccagcaacccccggtgtccactgggtctgccacccattacccatacagygtgcctctggagactcttcctggtttccaggagacgctggctgaggagctcagaacgtctctaaggaggatgatctcagaccctgtgtattttatggaga

SEQ ID NO: 4019 - DNA, 201 bp, Homo sapiens
ctgtgcaccttcgccctcagccagtcccgctccggagccctctgcgcagccgcaggcacggggcactggacagagagtaggatcccgagccacctctggawcccagttcctctcggaagcccgcaccggagctcgcccggcctcggaggctggagccaaggcaggagcccggcgcccgtccgcattctcggccatccaagg

SEQ ID NO: 4020 - DNA, 121 bp, Homo sapiens
cagactcgagatgcgcccgargaggttgggccggtgctgcgcggggagccggctcggacccggggacccagcagcactcacctgtgcaccttcgccctcagccagtcccgctccggagccc

SEQ ID NO: 4021 - DNA, 102 bp, Homo sapiens
cwgactcgagatgcgcccgaggaggttgggccggtgctgcgcggggagccggctcggacccggggacccagcagcactcacctgtgcaccttcgccctcagc

SEQ ID NO: 4022 - DNA, 201 bp, Homo sapiens
ctggaggaggagaatcatcagctgagagaagaggcctctcaactcgacactcttgaggatgaggaacagatgctcattctggagtgtgtggagcagttttyggaggccagccaacagatggctgagctgtcggaggtgctggtgctcaggctggaaaactatgaacggcagcagcaggaggtcgctcggctgcaggcccag

SEQ ID NO: 4023 - DNA, 201 bp, Homo sapiens
ggacatgaattatgtcctccagcagctggccaactggcaagatgcccattacaggcggcagctgaggtggaagatgctccagaaaggtgagtgcccccacrgggccctccctgccgccagccggacaagctgcagatcgtcgtgccgatgaaaagagagggtggataagctccccgagtgctcacctgccccagcctggct

SEQ ID NO: 4024 - DNA, 201 bp, Homo sapiens
caagatgcccattacaggcggcagctgaggtggaagatgctccagaaaggtgagtgcccccacggggccctccctgccgccagccggacaagctgcagatmgtcgtgccgatgaaaagagagggtggataagctccccgagtgctcacctgccccagcctggctctacctgctgtgcttatttgcatggactttgcatatc

SEQ ID NO: 4025 - DNA, 201 bp, Homo sapiens
aagggttgatgctggcagcggatatcatgcggggggaagatttcacgcctgcggaggagttggtgccccaggaggagctgggggctgccaagaaggtgccrgctgaggaaggggtgatggaagaggcagagctggtgtcagaggagaccgagggctgggaggaggtggaactggagctggatgaggcaacgcggatgaacg

SEQ ID NO: 4026 - DNA, 201 bp, Homo sapiens
tttcgctacagtgaggatcgagagcaggtgcgggggtttgaggctgaggaagggttgatgctggcagcggatatcatgcggggggaagatttcacgcctgyggaggagttggtgccccaggaggagctgggggctgccaagaaggtgccggctgaggaaggggtgatggaagaggcagagctggtgtcagaggagaccgag

SEQ ID NO: 4027 - DNA, 201 bp, Homo sapiens
aaaactatgaacggcagcagcaggaggtcgctcggctgcaggcccaggtgctgaagctgcagcagcgctgccggatgtatggggctgagactgaaaagttkcagaagcagctggcttcggagaaggaaatccagatgcagctccaggaagagagcgtgtgggtgggttcccagctgcaggacctgcgggagaagtacatgg

SEQ ID NO: 4028 - DNA, 201 bp, Homo sapiens; identical to SEQ ID NO: 4007

SEQ ID NO: 4029 - DNA, 201 bp, Homo sapiens
gaggtcgctcggctgcaggcccaggtgctgaagctgcagcagcgctgccggatggagactcttcctggtttccaggagacgctggctgaggagctcagaaygtctctaaggaggatgatctcagaccctgtgtattttatggagaggaattatgagatgcccagaggggacacatccagcctaaggtatgattttcgctac

SEQ ID NO: 4030 - DNA, 201 bp, Homo sapiens; identical to SEQ ID NO: 4009

SEQ ID NO: 4031 - DNA, 201 bp, Homo sapiens; identical to SEQ ID NO: 4010

SEQ ID NO: 4032 - DNA, 201 bp, Homo sapiens; identical to SEQ ID NO: 4011

SEQ ID NO: 4033 - DNA, 201 bp, Homo sapiens; identical to SEQ ID NO: 4012

SEQ ID NO: 4034 - DNA, 201 bp, Homo sapiens; identical to SEQ ID NO: 4013

SEQ ID NO: 4035 - DNA, 201 bp, Homo sapiens; identical to SEQ ID NO: 4016

SEQ ID NO: 4036 - DNA, 184 bp, Homo sapiens; identical to SEQ ID NO: 4017

SEQ ID NO: 4037 - DNA, 121 bp, Homo sapiens; identical to SEQ ID NO: 4020

SEQ ID NO: 4038 - DNA, 201 bp, Homo sapiens; identical to SEQ ID NO: 4019

SEQ ID NO: 4039 - DNA, 102 bp, Homo sapiens; identical to SEQ ID NO: 4021

SEQ ID NO: 4040 - DNA, 201 bp, Homo sapiens; identical to SEQ ID NO: 4022

SEQ ID NO: 4041 - DNA, 201 bp, Homo sapiens; identical to SEQ ID NO: 4023

SEQ ID NO: 4042 - DNA, 201 bp, Homo sapiens; identical to SEQ ID NO: 4025

SEQ ID NO: 4043 - DNA, 201 bp, Homo sapiens; identical to SEQ ID NO: 4024

SEQ ID NO: 4044 - DNA, 201 bp, Homo sapiens; identical to SEQ ID NO: 4026

SEQ ID NO: 4045 - DNA, 201 bp, Homo sapiens; identical to SEQ ID NO: 4007

SEQ ID NO: 4046 - DNA, 201 bp, Homo sapiens; identical to SEQ ID NO: 4008

SEQ ID NO: 4047 - DNA, 201 bp, Homo sapiens; identical to SEQ ID NO: 4009

SEQ ID NO: 4048 - DNA, 201 bp, Homo sapiens; identical to SEQ ID NO: 4010

SEQ ID NO: 4049 - DNA, 201 bp, Homo sapiens; identical to SEQ ID NO: 4011

SEQ ID NO: 4050 - DNA, 201 bp, Homo sapiens; identical to SEQ ID NO: 4012

SEQ ID NO: 4051 - DNA, 201 bp, Homo sapiens; identical to SEQ ID NO: 4013

SEQ ID NO: 4052 - DNA, 201 bp, Homo sapiens; identical to SEQ ID NO: 4014

SEQ ID NO: 4053 - DNA, 201 bp, Homo sapiens; identical to SEQ ID NO: 4015

SEQ ID NO: 4054 - DNA, 201 bp, Homo sapiens; identical to SEQ ID NO: 4016

SEQ ID NO: 4055 - DNA, 184 bp, Homo sapiens; identical to SEQ ID NO: 4017

SEQ ID NO: 4056 - DNA, 201 bp, Homo sapiens; identical to SEQ ID NO: 4018

SEQ ID NO: 4057 - DNA, 201 bp, Homo sapiens; identical to SEQ ID NO: 4019

SEQ ID NO: 4058 - DNA, 121 bp, Homo sapiens; identical to SEQ ID NO: 4020

SEQ ID NO: 4059 - DNA, 102 bp, Homo sapiens; identical to SEQ ID NO: 4021

SEQ ID NO: 4060 - DNA, 201 bp, Homo sapiens; identical to SEQ ID NO: 4022

SEQ ID NO: 4061 - DNA, 201 bp, Homo sapiens; identical to SEQ ID NO: 4023

SEQ ID NO: 4062 - DNA, 201 bp, Homo sapiens; identical to SEQ ID NO: 4024

SEQ ID NO: 4063 - DNA, 201 bp, Homo sapiens; identical to SEQ ID NO: 4025

SEQ ID NO: 4064 - DNA, 201 bp, Homo sapiens; identical to SEQ ID NO: 4026

SEQ ID NO: 4065 - DNA, 201 bp, Homo sapiens; identical to SEQ ID NO: 4027

SEQ ID NO: 4066 - DNA, 184 bp, Homo sapiens; identical to SEQ ID NO: 4017

SEQ ID NO: 4067 - DNA, 201 bp, Homo sapiens; identical to SEQ ID NO: 4007

SEQ ID NO: 4068 - DNA, 121 bp, Homo sapiens; identical to SEQ ID NO: 4020

SEQ ID NO: 4069 - DNA, 201 bp, Homo sapiens; identical to SEQ ID NO: 4019

SEQ ID NO: 4070 - DNA, 201 bp, Homo sapiens
ttgcagaagcagctggcttcggagaaggaaatccagatgcagctccaggaagaggagactcttcctggtttccaggagacgctggctgaggagctcagaaygtctctaaggaggatgatctcagaccctgtgtattttatggagaggaattatgagatgcccagaggggacacatccagcctaaggtatgattttcgctac

SEQ ID NO: 4071 - DNA, 201 bp, Homo sapiens; identical to SEQ ID NO: 4009

SEQ ID NO: 4072 - DNA, 102 bp, Homo sapiens; identical to SEQ ID NO: 4021

SEQ ID NO: 4073 - DNA, 201 bp, Homo sapiens; identical to SEQ ID NO: 4022

SEQ ID NO: 4074 - DNA, 201 bp, Homo sapiens; identical to SEQ ID NO: 4010

SEQ ID NO: 4075 - DNA, 201 bp, Homo sapiens; identical to SEQ ID NO: 4011

SEQ ID NO: 4076 - DNA, 201 bp, Homo sapiens; identical to SEQ ID NO: 4023

SEQ ID NO: 4077 - DNA, 201 bp, Homo sapiens; identical to SEQ ID NO: 4012

SEQ ID NO: 4078 - DNA, 201 bp, Homo sapiens; identical to SEQ ID NO: 4024

SEQ ID NO: 4079 - DNA, 201 bp, Homo sapiens; identical to SEQ ID NO: 4025

SEQ ID NO: 4080 - DNA, 201 bp, Homo sapiens; identical to SEQ ID NO: 4013

SEQ ID NO: 4081 - DNA, 201 bp, Homo sapiens; identical to SEQ ID NO: 4026

SEQ ID NO: 4082 - DNA, 201 bp, Homo sapiens
aaaactatgaacggcagcagcaggaggtcgctcggctgcaggcccaggtgctgaagctgcagcagcgctgccggatgtatggggctgagactgaaaagttkcagaagcagctggcttcggagaaggaaatccagatgcagctccaggaagaggagactcttcctggtttccaggagacgctggctgaggagctcagaacgt

SEQ ID NO: 4083 - DNA, 201 bp, Homo sapiens; identical to SEQ ID NO: 4016

SEQ ID NO: 4084 - DNA, 201 bp, Homo sapiens
tcctttgaatcctctctctgtgttacccagtaactcatctgtcaccaagccttggggattcttccatctgattgtgatgtgagttgcacagctatgaaggytgtacactgcacgaatggaagaggcacctgtcccagaaaaagcatcatggctatctgtgggtagtatgatgggtgtttttagcaggtaggaggcaaatat

SEQ ID NO: 4085 - DNA, 201 bp, Homo sapiens
aatattaaggaagaggcagggttcaagaggagccatggggcactacgtcttagctgaacgtgagtgacacgcagcctgcagactcactgtgggaaggagayaaaactagagactcaaagagggagtgcatttatgagctcttcatgtttcaggagagagttgaacctaaacatagaaattgcctgacgaactccttgattt

SEQ ID NO: 4086 - DNA, 201 bp, Homo sapiens
cggccagagctggggaaatgggcccgcgagccaggccggcgcttctcctcctgatgcttttgcagaccgcggtcctgcaggggcgcttgctgcagccctcvccgtctggcaccctagtcattggagtcatcagtggaattgctgtttttgtcgtcatcttgttcattggaattttgttcataatattaaggaagaggcagg

SEQ ID NO: 4087 - DNA, 51 bp, Homo sapiens
cactacattcagtagtttagatgcctagaataaatagagaaggaaggagay

SEQ ID NO: 4088 - DNA, 201 bp, Homo sapiens
gtgcggccagagctggggaaatgggcccgcgagccaggccggcgcttctcctcctgatgcttttgcagaccgcggtcctgcaggggcgcttgctgcagccytcaccgtctggcaccctagtcattggagtcatcagtggaattgctgtttttgtcgtcatcttgttcattggaattttgttcataatattaaggaagaggc

SEQ ID NO: 4089 - DNA, 201 bp, Homo sapiens
tcttccatctgattgtgatgtgagttgcacagctatgaaggctgtacactgcacgaatggaagaggcacctgtcccagaaaaagcatcatggctatctgtrggtagtatgatgggtgtttttagcaggtaggaggcaaatatcttgaaaggggttgtgaagaggtgttttttctaattggcatgaaggtgtcatacagatt

SEQ ID NO: 4090 - DNA, 201 bp, Homo sapiens
tttttgtcgtcatcttgttcattggaattttgttcataatattaaggaagaggcagggttcaagaggagccatggggcactacgtcttagctgaacgtgaktgacacgcagcctgcagactcactgtgggaaggagacaaaactagagactcaaagagggagtgcatttatgagctcttcatgtttcaggagagagttgaa

SEQ ID NO: 4091 - DNA, 201 bp, Homo sapiens
ctaataaaaatacaaaaaattagctgggcgtggtggcagacgcctgtagtcccagctactcggaaggctgaggcaggagaatggcatgaacccaggaggcsgagcttgcagtgagccgagtttgcgccactgcactccagcctaggtgacagagtgagactccatctcaaaaaaataaaaataaaaataaaaaaatgaaaa

SEQ ID NO: 4092 - DNA, 201 bp, Homo sapiens
gcgttcacactctctgcactacctcttcatgggtgcctcagagcaggaccttggtctttccttgtttgaagctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 4093 - DNA, 201 bp, Homo sapiens
tctgcactacctcttcatgggtgcctcagagcaggaccttggtctttccttgtttgaagctttgggctacgtggatgaccagctgttcgtgttctatgatsatgagagtcgccgtgtggagccccgaactccatgggtttccagtagaatttcaagccagatgtggctgcagctgagtcagagtctgaaagggtgggatca

SEQ ID NO: 4094 - DNA, 201 bp, Homo sapiens
accttaccagatttttacacatgtatctatgcattttctggacccgttcaacttttcctttgaatcctctctctgtgttacccagtaactcatctgtcacyaagccttggggattcttccatctgattgtgatgtgagttgcacagctatgaaggctgtacactgcacgaatggaagaggcacctgtcccagaaaaagcat

SEQ ID NO: 4095 - DNA, 201 bp, Homo sapiens
ggcccgcgagccaggccggcgcttctcctcctgatgcttttgcagaccgcggtcctgcaggggcgcttgctgcgttcacactctctgcactacctcttcaygggtgcctcagagcaggaccttggtctttccttgtttgaagctttgggctacgtggatgaccagctgttcgtgttctatgatcatgagagtcgccgtgtg

SEQ ID NO: 4096 - DNA, 201 bp, Homo sapiens
cctgcaggggcgcttgctgcgttcacactctctgcactacctcttcatgggtgcctcagagcaggaccttggtctttccttgtttgaagctttgggctacrtggatgaccagctgttcgtgttctatgatcatgagagtcgccgtgtggagccccgaactccatgggtttccagtagaatttcaagccagatgtggctgca

SEQ ID NO: 4097 - DNA, 105 bp, Homo sapiens
gatagaaacaggtttcaaactcagtcaatctgaccgtttgatacatctcagacaccactacattcagtagtttagatgcctagaataaatagagaaggaaygaga

SEQ ID NO: 4098 - DNA, 201 bp, Homo sapiens
gccaaggagttcgaacctaaagacgtattgcccaatggggatgggacctaccagggctggataaccttggctgtaccccctggggaagagcagagatataygtgccaggtggagcacccaggcctggatcagcccctcattgtgatctgggagccctcaccgtctggcaccctagtcattggagtcatcagtggaattgct

SEQ ID NO: 4099 - DNA, 201 bp, Homo sapiens
tgcactacctcttcatgggtgcctcagagcaggaccttggtctttccttgtttgaagctttgggctacgtggatgaccagctgttcgtgttctatgatcaygagagtcgccgtgtggagccccgaactccatgggtttccagtagaatttcaagccagatgtggctgcagctgagtcagagtctgaaagggtgggatcaca

SEQ ID NO: 4100 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggtgaccactctacggtgtcgggccttgaactactaccc

SEQ ID NO: 4101 - DNA, 201 bp, Homo sapiens
tcatcagtggaattgctgtttttgtcgtcatcttgttcattggaattttgttcataatattaaggaagaggcagggttcaagaggagccatggggcactaygtcttagctgaacgtgagtgacacgcagcctgcagactcactgtgggaaggagacaaaactagagactcaaagagggagtgcatttatgagctcttcatg

SEQ ID NO: 4102 - DNA, 201 bp, Homo sapiens
aaggagttcgaacctaaagacgtattgcccaatggggatgggacctaccagggctggataaccttggctgtaccccctggggaagagcagagatatacgtvccaggtggagcacccaggcctggatcagcccctcattgtgatctgggagccctcaccgtctggcaccctagtcattggagtcatcagtggaattgctgtt

SEQ ID NO: 4103 - DNA, 201 bp, Homo sapiens
ctcagagcaggaccttggtctttccttgtttgaagctttgggctacgtggatgaccagctgttcgtgttctatgatcatgagagtcgccgtgtggagcccygaactccatgggtttccagtagaatttcaagccagatgtggctgcagctgagtcagagtctgaaagggtgggatcacatgttcactgttgacttctggac

SEQ ID NO: 4104 - DNA, 201 bp, Homo sapiens
ttgaatcctctctctgtgttacccagtaactcatctgtcaccaagccttggggattcttccatctgattgtgatgtgagttgcacagctatgaaggctgtrcactgcacgaatggaagaggcacctgtcccagaaaaagcatcatggctatctgtgggtagtatgatgggtgtttttagcaggtaggaggcaaatatcttg

SEQ ID NO: 4105 - DNA, 201 bp, Homo sapiens
ctacctcttcatgggtgcctcagagcaggaccttggtctttccttgtttgaagctttgggctacgtggatgaccagctgttcgtgttctatgatcatgagwgtcgccgtgtggagccccgaactccatgggtttccagtagaatttcaagccagatgtggctgcagctgagtcagagtctgaaagggtgggatcacatgtt

SEQ ID NO: 4106 - DNA, 201 bp, Homo sapiens
tgggagccctcaccgtctggcaccctagtcattggagtcatcagtggaattgctgtttttgtcgtcatcttgttcattggaattttgttcataatattaakgaagaggcagggttcaagaggagccatggggcactacgtcttagctgaacgtgagtgacacgcagcctgcagactcactgtgggaaggagacaaaactag

SEQ ID NO: 4107 - DNA, 201 bp, Homo sapiens
gatcacgaggtcaggagatcgagaccatcctggctaacatggtgaaaccccatctctaataaaaatacaaaaaattagctgggcgtggtggcagacgcctstagtcccagctactcggaaggctgaggcaggagaatggcatgaacccaggaggcagagcttgcagtgagccgagtttgcgccactgcactccagcctagg

SEQ ID NO: 4108 - DNA, 201 bp, Homo sapiens; identical to SEQ ID NO: 4092

SEQ ID NO: 4109 - DNA, 201 bp, Homo sapiens; identical to SEQ ID NO: 4093

SEQ ID NO: 4110 - DNA, 201 bp, Homo sapiens; identical to SEQ ID NO: 4094

SEQ ID NO: 4111 - DNA, 201 bp, Homo sapiens; identical to SEQ ID NO: 4095

SEQ ID NO: 4112 - DNA, 201 bp, Homo sapiens; identical to SEQ ID NO: 4096

SEQ ID NO: 4113 - DNA, 111 bp, Homo sapiens
aagctgttatttaattagccagtgaaaaactattaacaacttgtctattacctgttagtattattgttgcattaaaaatgcatatactttaataaatgtayattgtattgt

SEQ ID NO: 4114 - DNA, 201 bp, Homo sapiens; identical to SEQ ID NO: 4099

SEQ ID NO: 4115 - DNA, 201 bp, Homo sapiens; identical to SEQ ID NO: 4098

SEQ ID NO: 4116 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggagtcccacaccctgcaggtcatcctgggctgtgaaat

SEQ ID NO: 4117 - DNA, 201 bp, Homo sapiens
ctactggaagtacgggtatgatgggcaggaccaccttgaattctgccctgacacactggattggagagcagcagaacccagggcctggcccaccaagctgkagtgggaaaggcacaagattcgggccaggcagaacagggcctacctggagagggactgccctgcacagctgcagcagttgctggagctggggagaggtgt

SEQ ID NO: 4118 - DNA, 201 bp, Homo sapiens
gggatcacatgttcactgttgacttctggactattatggaaaatcacaaccacagcaaggagtcccacaccctgcaggtcatcctgggctgtgaaatgcamgaagacaacagtaccgagggctactggaagtacgggtatgatgggcaggaccaccttgaattctgccctgacacactggattggagagcagcagaaccca

SEQ ID NO: 4119 - DNA, 201 bp, Homo sapiens
tggaagtacgggtatgatgggcaggaccaccttgaattctgccctgacacactggattggagagcagcagaacccagggcctggcccaccaagctggagtrggaaaggcacaagattcgggccaggcagaacagggcctacctggagagggactgccctgcacagctgcagcagttgctggagctggggagaggtgttttg

SEQ ID NO: 4120 - DNA, 201 bp, Homo sapiens; identical to SEQ ID NO: 4101

SEQ ID NO: 4121 - DNA, 201 bp, Homo sapiens; identical to SEQ ID NO: 4102

SEQ ID NO: 4122 - DNA, 201 bp, Homo sapiens; identical to SEQ ID NO: 4103

SEQ ID NO: 4123 - DNA, 201 bp, Homo sapiens; identical to SEQ ID NO: 4104

SEQ ID NO: 4124 - DNA, 201 bp, Homo sapiens; identical to SEQ ID NO: 4105

SEQ ID NO: 4125 - DNA, 201 bp, Homo sapiens; identical to SEQ ID NO: 4106

SEQ ID NO: 4126 - DNA, 201 bp, Homo sapiens
caccctgcccagccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttt

SEQ ID NO: 4127 - DNA, 201 bp, Homo sapiens; identical to SEQ ID NO: 4099

SEQ ID NO: 4128 - DNA, 201 bp, Homo sapiens; identical to SEQ ID NO: 4103

SEQ ID NO: 4129 - DNA, 201 bp, Homo sapiens; identical to SEQ ID NO: 4092

SEQ ID NO: 4130 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggaaggaagtgaaagttccagtcttcctggcaagggtaa

SEQ ID NO: 4131 - DNA, 201 bp, Homo sapiens; identical to SEQ ID NO: 4105

SEQ ID NO: 4132 - DNA, 201 bp, Homo sapiens; identical to SEQ ID NO: 4093

SEQ ID NO: 4133 - DNA, 201 bp, Homo sapiens
gtctgaaagggtgggatcacatgttcactgttgacttctggactattatggaaaatcacaaccacagcaaggaaggaagtgaaagttccagtcttcctggsaagggtaaacagatcccctctcctcatccttcctctttcctgtcaagtgcctcctttggtgaaggtgacacatcatgtgacctcttcagtgaccactcta

SEQ ID NO: 4134 - DNA, 201 bp, Homo sapiens; identical to SEQ ID NO: 4095

SEQ ID NO: 4135 - DNA, 201 bp, Homo sapiens; identical to SEQ ID NO: 4096

SEQ ID NO: 4136 - DNA, 201 bp, Homo sapiens
gacttctggagccatccccgtttccccgccccccaaaagaagcggagatttaacggggacgtgcggccagagctggggaaatgggcccgcgagccaggccrgcgcttctcctcctgatgcttttgcagaccgcggtcctgcaggggcgcttgctgcagtcccacaccctgcaggtcatcctgggctgtgaaatgcaagaag

SEQ ID NO: 4137 - DNA, 201 bp, Homo sapiens
atgccggtgatccctagctgtgacctctcccctggaactgtctctcatgaacctcaagctgcatctagaggcttccttcatttcctccgtcacctcagagycatacacctatgtcatttcatttcctatttttggaagaggactccttaaatttgggggacttacatgattcattttaacatctgagaaaagctttgaacc

SEQ ID NO: 4138 - DNA, 201 bp, Homo sapiens
caccatgaagtggctgaaggataagcagccaatggatgccaaggagttcgaacctaaagacgtattgcccaatggggatgggacctaccagggctggatayccttggctgtaccccctggggaagagcagagatatacgtgccaggtggagcacccaggcctggatcagcccctcattgtgatctgggagccctcaccgtc

SEQ ID NO: 4139 - DNA, 201 bp, Homo sapiens
gggccaggcagaacagggcctacctggagagggactgccctgcacagctgcagcagttgctggagctggggagaggtgttttggaccaacaagtgcctccvttggtgaaggtgacacatcatgtgacctcttcagtgaccactctacggtgtcgggccttgaactactacccccagaacatcaccatgaagtggctgaagg

SEQ ID NO: 4140 - DNA, 201 bp, Homo sapiens
gctgggcgtggtggcagacgcctgtagtcccagctactcggaaggctgaggcaggagaatggcatgaacccaggaggcagagcttgcagtgagccgagttrgcgccactgcactccagcctaggtgacagagtgagactccatctcaaaaaaataaaaataaaaataaaaaaatgaaaaaaaaaagaaagtgaagtataga

SEQ ID NO: 4141 - DNA, 201 bp, Homo sapiens
ttcgggccaggcagaacagggcctacctggagagggactgccctgcacagctgcagcagttgctggagctggggagaggtgttttggaccaacaagtgccycctttggtgaaggtgacacatcatgtgacctcttcagtgaccactctacggtgtcgggccttgaactactacccccagaacatcaccatgaagtggctga

SEQ ID NO: 4142 - DNA, 201 bp, Homo sapiens
tgcatctagaggcttccttcatttcctccgtcacctcagagacatacacctatgtcatttcatttcctatttttggaagaggactccttaaatttgggggrcttacatgattcattttaacatctgagaaaagctttgaaccctgggacgtggctagtcataaccttaccagatttttacacatgtatctatgcattttct

SEQ ID NO: 4143 - DNA, 201 bp, Homo sapiens
tacggtgtcgggccttgaactactacccccagaacatcaccatgaagtggctgaaggataagcagccaatggatgccaaggagttcgaacctaaagacgtkttgcccaatggggatgggacctaccagggctggataaccttggctgtaccccctggggaagagcagagatatacgtgccaggtggagcacccaggcctgg

SEQ ID NO: 4144 - DNA, 201 bp, Homo sapiens
gttctgataatgaaaattatgataaggatgataaaagcacttacttcgtgtccgactcttctgagcacctacttacatgcattactgcatgcacttcttasaataattctatgagataggtactattatccccatttcttttttaaatgaagaaagtgaagtaggccgggcacggtggctcacgcctgtaatcccagcact

SEQ ID NO: 4145 - DNA, 201 bp, Homo sapiens
gggtgacttctggagccatccccgtttccccgccccccaaaagaagcggagatttaacggggacgtgcggccagagctggggaaatgggcccgcgagccakgccggcgcttctcctcctgatgcttttgcagaccgcggtcctgcaggggcgcttgctgcagtcccacaccctgcaggtcatcctgggctgtgaaatgcaa

SEQ ID NO: 4146 - DNA, 201 bp, Homo sapiens
ctagtgtttcacaagcaggtaccttctgctgtaggagagagagaactaaagttctgaaagacctgttgcttttcaccaggaagttttactgggcatctccmgagcctaggcaatagctgtagggtgacttctggagccatccccgtttccccgccccccaaaagaagcggagatttaacggggacgtgcggccagagctgg

SEQ ID NO: 4147 - DNA, 201 bp, Homo sapiens
cactggatcacctagtgtttcacaagcaggtaccttctgctgtaggagagagagaactaaagttctgaaagacctgttgcttttcaccaggaagttttacrgggcatctcctgagcctaggcaatagctgtagggtgacttctggagccatccccgtttccccgccccccaaaagaagcggagatttaacggggacgtgcg

SEQ ID NO: 4148 - DNA, 201 bp, Homo sapiens
tagtgtttcacaagcaggtaccttctgctgtaggagagagagaactaaagttctgaaagacctgttgcttttcaccaggaagttttactgggcatctcctsagcctaggcaatagctgtagggtgacttctggagccatccccgtttccccgccccccaaaagaagcggagatttaacggggacgtgcggccagagctggg

SEQ ID NO: 4149 - DNA, 201 bp, Homo sapiens; identical to SEQ ID NO: 4137

SEQ ID NO: 4150 - DNA, 188 bp, Homo sapiens
ggggacactggatcacctagtgtttcacaagcaggtaccttctgctgtaggagagagagaactaaagttctgaaagacctgttgcttrtcaccaggaagttttactgggcatctcctgagcctaggcaatagctgtagggtgacttctggagccatccccgtttccccgccccccaaaagaagcggag

SEQ ID NO: 4151 - DNA, 201 bp, Homo sapiens; identical to SEQ ID NO: 4140

SEQ ID NO: 4152 - DNA, 201 bp, Homo sapiens
gtgtttcacaagcaggtaccttctgctgtaggagagagagaactaaagttctgaaagacctgttgcttttcaccaggaagttttactgggcatctcctgaycctaggcaatagctgtagggtgacttctggagccatccccgtttccccgccccccaaaagaagcggagatttaacggggacgtgcggccagagctgggga

SEQ ID NO: 4153 - DNA, 201 bp, Homo sapiens; identical to SEQ ID NO: 4141

SEQ ID NO: 4154 - DNA, 201 bp, Homo sapiens
ggcatctcctgagcctaggcaatagctgtagggtgacttctggagccatccccgtttccccgccccccaaaagaagcggagatttaacggggacgtgcggscagagctggggaaatgggcccgcgagccaggccggcgcttctcctcctgatgcttttgcagaccgcggtcctgcaggggcgcttgctgcctttgggctac

SEQ ID NO: 4155 - DNA, 201 bp, Homo sapiens
tatgatcatgagagtcgccgtgtggagccccgaactccatgggtttccagtagaatttcaagccagatgtggctgcagctgagtcagagtctgaaagggtkggatcacatgttcactgttgacttctggactattatggaaaatcacaaccacagcaaggagtcccacaccctgcaggtcatcctgggctgtgaaatgcaa

SEQ ID NO: 4156 - DNA, 201 bp, Homo sapiens
agctggggaaatgggcccgcgagccaggccggcgcttctcctcctgatgcttttgcagaccgcggtcctgcaggggcgcttgctgcctttgggctacgtgmatgaccagctgttcgtgttctatgatcatgagagtcgccgtgtggagccccgaactccatgggtttccagtagaatttcaagccagatgtggctgcagct

SEQ ID NO: 4157 - DNA, 201 bp, Homo sapiens
atcatgagagtcgccgtgtggagccccgaactccatgggtttccagtagaatttcaagccagatgtggctgcagctgagtcagagtctgaaagggtgggarcacatgttcactgttgacttctggactattatggaaaatcacaaccacagcaaggagtcccacaccctgcaggtcatcctgggctgtgaaatgcaagaag

SEQ ID NO: 4158 - DNA, 201 bp, Homo sapiens; identical to SEQ ID NO: 4138

SEQ ID NO: 4159 - DNA, 201 bp, Homo sapiens; identical to SEQ ID NO: 4139

SEQ ID NO: 4160 - DNA, 201 bp, Homo sapiens
ctgctgtaggagagagagaactaaagttctgaaagacctgttgcttttcaccaggaagttttactgggcatctcctgagcctaggcaatagctgtagggtyacttctggagccatccccgtttccccgccccccaaaagaagcggagatttaacggggacgtgcggccagagctggggaaatgggcccgcgagccaggccg

SEQ ID NO: 4161 - DNA, 201 bp, Homo sapiens; identical to SEQ ID NO: 4142

SEQ ID NO: 4162 - DNA, 201 bp, Homo sapiens
ttcacaagcaggtaccttctgctgtaggagagagagaactaaagttctgaaagacctgttgcttttcaccaggaagttttactgggcatctcctgagcctwggcaatagctgtagggtgacttctggagccatccccgtttccccgccccccaaaagaagcggagatttaacggggacgtgcggccagagctggggaaatg

SEQ ID NO: 4163 - DNA, 201 bp, Homo sapiens; identical to SEQ ID NO: 4143

SEQ ID NO: 4164 - DNA, 201 bp, Homo sapiens; identical to SEQ ID NO: 4144

SEQ ID NO: 4165 - DNA, 201 bp, Homo sapiens; identical to SEQ ID NO: 4099

SEQ ID NO: 4166 - DNA, 201 bp, Homo sapiens; identical to SEQ ID NO: 4103

SEQ ID NO: 4167 - DNA, 201 bp, Homo sapiens
tggaagtacgggtatgatgggcaggtgcttcaggataccatatacagctcagaagtttcttctttaggcattaaattttagcaaagatatctcatctcttrttttaaaccattttctttttttgtggttagaaaagttatgtagaaaaaagtaaatgtgatttacgctcattgtagaaaagctataaaatgaatacaatta

SEQ ID NO: 4168 - DNA, 201 bp, Homo sapiens; identical to SEQ ID NO: 4092

SEQ ID NO: 4169 - DNA, 201 bp, Homo sapiens; identical to SEQ ID NO: 4105

SEQ ID NO: 4170 - DNA, 201 bp, Homo sapiens; identical to SEQ ID NO: 4116

SEQ ID NO: 4171 - DNA, 201 bp, Homo sapiens; identical to SEQ ID NO: 4093

SEQ ID NO: 4172 - DNA, 201 bp, Homo sapiens
gggatcacatgttcactgttgacttctggactattatggaaaatcacaaccacagcaaggagtcccacaccctgcaggtcatcctgggctgtgaaatgcamgaagacaacagtaccgagggctactggaagtacgggtatgatgggcaggtgcttcaggataccatatacagctcagaagtttcttctttaggcattaaat

SEQ ID NO: 4173 - DNA, 201 bp, Homo sapiens
ctactggaagtacgggtatgatgggcaggtgcttcaggataccatatacagctcagaagtttcttctttaggcattaaattttagcaaagatatctcatckcttcttttaaaccattttctttttttgtggttagaaaagttatgtagaaaaaagtaaatgtgatttacgctcattgtagaaaagctataaaatgaataca

SEQ ID NO: 4174 - DNA, 201 bp, Homo sapiens; identical to SEQ ID NO: 4095

SEQ ID NO: 4175 - DNA, 201 bp, Homo sapiens; identical to SEQ ID NO: 4096

SEQ ID NO: 4176 - DNA, 201 bp, Homo sapiens; identical to SEQ ID NO: 4092

SEQ ID NO: 4177 - DNA, 201 bp, Homo sapiens; identical to SEQ ID NO: 4093

SEQ ID NO: 4178 - DNA, 201 bp, Homo sapiens; identical to SEQ ID NO: 4094

SEQ ID NO: 4179 - DNA, 201 bp, Homo sapiens; identical to SEQ ID NO: 4095

SEQ ID NO: 4180 - DNA, 201 bp, Homo sapiens; identical to SEQ ID NO: 4096

SEQ ID NO: 4181 - DNA, 105 bp, Homo sapiens; identical to SEQ ID NO: 4097

SEQ ID NO: 4182 - DNA, 201 bp, Homo sapiens; identical to SEQ ID NO: 4098

SEQ ID NO: 4183 - DNA, 201 bp, Homo sapiens; identical to SEQ ID NO: 4099

SEQ ID NO: 4184 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggtgcctcctttggtgaaggtgacacatcatgtgacctc

SEQ ID NO: 4185 - DNA, 201 bp, Homo sapiens; identical to SEQ ID NO: 4101

SEQ ID NO: 4186 - DNA, 201 bp, Homo sapiens; identical to SEQ ID NO: 4102

SEQ ID NO: 4187 - DNA, 201 bp, Homo sapiens; identical to SEQ ID NO: 4103

SEQ ID NO: 4188 - DNA, 201 bp, Homo sapiens; identical to SEQ ID NO: 4104

SEQ ID NO: 4189 - DNA, 201 bp, Homo sapiens; identical to SEQ ID NO: 4105

SEQ ID NO: 4190 - DNA, 201 bp, Homo sapiens; identical to SEQ ID NO: 4106

SEQ ID NO: 4191 - DNA, 201 bp, Homo sapiens; identical to SEQ ID NO: 4107

SEQ ID NO: 4192 - DNA, 201 bp, Homo sapiens; identical to SEQ ID NO: 4092

SEQ ID NO: 4193 - DNA, 201 bp, Homo sapiens; identical to SEQ ID NO: 4093

SEQ ID NO: 4194 - DNA, 201 bp, Homo sapiens; identical to SEQ ID NO: 4095

SEQ ID NO: 4195 - DNA, 201 bp, Homo sapiens; identical to SEQ ID NO: 4096

SEQ ID NO: 4196 - DNA, 201 bp, Homo sapiens
gcacagctgcagcagttgctggagctggggagaggtgttttggaccaacaagtgcctcctttggtgaaggtgacacatcatgtgacctcttcagtgaccaytctacggtgtcgggccttgaactactacccccagaacatcaccatgaagtggctgaaggataagcagccaatggatgccaaggagttcgaacctaaagac

SEQ ID NO: 4197 - DNA, 201 bp, Homo sapiens; identical to SEQ ID NO: 4099

SEQ ID NO: 4198 - DNA, 201 bp, Homo sapiens; identical to SEQ ID NO: 4103

SEQ ID NO: 4199 - DNA, 201 bp, Homo sapiens; identical to SEQ ID NO: 4105

SEQ ID NO: 4200 - DNA, 201 bp, Homo sapiens; identical to SEQ ID NO: 4116

SEQ ID NO: 4201 - DNA, 201 bp, Homo sapiens
gagtctgaaagggtgggatcacatgttcactgttgacttctggactattatggaaaatcacaaccacagcaaggagtcccacaccctgcaggtcatcctgsgctgtgaaatgcaagaagacaacagtaccgagggctactggaagtacgggtatgatgggcaggaccaccttgaattctgccctgacacactggattggag

SEQ ID NO: 4202 - DNA, 201 bp, Homo sapiens
gctgcctcctttggtgaaggtgacacatcatgtgacctcttcagtgaccactctacggtgtcgggccttgaactactacccccagaacatcaccatgaagrggctgaaggataagcagccaatggatgccaaggagttcgaacctaaagacgtattgcccaatggggatgggacctaccagggctggataaccttggctgt

SEQ ID NO: 4203 - DNA, 201 bp, Homo sapiens
ggtgaaggtgacacatcatgtgacctcttcagtgaccactctacggtgtcgggccttgaactactacccccagaacatcaccatgaagtggctgaaggatsagcagccaatggatgccaaggagttcgaacctaaagacgtattgcccaatggggatgggacctaccagggctggataaccttggctgtaccccctgggga

SEQ ID NO: 4204 - DNA, 201 bp, Homo sapiens
gggttgtgaagaggtgttttttctaattggcatgaaggtgtcatacagatttgcaaagtttaatggtgccttcatttgggatgctactctagtattccagycctgaagaatcacaataattttctacctggtctctccttgttctgataatgaaaattatgataaggatgataaaagcacttacttcgtgtccgactcttc

SEQ ID NO: 4205 - DNA, 201 bp, Homo sapiens
tctgttcatttcctcaaaaagatttccccatttaggtttctgagttcctgcatgccggtgatccctagctgtgacctctcccctggaactgtctctcatgyacctcaagctgcatctagaggcttccttcatttcctccgtcacctcagagacatacacctatgtcatttcatttcctatttttggaagaggactccttaa

SEQ ID NO: 4206 - DNA, 201 bp, Homo sapiens
ggcccgcgagccaggccggcgcttctcctcctgatgcttttgcagaccgcggtcctgcaggggcgcttgctgctgcctcctttggtgaaggtgacacatcytgtgacctcttcagtgaccactctacggtgtcgggccttgaactactacccccagaacatcaccatgaagtggctgaaggataagcagccaatggatgcc

SEQ ID NO: 4207 - DNA, 201 bp, Homo sapiens
ggagccatggggcactacgtcttagctgaacgtgagtgacacgcagcctgcagactcactgtgggaaggagacaaaactagagactcaaagagggagtgcvtttatgagctcttcatgtttcaggagagagttgaacctaaacatagaaattgcctgacgaactccttgattttagccttctctgttcatttcctcaaaaa

SEQ ID NO: 4208 - DNA, 201 bp, Homo sapiens
cctgcaggggcgcttgctgctgcctcctttggtgaaggtgacacatcatgtgacctcttcagtgaccactctacggtgtcgggccttgaactactaccccragaacatcaccatgaagtggctgaaggataagcagccaatggatgccaaggagttcgaacctaaagacgtattgcccaatggggatgggacctaccaggg

SEQ ID NO: 4209 - DNA, 201 bp, Homo sapiens
agaggagccatggggcactacgtcttagctgaacgtgagtgacacgcagcctgcagactcactgtgggaaggagacaaaactagagactcaaagagggagygcatttatgagctcttcatgtttcaggagagagttgaacctaaacatagaaattgcctgacgaactccttgattttagccttctctgttcatttcctcaa

SEQ ID NO: 4210 - DNA, 201 bp, Homo sapiens
tgaaggtgacacatcatgtgacctcttcagtgaccactctacggtgtcgggccttgaactactacccccagaacatcaccatgaagtggctgaaggataaycagccaatggatgccaaggagttcgaacctaaagacgtattgcccaatggggatgggacctaccagggctggataaccttggctgtaccccctggggaag

SEQ ID NO: 4211 - DNA, 201 bp, Homo sapiens
ctcttcagtgaccactctacggtgtcgggccttgaactactacccccagaacatcaccatgaagtggctgaaggataagcagccaatggatgccaaggagytcgaacctaaagacgtattgcccaatggggatgggacctaccagggctggataaccttggctgtaccccctggggaagagcagagatatacgtgccaggt

SEQ ID NO: 4212 - DNA, 201 bp, Homo sapiens
ttaatggtgccttcatttgggatgctactctagtattccagacctgaagaatcacaataattttctacctggtctctccttgttctgataatgaaaattargataaggatgataaaagcacttacttcgtgtccgactcttctgagcacctacttacatgcattactgcatgcacttcttacaataattctatgagatagg

SEQ ID NO: 4213 - DNA, 201 bp, Homo sapiens
gctgaaggataagcagccaatggatgccaaggagttcgaacctaaagacgtattgcccaatggggatgggacctaccagggctggataaccttggctgtascccctggggaagagcagagatatacgtgccaggtggagcacccaggcctggatcagcccctcattgtgatctgggagccctcaccgtctggcaccctagt

SEQ ID NO: 4214 - DNA, 201 bp, Homo sapiens
ggtgacacatcatgtgacctcttcagtgaccactctacggtgtcgggccttgaactactacccccagaacatcaccatgaagtggctgaaggataagcagwcaatggatgccaaggagttcgaacctaaagacgtattgcccaatggggatgggacctaccagggctggataaccttggctgtaccccctggggaagagca

SEQ ID NO: 4215 - DNA, 201 bp, Homo sapiens
tagaaattgcctgacgaactccttgattttagccttctctgttcatttcctcaaaaagatttccccatttaggtttctgagttcctgcatgccggtgatckctagctgtgacctctcccctggaactgtctctcatgaacctcaagctgcatctagaggcttccttcatttcctccgtcacctcagagacatacacctatg

SEQ ID NO: 4216 - DNA, 201 bp, Homo sapiens; identical to SEQ ID NO: 4136

SEQ ID NO: 4217 - DNA, 201 bp, Homo sapiens; identical to SEQ ID NO: 4137

SEQ ID NO: 4218 - DNA, 201 bp, Homo sapiens; identical to SEQ ID NO: 4138

SEQ ID NO: 4219 - DNA, 201 bp, Homo sapiens
gggcctggcccaccaagctggagtgggaaaggcacaagattcgggccaggcagaacagggcctacctggagagggactgccctgcacagctgcagcagttvctggagctggggagaggtgttttggaccaacaagtgaccactctacggtgtcgggccttgaactactacccccagaacatcaccatgaagtggctgaagg

SEQ ID NO: 4220 - DNA, 201 bp, Homo sapiens; identical to SEQ ID NO: 4140

SEQ ID NO: 4221 - DNA, 201 bp, Homo sapiens
ccagggcctggcccaccaagctggagtgggaaaggcacaagattcgggccaggcagaacagggcctacctggagagggactgccctgcacagctgcagcayttgctggagctggggagaggtgttttggaccaacaagtgaccactctacggtgtcgggccttgaactactacccccagaacatcaccatgaagtggctga

SEQ ID NO: 4222 - DNA, 201 bp, Homo sapiens; identical to SEQ ID NO: 4142

SEQ ID NO: 4223 - DNA, 201 bp, Homo sapiens; identical to SEQ ID NO: 4143

SEQ ID NO: 4224 - DNA, 201 bp, Homo sapiens; identical to SEQ ID NO: 4144

SEQ ID NO: 4225 - DNA, 201 bp, Homo sapiens; identical to SEQ ID NO: 4145

SEQ ID NO: 4226 - DNA, 201 bp, Homo sapiens; identical to SEQ ID NO: 4146

SEQ ID NO: 4227 - DNA, 201 bp, Homo sapiens; identical to SEQ ID NO: 4092

SEQ ID NO: 4228 - DNA, 201 bp, Homo sapiens; identical to SEQ ID NO: 4093

SEQ ID NO: 4229 - DNA, 201 bp, Homo sapiens; identical to SEQ ID NO: 4094

SEQ ID NO: 4230 - DNA, 201 bp, Homo sapiens; identical to SEQ ID NO: 4095

SEQ ID NO: 4231 - DNA, 201 bp, Homo sapiens; identical to SEQ ID NO: 4096

SEQ ID NO: 4232 - DNA, 105 bp, Homo sapiens; identical to SEQ ID NO: 4097

SEQ ID NO: 4233 - DNA, 201 bp, Homo sapiens; identical to SEQ ID NO: 4099

SEQ ID NO: 4234 - DNA, 201 bp, Homo sapiens; identical to SEQ ID NO: 4098

SEQ ID NO: 4235 - DNA, 201 bp, Homo sapiens; identical to SEQ ID NO: 4116

SEQ ID NO: 4236 - DNA, 201 bp, Homo sapiens; identical to SEQ ID NO: 4117

SEQ ID NO: 4237 - DNA, 201 bp, Homo sapiens; identical to SEQ ID NO: 4118

SEQ ID NO: 4238 - DNA, 201 bp, Homo sapiens; identical to SEQ ID NO: 4119

SEQ ID NO: 4239 - DNA, 201 bp, Homo sapiens; identical to SEQ ID NO: 4101

SEQ ID NO: 4240 - DNA, 201 bp, Homo sapiens; identical to SEQ ID NO: 4102

SEQ ID NO: 4241 - DNA, 201 bp, Homo sapiens; identical to SEQ ID NO: 4103

SEQ ID NO: 4242 - DNA, 201 bp, Homo sapiens; identical to SEQ ID NO: 4104

SEQ ID NO: 4243 - DNA, 201 bp, Homo sapiens; identical to SEQ ID NO: 4105

SEQ ID NO: 4244 - DNA, 201 bp, Homo sapiens; identical to SEQ ID NO: 4106

SEQ ID NO: 4245 - DNA, 201 bp, Homo sapiens; identical to SEQ ID NO: 4107

SEQ ID NO: 4246 - DNA, 201 bp, Homo sapiens
gagccgcctcggtgggcatgcacctgctgtccccgcccagccggggcctgttccacagggccgtgctgcagagcggtgcccccaatggaccctgggccacrgtgggcatgggagaggcccgtcgcagggccacgcagctggcccaccttgtgggctgtcctccaggcggcactggtgggaatgacacagagctggtagcct

SEQ ID NO: 4247 - DNA, 201 bp, Homo sapiens
gctgcctcaagaaagcgtcttccggttctccttcgtgcctgtggtagatggagacttcctcagtgacaccccagaggccctcatcaacgcgggagacttcmacggcctgcaggtgctggtgggtgtggtgaaggatgagggctcgtattttctggtttacggggccccaggcttcagcaaagacaacgagtctctcatcag

SEQ ID NO: 4248 - DNA, 201 bp, Homo sapiens
tgcggagccacccatgggaccccgtcgctttctgccaccggagcccaagcagccttggtcaggggtggtagacgctacaaccttccagagtgtctgctacyaatatgtggacaccctatacccaggttttgagggcaccgagatgtggaaccccaaccgtgagctgagcgaggactgcctgtacctcaacgtgtggacacc

SEQ ID NO: 4249 - DNA, 201 bp, Homo sapiens
agctggctgggcgactggctgcccagggtgcccgggtctacgcctacgtctttgaacaccgtgcttccacgctctcctggcccctgtggatgggggtgccycacggctacgagatcgagttcatctttgggatccccctggacccctctcgaaactacacggcagaggagaaaatcttcgcccagcgactgatgcgatact

SEQ ID NO: 4250 - DNA, 201 bp, Homo sapiens
ctggtagcctgccttcggacacgaccagcgcaggtcctggtgaaccacgaatggcacgtgctgcctcaagaaagcgtcttccggttctccttcgtgcctgwggtagatggagacttcctcagtgacaccccagaggccctcatcaacgcgggagacttccacggcctgcaggtgctggtgggtgtggtgaaggatgagggc

SEQ ID NO: 4251 - DNA, 201 bp, Homo sapiens
tacacagactggctgcatcccgaggacccggcacgcctgagggaggccctgagcgatgtggtgggcgaccacaatgtcgtgtgccccgtggcccagctggstgggcgactggctgcccagggtgcccgggtctacgcctacgtctttgaacaccgtgcttccacgctctcctggcccctgtggatgggggtgccccacggc

SEQ ID NO: 4252 - DNA, 201 bp, Homo sapiens
tctgccaccggagcccaagcagccttggtcaggggtggtagacgctacaaccttccagagtgtctgctaccaatatgtggacaccctatacccaggttttsagggcaccgagatgtggaaccccaaccgtgagctgagcgaggactgcctgtacctcaacgtgtggacaccatacccccggcctacatcccccacccctgt

SEQ ID NO: 4253 - DNA, 201 bp, Homo sapiens
gcctgcgccttctggaaccgcttcctccccaaattgctcagcgccaccgcctcggaggctcccagcacctgcccaggcttcacccatggggaggctgctcsgaggcccggcctccccctgcccctcctcctcctccaccagcttctcctcctcttcctctcccacctccggcggctgtgaacacggcctcttcccctacgg

SEQ ID NO: 4254 - DNA, 201 bp, Homo sapiens; identical to SEQ ID NO: 4249

SEQ ID NO: 4255 - DNA, 201 bp, Homo sapiens; identical to SEQ ID NO: 4246

SEQ ID NO: 4256 - DNA, 201 bp, Homo sapiens; identical to SEQ ID NO: 4248

SEQ ID NO: 4257 - DNA, 201 bp, Homo sapiens; identical to SEQ ID NO: 4250

SEQ ID NO: 4258 - DNA, 201 bp, Homo sapiens; identical to SEQ ID NO: 4251

SEQ ID NO: 4259 - DNA, 201 bp, Homo sapiens; identical to SEQ ID NO: 4252

SEQ ID NO: 4260 - DNA, 201 bp, Homo sapiens; identical to SEQ ID NO: 4247

SEQ ID NO: 4261 - DNA, 201 bp, Homo sapiens; identical to SEQ ID NO: 4249

SEQ ID NO: 4262 - DNA, 201 bp, Homo sapiens; identical to SEQ ID NO: 4246

SEQ ID NO: 4263 - DNA, 201 bp, Homo sapiens; identical to SEQ ID NO: 4248

SEQ ID NO: 4264 - DNA, 201 bp, Homo sapiens; identical to SEQ ID NO: 4250

SEQ ID NO: 4265 - DNA, 201 bp, Homo sapiens; identical to SEQ ID NO: 4251

SEQ ID NO: 4266 - DNA, 201 bp, Homo sapiens; identical to SEQ ID NO: 4252

SEQ ID NO: 4267 - DNA, 201 bp, Homo sapiens; identical to SEQ ID NO: 4247

SEQ ID NO: 4268 - DNA, 201 bp, Homo sapiens; identical to SEQ ID NO: 4246

SEQ ID NO: 4269 - DNA, 201 bp, Homo sapiens; identical to SEQ ID NO: 4247

SEQ ID NO: 4270 - DNA, 201 bp, Homo sapiens; identical to SEQ ID NO: 4248

SEQ ID NO: 4271 - DNA, 201 bp, Homo sapiens; identical to SEQ ID NO: 4249

SEQ ID NO: 4272 - DNA, 201 bp, Homo sapiens; identical to SEQ ID NO: 4250

SEQ ID NO: 4273 - DNA, 201 bp, Homo sapiens; identical to SEQ ID NO: 4251

SEQ ID NO: 4274 - DNA, 201 bp, Homo sapiens; identical to SEQ ID NO: 4252

SEQ ID NO: 4275 - DNA, 201 bp, Homo sapiens; identical to SEQ ID NO: 4253

SEQ ID NO: 4276 - DNA, 201 bp, Homo sapiens
taagtcttcttagatataatgctaacttaacaaaaatgaagaacactttgatctcagcatcacaacaactgaaagctaaattggagttttttcacaaaagyattcagcttgacttggagagatacagcgagcagatgacgtatgggatatcttcagaaaaaatgctaaaagcatggaaagaaatggaagaaaaggccatcc

SEQ ID NO: 4277 - DNA, 201 bp, Homo sapiens
aaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgag

SEQ ID NO: 4278 - DNA, 201 bp, Homo sapiens
taagaagaaggatccaaagtgtatatttgcatgtgaagagatgtcaggagaagttcggtttagtagccatttacctcaaccaaatagcctttgtagtttartagtagaacccatggaaaactggctacagttgatgttgaattgggaccctcagcagagaggaggacctgttgaccttactttgaagcagccaagatgttt

SEQ ID NO: 4279 - DNA, 201 bp, Homo sapiens
aattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagt

SEQ ID NO: 4280 - DNA, 201 bp, Homo sapiens
ctttgatctcagcatcacaacaactgaaagctaaattggagttttttcacaaaagcattcagcttgacttggagagatacagcgagcagatgacgtatggratatcttcagaaaaaatgctaaaagcatggaaagaaatggaagaaaaggccatccactatgctgaggttggtgtcattggatacctggaggatcagatta

SEQ ID NO: 4281 - DNA, 201 bp, Homo sapiens
aatactgttctggaggagatctccgaaagctgctcaacaaaccagaaaattgttgtggacttaaagaaagccagatactttctttactaagtgatataggrtctgggattcgatatttgcatgaaaacaaaattatacatcgagatctaaaacctgaaaacatagttcttcaggatgttggtggaaagataatacataaaa

SEQ ID NO: 4282 - DNA, 201 bp, Homo sapiens
tgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggttt

SEQ ID NO: 4283 - DNA, 201 bp, Homo sapiens
tcattttaaattccactgaaaatttaacagtatccccttctcatcgaagggattgtgtatctgtgcttctaatattagttggctttcataaatcatgttgktgtgtgtatatgtatttaagatgtacatttaataatatcaaagagaagatgcctgttaatttataatgtatttgaaaattacatgttttttcatttgtaa

SEQ ID NO: 4284 - DNA, 201 bp, Homo sapiens
gcaaaatacagcttccaattatacagctgcgtaaagtgtgggctgaagcagtgcactatgtgtctggactaaaagaagactatagcaggctctttcagggrcaaagggcagcaatgttaagtcttcttagatataatgctaacttaacaaaaatgaagaacactttgatctcagcatcacaacaactgaaagctaaattgg

SEQ ID NO: 4285 - DNA, 201 bp, Homo sapiens
catgtgaagagatgtcaggagaagttcggtttagtagccatttacctcaaccaaatagcctttgtagtttagtagtagaacccatggaaaactggctacasttgatgttgaattgggaccctcagcagagaggaggacctgttgaccttactttgaagcagccaagatgttttgtattaatggatcacattttgaatttga

SEQ ID NO: 4286 - DNA, 201 bp, Homo sapiens
tcctggcatcataaggagttggtgtaatcattttaaattccactgaaaatttaacagtatccccttctcatcgaagggattgtgtatctgtgcttctaatmttagttggctttcataaatcatgttgttgtgtgtatatgtatttaagatgtacatttaataatatcaaagagaagatgcctgttaatttataatgtattt

SEQ ID NO: 4287 - DNA, 201 bp, Homo sapiens
ggcagcagcttcagctaccccgatgttaagctcaaaggcatccctgtgtatccctacccgagggccacctccccagcccctgatgcggactcctgctgcarggagccactggccgatcccccacccatgcgacacagcctgcccagcacctttgccagtagtcctcgtggctccgaggagtactattctttccatgagtcg

SEQ ID NO: 4288 - DNA, 201 bp, Homo sapiens
ctgctgcctgctctggcgaccctgggtgtgggagtggtgccgggctgccttctgcttccgccgctgccgggattgcctccagcgctgtggagcctgtgtgyggggatgcagcccctgcctgtctactgaggactccactgaggggactgctgaagccaactgggccaaggagcacaatggagtgccccccagccctgatcg

SEQ ID NO: 4289 - DNA, 201 bp, Homo sapiens
ccggcccttgagtcccccacctgctgcctgctctggcgaccctgggtgtgggagtggtgccgggctgccttctgcttccgccgctgccgggattgcctccrgcgctgtggagcctgtgtgcggggatgcagcccctgcctgtctactgaggactccactgaggggactgctgaagccaactgggccaaggagcacaatgga

SEQ ID NO: 4290 - DNA, 201 bp, Homo sapiens
agtggtgccgggctgccttctgcttccgccgctgccgggattgcctccagcgctgtggagcctgtgtgcggggatgcagcccctgcctgtctactgaggaytccactgaggggactgctgaagccaactgggccaaggagcacaatggagtgccccccagccctgatcgtgcaccccccagccggcgggatggccagcggc

SEQ ID NO: 4291 - DNA, 201 bp, Homo sapiens
agcagatgacaggaaggtcaaggtaagtcagggaaacaggggtggggaatggagagtgctgagactctaaaagagaataggctggtagtcttggctccctrgtattgcaccctgaggggcagactatcatggggaatttaaatgaaacaagattcataaagcctgtgtagtgctggaatgccactgatgctaaatacatgt

SEQ ID NO: 4292 - DNA, 201 bp, Homo sapiens
tacatgaagtcactcggtgtgggttttgctaccaggcaggtggccagcatgaccaagcctaccacaatcatcgaaaagaatggggacattctcaccctaaraacacacagcaccttcaagaacacagagatcagctttaagttgggggtggagttcgatgagacaacagcagatgacaggaaggtcaaggtaagtcaggga

SEQ ID NO: 4293 - DNA, 201 bp, Homo sapiens
gatgcgagggctatttaaagcggcagcccgggcagggagccgccgtcggagcccttgcacgcctgctctcttgtagcttctctcagcctagcccagcatcrctatggtggacgctttcctgggcacctggaagctagtggacagcaagaatttcgatgactacatgaagtcactcggtgtgggttttgctaccaggcaggt

SEQ ID NO: 4294 - DNA, 201 bp, Homo sapiens
tacatgaagtcactcggtgtgggttttgctaccaggcaggtggccagcatgaccaagcctaccacaatcatcgaaaagaatggggacattctcaccctaaraacacacagcaccttcaagaacacagagatcagctttaagttgggggtggagttcgatgagacaacagcagatgacaggaaggtcaagtccattgtgaca

SEQ ID NO: 4295 - DNA, 201 bp, Homo sapiens; identical to SEQ ID NO: 4293

SEQ ID NO: 4296 - DNA, 201 bp, Homo sapiens
gctgcctggctgcctggccctggctgccctgtgtagccttgtgcacagccagcatgtgttcctggctcctcagcaagcacggtcgctgctccagcgggtcyggcgagccaacaccttcttggaggaggtgcgcaagggcaacctggagcgagagtgcgtggaggagacgtgcagctacgaggaggccttcgaggctctgga

SEQ ID NO: 4297 - DNA, 201 bp, Homo sapiens
tttgtcatgaagagcccctttaacaaccgctggtatcaaatgggcatcgtctcatggggtgaaggctgtgaccgggatgggaaatatggcttctacacacrtgtgttccgcctgaagaagtggatacagaaggtcattgatcagtttggagagtagggggccactcatattctgggctcctggaaccaatcccgtgaaaga

SEQ ID NO: 4298 - DNA, 201 bp, Homo sapiens
catgttctgtgctggttacaagcctgatgaagggaaacgaggggatgcctgtgaaggtgacagtgggggaccctttgtcatgaagagcccctttaacaacygctggtatcaaatgggcatcgtctcatggggtgaaggctgtgaccgggatgggaaatatggcttctacacacatgtgttccgcctgaagaagtggataca

SEQ ID NO: 4299 - DNA, 201 bp, Homo sapiens
ctttggctcgggagaggcagactgtgggctgcgacctctgttcgagaagaagtcgctggaggacaaaaccgaaagagagctcctggaatcctacatcgacrggcgcattgtggagggctcggatgcagagatcggcatgtcaccttggcaggtgatgcttttccggaagagtccccaggagctgctgtgtggggccagcct

SEQ ID NO: 4300 - DNA, 201 bp, Homo sapiens
tgagtgccagctatggaggagtcgctacccacataagcctgaaatcaactccactacccatcctggggccgacctacaggagaatttctgccgcaacccckacagcagcaccacgggaccctggtgctacactacagaccccaccgtgaggaggcaggaatgcagcatccctgtctgtggccaggatcaagtcactgtagc

SEQ ID NO: 4301 - DNA, 201 bp, Homo sapiens
cattgtggagggctcggatgcagagatcggcatgtcaccttggcaggtgatgcttttccggaagagtccccaggagctgctgtgtggggccagcctcatcmgtgaccgctgggtcctcaccgccgcccactgcctcctgtacccgccctgggacaagaacttcaccgagaatgaccttctggtgcgcattggcaagcactc

SEQ ID NO: 4302 - DNA, 201 bp, Homo sapiens
gggaaacgaggggatgcctgtgaaggtgacagtgggggaccctttgtcatgaagagcccctttaacaaccgctggtatcaaatgggcatcgtctcatgggstgaaggctgtgaccgggatgggaaatatggcttctacacacatgtgttccgcctgaagaagtggatacagaaggtcattgatcagtttggagagtagggg

SEQ ID NO: 4303 - DNA, 201 bp, Homo sapiens
ccagcgcacaggccaaggccctgagcaagcaccaggacttcaactcagctgtgcagctggtggagaacttctgccgcaacccagacggggatgaggagggygtgtggtgctatgtggccgggaagcctggcgactttgggtactgcgacctcaactattgtgaggaggccgtggaggaggagacaggagatgggctggatg

SEQ ID NO: 4304 - DNA, 201 bp, Homo sapiens
tggaggagtcgctacccacataagcctgaaatcaactccactacccatcctggggccgacctacaggagaatttctgccgcaaccccgacagcagcaccaygggaccctggtgctacactacagaccccaccgtgaggaggcaggaatgcagcatccctgtctgtggccaggatcaagtcactgtagcgatgactccacgc

SEQ ID NO: 4305 - DNA, 201 bp, Homo sapiens
tgacaggctggggcaacctgaaggagacgtggacagccaacgttggtaaggggcagcccagtgtcctgcaggtggtgaacctgcccattgtggagcggccrgtctgcaaggactccacccggatccgcatcactgacaacatgttctgtgctggttacaagcctgatgaagggaaacgaggggatgcctgtgaaggtgaca

SEQ ID NO: 4306 - DNA, 201 bp, Homo sapiens
gctcggatgcagagatcggcatgtcaccttggcaggtgatgcttttccggaagagtccccaggagctgctgtgtggggccagcctcatcagtgaccgctgkgtcctcaccgccgcccactgcctcctgtacccgccctgggacaagaacttcaccgagaatgaccttctggtgcgcattggcaagcactcccgcaccaggt

SEQ ID NO: 4307 - DNA, 201 bp, Homo sapiens
caagcactcccgcaccaggtacgagcgaaacattgaaaagatatccatgttggaaaagatctacatccaccccaggtacaactggcgggagaacctggacygggacattgccctgatgaagctgaagaagcctgttgccttcagtgactacattcaccctgtgtgtctgcccgacagggagacggcagccagcttgctcca

SEQ ID NO: 4308 - DNA, 201 bp, Homo sapiens
ggtgacagtgggggaccctttgtcatgaagagcccctttaacaaccgctggtatcaaatgggcatcgtctcatggggtgaaggctgtgaccgggatgggamatatggcttctacacacatgtgttccgcctgaagaagtggatacagaaggtcattgatcagtttggagagtagggggccactcatattctgggctcctgg

SEQ ID NO: 4309 - DNA, 201 bp, Homo sapiens
agtgggggaccctttgtcatgaagagcccctttaacaaccgctggtatcaaatgggcatcgtctcatggggtgaaggctgtgaccgggatgggaaatatgkcttctacacacatgtgttccgcctgaagaagtggatacagaaggtcattgatcagtttggagagtagggggccactcatattctgggctcctggaaccaa

SEQ ID NO: 4310 - DNA, 201 bp, Homo sapiens
accctggtgctacactacagaccccaccgtgaggaggcaggaatgcagcatccctgtctgtggccaggatcaagtcactgtagcgatgactccacgctccraaggctccagtgtgaatctgtcacctccattggagcagtgtgtccctgatcgggggcagcagtaccaggggcgcctggcggtgaccacacatgggctccc

SEQ ID NO: 4311 - DNA, 107 bp, Homo sapiens
gtagggggccactcatattctgggctcctggaaccaatcccgtgaaagaattatttttgtgtttctaaaactatggttcccaataaaagtgactctcagcragcctc

SEQ ID NO: 4312 - DNA, 201 bp, Homo sapiens
ggcaacctggagcgagagtgcgtggaggagacgtgcagctacgaggaggccttcgaggctctggagtcctccacggctacggatgtgttctgggccaagtrcacagcttgtgagacagcgaggacgcctcgagataagcttgctgcatgtctggaaggtaactgtgctgagggtctgggtacgaactaccgagggcatgtg

SEQ ID NO: 4313 - DNA, 201 bp, Homo sapiens
ggctcgggagaggcagactgtgggctgcgacctctgttcgagaagaagtcgctggaggacaaaaccgaaagagagctcctggaatcctacatcgacgggcrcattgtggagggctcggatgcagagatcggcatgtcaccttggcaggtgatgcttttccggaagagtccccaggagctgctgtgtggggccagcctcatc

SEQ ID NO: 4314 - DNA, 201 bp, Homo sapiens
cctggggccgacctacaggagaatttctgccgcaaccccgacagcagcaccacgggaccctggtgctacactacagaccccaccgtgaggaggcaggaatrcagcatccctgtctgtggccaggatcaagtcactgtagcgatgactccacgctccgaaggctccagtgtgaatctgtcacctccattggagcagtgtgtc

SEQ ID NO: 4315 - DNA, 201 bp, Homo sapiens
acctctgttcgagaagaagtcgctggaggacaaaaccgaaagagagctcctggaatcctacatcgacgggcgcattgtggagggctcggatgcagagatcrgcatgtcaccttggcaggtgatgcttttccggaagagtccccaggagctgctgtgtggggccagcctcatcagtgaccgctgggtcctcaccgccgccca

SEQ ID NO: 4316 - DNA, 201 bp, Homo sapiens
ctggaggacaaaaccgaaagagagctcctggaatcctacatcgacgggcgcattgtggagggctcggatgcagagatcggcatgtcaccttggcaggtgaygcttttccggaagagtccccaggagctgctgtgtggggccagcctcatcagtgaccgctgggtcctcaccgccgcccactgcctcctgtacccgccctgg

SEQ ID NO: 4317 - DNA, 201 bp, Homo sapiens
caaaaccgaaagagagctcctggaatcctacatcgacgggcgcattgtggagggctcggatgcagagatcggcatgtcaccttggcaggtgatgcttttcyggaagagtccccaggagctgctgtgtggggccagcctcatcagtgaccgctgggtcctcaccgccgcccactgcctcctgtacccgccctgggacaagaa

SEQ ID NO: 4318 - DNA, 201 bp, Homo sapiens
ttgagtgccagctatggaggagtcgctacccacataagcctgaaatcaactccactacccatcctggggccgacctacaggagaatttctgccgcaacccygacagcagcaccacgggaccctggtgctacactacagaccccaccgtgaggaggcaggaatgcagcatccctgtctgtggccaggatcaagtcactgtag

SEQ ID NO: 4319 - DNA, 201 bp, Homo sapiens
gaccgctgggtcctcaccgccgcccactgcctcctgtacccgccctgggacaagaacttcaccgagaatgaccttctggtgcgcattggcaagcactcccrcaccaggtacgagcgaaacattgaaaagatatccatgttggaaaagatctacatccaccccaggtacaactggcgggagaacctggaccgggacattgcc

SEQ ID NO: 4320 - DNA, 201 bp, Homo sapiens
aggtgatgcttttccggaagagtccccaggagctgctgtgtggggccagcctcatcagtgaccgctgggtcctcaccgccgcccactgcctcctgtacccrccctgggacaagaacttcaccgagaatgaccttctggtgcgcattggcaagcactcccgcaccaggtacgagcgaaacattgaaaagatatccatgttgg

SEQ ID NO: 4321 - DNA, 201 bp, Homo sapiens
aagagagctcctggaatcctacatcgacgggcgcattgtggagggctcggatgcagagatcggcatgtcaccttggcaggtgatgcttttccggaagagtmcccaggagctgctgtgtggggccagcctcatcagtgaccgctgggtcctcaccgccgcccactgcctcctgtacccgccctgggacaagaacttcaccga

SEQ ID NO: 4322 - DNA, 201 bp, Homo sapiens
ggcgactttgggtactgcgacctcaactattgtgaggaggccgtggaggaggagacaggagatgggctggatgaggactcagacagggccatcgaagggcrtaccgccaccagtgagtaccagactttcttcaatccgaggacctttggctcgggagaggcagactgtgggctgcgacctctgttcgagaagaagtcgctg

SEQ ID NO: 4323 - DNA, 201 bp, Homo sapiens
cctggctgcctggccctggctgccctgtgtagccttgtgcacagccagcatgtgttcctggctcctcagcaagcacggtcgctgctccagcgggtccggcragccaacaccttcttggaggaggtgcgcaagggcaacctggagcgagagtgcgtggaggagacgtgcagctacgaggaggccttcgaggctctggagtcc

SEQ ID NO: 4324 - DNA, 201 bp, Homo sapiens
gactacattcaccctgtgtgtctgcccgacagggagacggcagccagcttgctccaggctggatacaaggggcgggtgacaggctggggcaacctgaaggmgacgtggacagccaacgttggtaaggggcagcccagtgtcctgcaggtggtgaacctgcccattgtggagcggccggtctgcaaggactccacccggatc

SEQ ID NO: 4325 - DNA, 201 bp, Homo sapiens
tgccctgtgtagccttgtgcacagccagcatgtgttcctggctcctcagcaagcacggtcgctgctccagcgggtccggcgagccaacaccttcttggagraggtgcgcaagggcaacctggagcgagagtgcgtggaggagacgtgcagctacgaggaggccttcgaggctctggagtcctccacggctacggatgtgtt

SEQ ID NO: 4326 - DNA, 201 bp, Homo sapiens
tgagtaccagactttcttcaatccgaggacctttggctcgggagaggcagactgtgggctgcgacctctgttcgagaagaagtcgctggaggacaaaaccraaagagagctcctggaatcctacatcgacgggcgcattgtggagggctcggatgcagagatcggcatgtcaccttggcaggtgatgcttttccggaagag

SEQ ID NO: 4327 - DNA, 201 bp, Homo sapiens
tggcgactttgggtactgcgacctcaactattgtgaggaggccgtggaggaggagacaggagatgggctggatgaggactcagacagggccatcgaagggygtaccgccaccagtgagtaccagactttcttcaatccgaggacctttggctcgggagaggcagactgtgggctgcgacctctgttcgagaagaagtcgct

SEQ ID NO: 4328 - DNA, 201 bp, Homo sapiens
aacaaccgctggtatcaaatgggcatcgtctcatggggtgaaggctgtgaccgggatgggaaatatggcttctacacacatgtgttccgcctgaagaagtrgatacagaaggtcattgatcagtttggagagtagggggccactcatattctgggctcctggaaccaatcccgtgaaagaattatttttgtgtttctaaaa

SEQ ID NO: 4329 - DNA, 201 bp, Homo sapiens
ggcgcacgtccgaggcttgcagctgcctggctgcctggccctggctgccctgtgtagccttgtgcacagccagcatgcacggtcgctgctccagcgggtcyggcgagccaacaccttcttggaggaggtgcgcaagggcaacctggagcgagagtgcgtggaggagacgtgcagctacgaggaggccttcgaggctctgga

SEQ ID NO: 4330 - DNA, 201 bp, Homo sapiens; identical to SEQ ID NO: 4297

SEQ ID NO: 4331 - DNA, 201 bp, Homo sapiens; identical to SEQ ID NO: 4298

SEQ ID NO: 4332 - DNA, 201 bp, Homo sapiens; identical to SEQ ID NO: 4299

SEQ ID NO: 4333 - DNA, 201 bp, Homo sapiens; identical to SEQ ID NO: 4300

SEQ ID NO: 4334 - DNA, 201 bp, Homo sapiens; identical to SEQ ID NO: 4301

SEQ ID NO: 4335 - DNA, 201 bp, Homo sapiens; identical to SEQ ID NO: 4302

SEQ ID NO: 4336 - DNA, 201 bp, Homo sapiens; identical to SEQ ID NO: 4303

SEQ ID NO: 4337 - DNA, 201 bp, Homo sapiens; identical to SEQ ID NO: 4304

SEQ ID NO: 4338 - DNA, 201 bp, Homo sapiens; identical to SEQ ID NO: 4305

SEQ ID NO: 4339 - DNA, 201 bp, Homo sapiens; identical to SEQ ID NO: 4306

SEQ ID NO: 4340 - DNA, 201 bp, Homo sapiens; identical to SEQ ID NO: 4307

SEQ ID NO: 4341 - DNA, 201 bp, Homo sapiens; identical to SEQ ID NO: 4308

SEQ ID NO: 4342 - DNA, 201 bp, Homo sapiens; identical to SEQ ID NO: 4309

SEQ ID NO: 4343 - DNA, 201 bp, Homo sapiens; identical to SEQ ID NO: 4310

SEQ ID NO: 4344 - DNA, 107 bp, Homo sapiens; identical to SEQ ID NO: 4311

SEQ ID NO: 4345 - DNA, 201 bp, Homo sapiens; identical to SEQ ID NO: 4312

SEQ ID NO: 4346 - DNA, 201 bp, Homo sapiens; identical to SEQ ID NO: 4313

SEQ ID NO: 4347 - DNA, 201 bp, Homo sapiens; identical to SEQ ID NO: 4314

SEQ ID NO: 4348 - DNA, 201 bp, Homo sapiens; identical to SEQ ID NO: 4315

SEQ ID NO: 4349 - DNA, 201 bp, Homo sapiens; identical to SEQ ID NO: 4316

SEQ ID NO: 4350 - DNA, 201 bp, Homo sapiens; identical to SEQ ID NO: 4317

SEQ ID NO: 4351 - DNA, 201 bp, Homo sapiens; identical to SEQ ID NO: 4318

SEQ ID NO: 4352 - DNA, 201 bp, Homo sapiens; identical to SEQ ID NO: 4319

SEQ ID NO: 4353 - DNA, 201 bp, Homo sapiens; identical to SEQ ID NO: 4320

SEQ ID NO: 4354 - DNA, 201 bp, Homo sapiens; identical to SEQ ID NO: 4321

SEQ ID NO: 4355 - DNA, 201 bp, Homo sapiens; identical to SEQ ID NO: 4322

SEQ ID NO: 4356 - DNA, 201 bp, Homo sapiens
cacgtccgaggcttgcagctgcctggctgcctggccctggctgccctgtgtagccttgtgcacagccagcatgcacggtcgctgctccagcgggtccggcragccaacaccttcttggaggaggtgcgcaagggcaacctggagcgagagtgcgtggaggagacgtgcagctacgaggaggccttcgaggctctggagtcc

SEQ ID NO: 4357 - DNA, 201 bp, Homo sapiens; identical to SEQ ID NO: 4324

SEQ ID NO: 4358 - DNA, 201 bp, Homo sapiens
gcctggctgcctggccctggctgccctgtgtagccttgtgcacagccagcatgcacggtcgctgctccagcgggtccggcgagccaacaccttcttggagraggtgcgcaagggcaacctggagcgagagtgcgtggaggagacgtgcagctacgaggaggccttcgaggctctggagtcctccacggctacggatgtgtt

SEQ ID NO: 4359 - DNA, 201 bp, Homo sapiens; identical to SEQ ID NO: 4326

SEQ ID NO: 4360 - DNA, 201 bp, Homo sapiens; identical to SEQ ID NO: 4327

SEQ ID NO: 4361 - DNA, 201 bp, Homo sapiens; identical to SEQ ID NO: 4328

SEQ ID NO: 4362 - DNA, 201 bp, Homo sapiens; identical to SEQ ID NO: 4296

SEQ ID NO: 4363 - DNA, 201 bp, Homo sapiens; identical to SEQ ID NO: 4297

SEQ ID NO: 4364 - DNA, 201 bp, Homo sapiens
ttctgtgctggcaagttacaagcctgatgaagggaaacgaggggatgcctgtgaaggtgacagtgggggaccctttgtcatgaagagcccctttaacaacygctggtatcaaatgggcatcgtctcatggggtgaaggctgtgaccgggatgggaaatatggcttctacacacatgtgttccgcctgaagaagtggataca

SEQ ID NO: 4365 - DNA, 201 bp, Homo sapiens; identical to SEQ ID NO: 4299

SEQ ID NO: 4366 - DNA, 201 bp, Homo sapiens; identical to SEQ ID NO: 4300

SEQ ID NO: 4367 - DNA, 201 bp, Homo sapiens; identical to SEQ ID NO: 4301

SEQ ID NO: 4368 - DNA, 201 bp, Homo sapiens; identical to SEQ ID NO: 4302

SEQ ID NO: 4369 - DNA, 201 bp, Homo sapiens; identical to SEQ ID NO: 4303

SEQ ID NO: 4370 - DNA, 201 bp, Homo sapiens; identical to SEQ ID NO: 4304

SEQ ID NO: 4371 - DNA, 201 bp, Homo sapiens
tgacaggctggggcaacctgaaggagacgtggacagccaacgttggtaaggggcagcccagtgtcctgcaggtggtgaacctgcccattgtggagcggccrgtctgcaaggactccacccggatccgcatcactgacaacatgttctgtgctggcaagttacaagcctgatgaagggaaacgaggggatgcctgtgaaggt

SEQ ID NO: 4372 - DNA, 201 bp, Homo sapiens; identical to SEQ ID NO: 4306

SEQ ID NO: 4373 - DNA, 201 bp, Homo sapiens; identical to SEQ ID NO: 4307

SEQ ID NO: 4374 - DNA, 201 bp, Homo sapiens; identical to SEQ ID NO: 4308

SEQ ID NO: 4375 - DNA, 201 bp, Homo sapiens; identical to SEQ ID NO: 4310

SEQ ID NO: 4376 - DNA, 201 bp, Homo sapiens; identical to SEQ ID NO: 4309

SEQ ID NO: 4377 - DNA, 102 bp, Homo sapiens
gtagggggccactcatattctgggctcctggaaccaatcccgtgaaagaattatttttgtgtttctaaaactatggttcccaataaaagtgactctcagcra

SEQ ID NO: 4378 - DNA, 201 bp, Homo sapiens; identical to SEQ ID NO: 4312

SEQ ID NO: 4379 - DNA, 201 bp, Homo sapiens; identical to SEQ ID NO: 4313

SEQ ID NO: 4380 - DNA, 201 bp, Homo sapiens; identical to SEQ ID NO: 4314

SEQ ID NO: 4381 - DNA, 201 bp, Homo sapiens; identical to SEQ ID NO: 4315

SEQ ID NO: 4382 - DNA, 201 bp, Homo sapiens; identical to SEQ ID NO: 4316

SEQ ID NO: 4383 - DNA, 201 bp, Homo sapiens; identical to SEQ ID NO: 4317

SEQ ID NO: 4384 - DNA, 201 bp, Homo sapiens; identical to SEQ ID NO: 4318

SEQ ID NO: 4385 - DNA, 201 bp, Homo sapiens; identical to SEQ ID NO: 4319

SEQ ID NO: 4386 - DNA, 201 bp, Homo sapiens; identical to SEQ ID NO: 4320

SEQ ID NO: 4387 - DNA, 201 bp, Homo sapiens; identical to SEQ ID NO: 4321

SEQ ID NO: 4388 - DNA, 201 bp, Homo sapiens; identical to SEQ ID NO: 4322

SEQ ID NO: 4389 - DNA, 201 bp, Homo sapiens; identical to SEQ ID NO: 4323

SEQ ID NO: 4390 - DNA, 201 bp, Homo sapiens; identical to SEQ ID NO: 4324

SEQ ID NO: 4391 - DNA, 201 bp, Homo sapiens; identical to SEQ ID NO: 4325

SEQ ID NO: 4392 - DNA, 201 bp, Homo sapiens; identical to SEQ ID NO: 4326

SEQ ID NO: 4393 - DNA, 201 bp, Homo sapiens; identical to SEQ ID NO: 4327

SEQ ID NO: 4394 - DNA, 201 bp, Homo sapiens; identical to SEQ ID NO: 4328

SEQ ID NO: 4395 - DNA, 145 bp, Homo sapiens
ctcgtagtccagcgacctgagggcaaacaggtggccgttgtccgygttgatggagaccagggaagagaggggcagccacagaatagcgtcttgactcggacccagccagagaccctcccagaaaaacaaagagaagcaagacttg

SEQ ID NO: 4396 - DNA, 201 bp, Homo sapiens
gtccgcgttgatggagaccagggaagagaggggcagccacagaatagcgtcttgactcggacccagccagagaccctcccagaaaaacaaagagaagcaasacttgcctttgtctaagaaatcgctctcctcccgcctccattgcactttccgtcacgctcttccagggaatgtcgccaagctgaacctcagacagagctg

SEQ ID NO: 4397 - DNA, 201 bp, Homo sapiens
tttaccacactggatccgtgcgtcaccgagcatgcacaatgcctgtggtttaattcgccttcttagtcaacagcgccaccatgcgttcgcttgcagttacaaaatcttggagaaggtgtttttattttgctttatcgattattcttatcaaccctagttgacgctactggaggagtttctcatgttatatgaattaaataa

SEQ ID NO: 4398 - DNA, 125 bp, Homo sapiens
ctcgtagtccagcgacctgagggcraacaggtggccgttgtccgcgttgatggagaccagggaagagaggggcagccacagaatagcgtcttgactcggacccagccagagaccctcccagaaaa

SEQ ID NO: 4399 - DNA, 201 bp, Homo sapiens
gaatgtcgccaagctgaacctcagacagagctgggaaacagtcttttgccccacaacctttgtagacggcctagtgaataagcctttccagaggctcagasttgctggctcaaaaatctgcctgggctctcaaccgctggtttaccacactggatccgtgcgtcaccgagcatgcacaatgcctgtggtttaattcgcctt

SEQ ID NO: 4400 - DNA, 201 bp, Homo sapiens
ccaagctgaacctcagacagagctgggaaacagtcttttgccccacaacctttgtagacggcctagtgaataagcctttccagaggctcagacttgctggstcaaaaatctgcctgggctctcaaccgctggtttaccacactggatccgtgcgtcaccgagcatgcacaatgcctgtggtttaattcgccttcttagtca

SEQ ID NO: 4401 - DNA, 201 bp, Homo sapiens
gcaagacttgcctttgtctaagaaatcgctctcctcccgcctccattgcactttccgtcacgctcttccagggaatgtcgccaagctgaacctcagacagmgctgggaaacagtcttttgccccacaacctttgtagacggcctagtgaataagcctttccagaggctcagacttgctggctcaaaaatctgcctgggctc

SEQ ID NO: 4402 - DNA, 201 bp, Homo sapiens
ccggtcccgtagcaggtcgcgctctcggggaaggtcgtactgcggaagggcgtacgcgatcgcgcggggacagcgctactacggctttggtcgcacagtgyacccggaggagcacagcagatggagggacagatccaggacgaggtcgcggagcagaaccccctttcgcttaagtgaaaaagatcgaatggagctgttaga

SEQ ID NO: 4403 - DNA, 201 bp, Homo sapiens
gatgtatataatgtgctaaattcaaagtagcaaatctgaagataggcaatgtcaaacccatgaaaatgggagattaatgagctttatttggccgtgcatgrtgcctcatgcctgtaatgaggcagatggcttgagtccaggagttcaagactagcctgggcaatgtggcaaaaccgcgtgtttacaaaaaatacaaaaatt

SEQ ID NO: 4404 - DNA, 201 bp, Homo sapiens
ggctaaagcatcagaggtttaatttgaagtttatgttcacacactgaaaacttagtttttttgttggtagatccatgtgcatgctagaatttgggacaggyactatttgcataaagtattaaagtcaatttttaaactaagcaaaggtacacgttgtaacggtggggcatctgtgaaaaagatgtccctttcataatatat

SEQ ID NO: 4405 - DNA, 201 bp, Homo sapiens
agcctttctctcagtcgtgagggaggcgtcgacggcgtgcgatgtccaactacgtgaacgacatgtggccgggctcgccgcaggagaaggattcgccctckacctcgcggtcgggcgggtccagccggctgtcgtcgcggtctaggagccgctctttttccagaagctctcggtcccattcccgcgtctcgagccggtttt

SEQ ID NO: 4406 - DNA, 201 bp, Homo sapiens
ggtcgtactgcggaagggcgtacgcgatcgcgcggggacagcgctactacggctttggtcgcacagtgtacccggaggagcacagcagatggagggacagmtccaggacgaggtcgcggagcagaaccccctttcgcttaagtgaaaaagatcgaatggagctgttagaaatagcaaaaaccaatgcagcgaaagctctag

SEQ ID NO: 4407 - DNA, 201 bp, Homo sapiens
ggatttagaaaccaagggtatgtgttttaaaattacactttttcttaacctgtctagctgtcggaaaaggtaacagaagatggaactcgaaatcccaatgraaaacctacccagcaaagaagcatagcttttagctctaataattctgtagcaaagccaatacaaaaatcagctaaagctgccacagaagaggcatcttca

SEQ ID NO: 4408 - DNA, 201 bp, Homo sapiens
ggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttatt

SEQ ID NO: 4409 - DNA, 201 bp, Homo sapiens
ccgaaaggaaggcgtctgttgagcctttctctcagtcgtgagggaggcgtcgacggcgtgcgatgtccaactacgtgaacgacatgtggccgggctcgcckcaggagaaggattcgccctcgacctcgcggtcgggcgggtccagccggctgtcgtcgcggtctaggagccgctctttttccagaagctctcggtcccatt

SEQ ID NO: 4410 - DNA, 201 bp, Homo sapiens; identical to SEQ ID NO: 4405

SEQ ID NO: 4411 - DNA, 201 bp, Homo sapiens
tcagccaaagaaacaagccgtggaataggtgtatcaagtaatggtgcaaagcctgaactgtcggaaaaggtaacagaagatggaactcgaaatcccaatgraaaacctacccagcaaagaagcatagcttttagctctaataattctgtagcaaagccaatacaaaaatcagctaaagctgccacagaagaggcatcttca

SEQ ID NO: 4412 - DNA, 201 bp, Homo sapiens; identical to SEQ ID NO: 4406

SEQ ID NO: 4413 - DNA, 201 bp, Homo sapiens; identical to SEQ ID NO: 4402

SEQ ID NO: 4414 - DNA, 201 bp, Homo sapiens; identical to SEQ ID NO: 4409

SEQ ID NO: 4415 - DNA, 201 bp, Homo sapiens
atcctttccggagaaagcgcaggctaaagccgcaggtgaagatgtccaactacgtgaacgacatgtggccgggctcgccgcaggagaaggattcgccctckacctcgcggtcgggcgggtccagccggctgtcgtcgcggtctaggagccgctctttttccagaagctctcggtcccattcccgcgtctcgagccggtttt

SEQ ID NO: 4416 - DNA, 201 bp, Homo sapiens; identical to SEQ ID NO: 4411

SEQ ID NO: 4417 - DNA, 201 bp, Homo sapiens; identical to SEQ ID NO: 4406

SEQ ID NO: 4418 - DNA, 201 bp, Homo sapiens; identical to SEQ ID NO: 4402

SEQ ID NO: 4419 - DNA, 201 bp, Homo sapiens
tcctgagttgaggcttgcgggatcctttccggagaaagcgcaggctaaagccgcaggtgaagatgtccaactacgtgaacgacatgtggccgggctcgcckcaggagaaggattcgccctcgacctcgcggtcgggcgggtccagccggctgtcgtcgcggtctaggagccgctctttttccagaagctctcggtcccatt

SEQ ID NO: 4420 - DNA, 201 bp, Homo sapiens; identical to SEQ ID NO: 4405

SEQ ID NO: 4421 - DNA, 201 bp, Homo sapiens; identical to SEQ ID NO: 4411

SEQ ID NO: 4422 - DNA, 201 bp, Homo sapiens; identical to SEQ ID NO: 4406

SEQ ID NO: 4423 - DNA, 201 bp, Homo sapiens; identical to SEQ ID NO: 4402

SEQ ID NO: 4424 - DNA, 201 bp, Homo sapiens; identical to SEQ ID NO: 4409

SEQ ID NO: 4425 - DNA, 201 bp, Homo sapiens
atcaagatactggtgattcaaggaattttatttatggtccagccaagagccatctcgtgccaagacttctgctggcaagggaatggataaagctgttttgktctagtaacaattttggaatgaatactgacaatattccatgagggtgtgcaagcacaaattttaccaatctgacctctttgaagttgcagaatgctttga

SEQ ID NO: 4426 - DNA, 201 bp, Homo sapiens
atggtgagctcaggtactccttgagcagctacacgtcggaccgggagaggcagctcttcagcatagatgccagtaccggggaagtgcgagtaattgggggyctggattatgaggaagcctcctcctaccagatctatgtgcaggcgactgaccggggtccagtgcccatggcaggtcactgcaaggtgctggtggacatcg

SEQ ID NO: 4427 - DNA, 201 bp, Homo sapiens
tgacttgtcttggtgtgctagcctacaccttctctttggtttagttttccttttctataacactctgaattgctaatcttactaacacctatgatgttacrtgaaatcaatctcccatatgtatgctgtatgctatgctaagactcctgaaatatacttactctgtgcttgtgtatgtgaatgttaatgcaactattacct

SEQ ID NO: 4428 - DNA, 201 bp, Homo sapiens
tgagcgccgttgaggtggaaatattggacatcaacgacaactcaccgcgtttcccgcggcccaactaccagcttcaggtaagcgaatcggtggcgcctggygcgcgctttcacatagagagtgcgcaggaccccgacgtgggcgccaactcagtacagacctacgagctcagccccagcgagcacttcgagctggacctta

SEQ ID NO: 4429 - DNA, 201 bp, Homo sapiens
ggccagtggctatggagcaggcgggcaccagacctgcggcgacagagcatccacggctccggcggcccatgccctggctgctgctactgcctctcctgctwctgttgctgctgctgctacctggccctgcggcctcccagctgcgatactctgtgccagaggagcaggcacccggcgcgctcgtgggcaacgtggctcgcg

SEQ ID NO: 4430 - DNA, 201 bp, Homo sapiens
gatctgatgtgtttcctatacatgtcctgtgctcactttattaaaaattcttttgcacacaatgtttatgaaaaggccagatccttttccaatacttatgkaaaagcaaaagaaaaccccgacacctcacctttcgctgtttgttgtttcatagatttatttaaaaaaagagaaagtctatagctataaatctttaaagag

SEQ ID NO: 4431 - DNA, 201 bp, Homo sapiens
attttgagcatcatcaagtgctaccgctacactgcgtatggcactgcatgctgtggaggcttctgtggagtaagggaaaggtcccctgcagaactgtacamacaagccaacaacaatattgatgccaggataccgcatggcctcaaagtgcagcctcacttcattgaagttcgagggaatggctccctcaccaagacctac

SEQ ID NO: 4432 - DNA, 201 bp, Homo sapiens
tccggcggcccatgccctggctgctgctactgcctctcctgctgctgttgctgctgctgctacctggccctgcggcctcccagctgcgatactctgtgccygaggagcaggcacccggcgcgctcgtgggcaacgtggctcgcgcgctggggcttgagctgcggcgcttggggccgggttgcttgcgcatcaaccatctgg

SEQ ID NO: 4433 - DNA, 201 bp, Homo sapiens
gtccgccacttcggcgcggaatcagagcaggacttgctgagccctcctaccgctccctttccccctccccctctgtcttcccttctgtttccttttccctycccctggagctgtagcggcagcagcagcaggaagccgagccgggttgagcgactcggaggcgagcggaggagctggaatatggggagtcagcgaggacgg

SEQ ID NO: 4434 - DNA, 201 bp, Homo sapiens
gcctgtctgacagcaggctcagggagtgacactttcatgttttacaatacaggggcccagacaggaccagggccttcgggagcccaagcagcagtgactgrcagcaggaatctcacaggccaaagtggtcagaatgctgggaacctgattattctcaaaaatgaggctgtttctcaaaatgagccacgacagcccaaccct

SEQ ID NO: 4435 - DNA, 201 bp, Homo sapiens
tgcccggctgcctccgccgcggccagtggctatggagcaggcgggcaccagacctgcggcgacagagcatccacggctccggcggcccatgccctggctgstgctactgcctctcctgctgctgttgctgctgctgctacctggccctgcggcctcccagctgcgatactctgtgccagaggagcaggcacccggcgcgct

SEQ ID NO: 4436 - DNA, 201 bp, Homo sapiens
aggcgctttctagagcgtgagcggtgggggagcaggcgcagggtggcacgagcggaggcggggcccgggcgtggggcacggctggggaagctgccgcctcsggccctgcccggctgcctccgccgcggccagtggctatggagcaggcgggcaccagacctgcggcgacagagcatccacggctccggcggcccatgccct

SEQ ID NO: 4437 - DNA, 201 bp, Homo sapiens
aagacccgttaagcaggggagagacggtggagactggatgaactggacagtgggggtagggagaaagggagtggccgtgttcctgcggtccgctgggatcwggcaggtccagggtgaaggagatggggctggagaggctgagcagtccgggttcgctgtccgccacttcggcgcggaatcagagcaggacttgctgagccc

SEQ ID NO: 4438 - DNA, 145 bp, Homo sapiens
cagactaatctccttaaagacccgttaagcaggggagagacggtrgagactggatgaactggacagtgggggtagggagaaagggagtggccgtgttcctgcggtccgctgggatccggcaggtccagggtgaaggagatggggc

SEQ ID NO: 4439 - DNA, 201 bp, Homo sapiens
cctaccgctccctttccccctccccctctgtcttcccttctgtttccttttccctccccctggagctgtagcggcagcagcagcaggaagccgagccgggmtgagcgactcggaggcgagcggaggagctggaatatggggagtcagcgaggacggtggggccaggagcccttgggagggcctacggagggagcggcccca

SEQ ID NO: 4440 - DNA, 201 bp, Homo sapiens
tcacctcctatgtctccattaacagtgccagtggcagcctttatgctgtcaactcctttgactatgagaagtttcgggagttctttgtgactgtggaggcrcaggacaaggggagcccaccactgagcagcactgtgactgccaacgtatatgtggtggacatgaatgaccatgcccctcacattctgtaccctacctcaa

SEQ ID NO: 4441 - DNA, 201 bp, Homo sapiens
tttccttttccctccccctggagctgtagcggcagcagcagcaggaagccgagccgggttgagcgactcggaggcgagcggaggagctggaatatggggaytcagcgaggacggtggggccaggagcccttgggagggcctacggagggagcggccccaggcgctttctagagcgtgagcggtgggggagcaggcgcaggg

SEQ ID NO: 4442 - DNA, 201 bp, Homo sapiens
tcacggtgtctgcgcgagacgcggacgcgcaggagaacgcgctggtgtcctactcgcttgtggagcggcgggtgggcgagcgctcgctgtcgagctacatktcggtgcacacggagagcggcaaggtgtacgcgctgcagccgctggaccacgaggagctagagctgctgcagttccaggtgagcgcgcgcgacgcgggcg

SEQ ID NO: 4443 - DNA, 201 bp, Homo sapiens
cttcacggtgtctgcgcgagacgcggacgcgcaggagaacgcgctggtgtcctactcgcttgtggagcggcgggtgggcgagcgctcgctgtcgagctacrtttcggtgcacacggagagcggcaaggtgtacgcgctgcagccgctggaccacgaggagctagagctgctgcagttccaggtgagcgcgcgcgacgcggg

SEQ ID NO: 4444 - DNA, 201 bp, Homo sapiens
ggagaacgcgctggtgtcctactcgcttgtggagcggcgggtgggcgagcgctcgctgtcgagctacatttcggtgcacacggagagcggcaaggtgtackcgctgcagccgctggaccacgaggagctagagctgctgcagttccaggtgagcgcgcgcgacgcgggcgtgccgcctctgggcagcaacgtgacgctgca

SEQ ID NO: 4445 - DNA, 201 bp, Homo sapiens
cggtgttcgtgaaggagaacaacccgccgggctgccacatcttcacggtgtctgcgcgagacgcggacgcgcaggagaacgcgctggtgtcctactcgctkgtggagcggcgggtgggcgagcgctcgctgtcgagctacatttcggtgcacacggagagcggcaaggtgtacgcgctgcagccgctggaccacgaggagc

SEQ ID NO: 4446 - DNA, 201 bp, Homo sapiens
cagtggacgccgactcgggctacaacgcgtggctttcgtatgagctgcagccagctgcaagcagccctcgcatcccgttccgcgtggggctgtacacgggmgagatcagcaccactcgtgtcctggacgaagcggactctccgcgccaccgtctgctggtcctggtgaaggatcatggtgaacctgcgctgaccgccacgg

SEQ ID NO: 4447 - DNA, 201 bp, Homo sapiens
tggccgacgtgaacgacaatgctccggcgttcgcgcagcccgagtacacggtgttcgtgaaggagaacaacccgccgggctgccacatcttcacggtgtcwgcgcgagacgcggacgcgcaggagaacgcgctggtgtcctactcgcttgtggagcggcgggtgggcgagcgctcgctgtcgagctacatttcggtgcaca

SEQ ID NO: 4448 - DNA, 201 bp, Homo sapiens
acttgtcttggtgtgctagcctacaccttctctttggtttagttttccttttctataacactctgaattgctaatcttactaacacctatgatgttacctkaaatcaatctcccatatgtatgctgtatgctatgctaagactcctgaaatatacttactctgtgcttgtgtatgtgaatgttaatgcaactattacctag

SEQ ID NO: 4449 - DNA, 201 bp, Homo sapiens
gtgcacacggagagcggcaaggtgtacgcgctgcagccgctggaccacgaggagctagagctgctgcagttccaggtgagcgcgcgcgacgcgggcgtgcmgcctctgggcagcaacgtgacgctgcaggtgttcgtgctggacgagaatgacaacgcgccggcactgctggagcctcgggtgggtggcactggtggcgca

SEQ ID NO: 4450 - DNA, 201 bp, Homo sapiens
agcaagctggtgccgcggtctgtgggcgcgggccacgtggtagcgaaggtgcgcgcagtggacgccgactcgggctacaacgcgtggctttcgtatgagcwgcagccagctgcaagcagccctcgcatcccgttccgcgtggggctgtacacgggcgagatcagcaccactcgtgtcctggacgaagcggactctccgcgc

SEQ ID NO: 4451 - DNA, 201 bp, Homo sapiens
tggagcggcgggtgggcgagcgctcgctgtcgagctacatttcggtgcacacggagagcggcaaggtgtacgcgctgcagccgctggaccacgaggagctrgagctgctgcagttccaggtgagcgcgcgcgacgcgggcgtgccgcctctgggcagcaacgtgacgctgcaggtgttcgtgctggacgagaatgacaacg

SEQ ID NO: 4452 - DNA, 201 bp, Homo sapiens
gggctgccacatcttcacggtgtctgcgcgagacgcggacgcgcaggagaacgcgctggtgtcctactcgcttgtggagcggcgggtgggcgagcgctcgytgtcgagctacatttcggtgcacacggagagcggcaaggtgtacgcgctgcagccgctggaccacgaggagctagagctgctgcagttccaggtgagcgc

SEQ ID NO: 4453 - DNA, 201 bp, Homo sapiens
gccgggctgccacatcttcacggtgtctgcgcgagacgcggacgcgcaggagaacgcgctggtgtcctactcgcttgtggagcggcgggtgggcgagcgckcgctgtcgagctacatttcggtgcacacggagagcggcaaggtgtacgcgctgcagccgctggaccacgaggagctagagctgctgcagttccaggtgag

SEQ ID NO: 4454 - DNA, 201 bp, Homo sapiens
ctttcgtatgagctgcagccagctgcaagcagccctcgcatcccgttccgcgtggggctgtacacgggcgagatcagcaccactcgtgtcctggacgaagyggactctccgcgccaccgtctgctggtcctggtgaaggatcatggtgaacctgcgctgaccgccacggccacggttctggtgtcgctggtggagagcggc

SEQ ID NO: 4455 - DNA, 201 bp, Homo sapiens
tggagcctcgggtgggtggcactggtggcgcagcgagcaagctggtgccgcggtctgtgggcgcgggccacgtggtagcgaaggtgcgcgcagtggacgcsgactcgggctacaacgcgtggctttcgtatgagctgcagccagctgcaagcagccctcgcatcccgttccgcgtggggctgtacacgggcgagatcagca

SEQ ID NO: 4456 - DNA, 201 bp, Homo sapiens
tgccttttgaactaggagaatcgggctaatttattaatgatgataattataatgtatctgtacagcactttttacatttgcgaagtgctttccaatccatkttagttactagttattacagctgtaaggataaaacacgtcatgtggattcattttgaattggtgctattggtatttcctctgttattgctaataaatgaa

SEQ ID NO: 4457 - DNA, 201 bp, Homo sapiens
aggagctagagctgctgcagttccaggtgagcgcgcgcgacgcgggcgtgccgcctctgggcagcaacgtgacgctgcaggtgttcgtgctggacgagaaygacaacgcgccggcactgctggagcctcgggtgggtggcactggtggcgcagcgagcaagctggtgccgcggtctgtgggcgcgggccacgtggtagcga

SEQ ID NO: 4458 - DNA, 201 bp, Homo sapiens
tccactactccgtccccgaggaggccaaacacggcaccttcgtgggccggatcgcgcaggacctggggctggagctggcggagctggtgccgcgcctgttscgggtggcgtccaaaagacaccgggaccttctggaggtaaatctgcagaatggcattttgtttgtgaattctcggatcgaccgcgaggagctgtgcgggc

SEQ ID NO: 4459 - DNA, 201 bp, Homo sapiens
atctgaaatatcagctcatagaaagtaacaaaatttgctgtcaccttaaataagacattttaattttgttataatgtacaatttagaagtttgattaattrtattatctatttaggcattaatataaaagaggtaggagtctgttatttaaaaaaagcattaaatttaaaaaaaaactgtcttgtctacttttagcttcat

SEQ ID NO: 4460 - DNA, 201 bp, Homo sapiens
acgtgaacgacaatgctccggcgttcgcgcagcccgagtacacggtgttcgtgaaggagaacaacccgccgggctgccacatcttcacggtgtctgcgcgrgacgcggacgcgcaggagaacgcgctggtgtcctactcgcttgtggagcggcgggtgggcgagcgctcgctgtcgagctacatttcggtgcacacggaga

SEQ ID NO: 4461 - DNA, 201 bp, Homo sapiens
tgttggagctaactccgtgttaacctacaggcttagctctcatgattacttcatgctagatgtgaattcaaagaacgatgagaataaactggttgagctcktattaagaaaatccttggacagagaggacgctcctgcgcaccacttattcctgacagccacagatgggggcaaacctgagctcacaggcactgttcagct

SEQ ID NO: 4462 - DNA, 201 bp, Homo sapiens
tgaacgacaatgctccggcgttcgcgcagcccgagtacacggtgttcgtgaaggagaacaacccgccgggctgccacatcttcacggtgtctgcgcgagaygcggacgcgcaggagaacgcgctggtgtcctactcgcttgtggagcggcgggtgggcgagcgctcgctgtcgagctacatttcggtgcacacggagagcg

SEQ ID NO: 4463 - DNA, 128 bp, Homo sapiens
atggattatcactggcgaggagagctgrgatcctggcgactactactcttgcttctgctcctcgcagcctggaaggtggggagcggccagctccactactccgtccccgaggaggccaaacacggcac

SEQ ID NO: 4464 - DNA, 201 bp, Homo sapiens
cgacgtgaacgacaatgctccggcgttcgcgcagcccgagtacacggtgttcgtgaaggagaacaacccgccgggctgccacatcttcacggtgtctgcgygagacgcggacgcgcaggagaacgcgctggtgtcctactcgcttgtggagcggcgggtgggcgagcgctcgctgtcgagctacatttcggtgcacacgga

SEQ ID NO: 4465 - DNA, 201 bp, Homo sapiens
gggcagcaacgtgacgctgcaggtgttcgtgctggacgagaatgacaacgcgccggcactgctggagcctcgggtgggtggcactggtggcgcagcgagcragctggtgccgcggtctgtgggcgcgggccacgtggtagcgaaggtgcgcgcagtggacgccgactcgggctacaacgcgtggctttcgtatgagctgca

SEQ ID NO: 4466 - DNA, 201 bp, Homo sapiens
tacgtgaagacgctcaatttggtactgtcatcgccctaattagcgtgaacgacctcgattcaggtgccaacgggcaggtgacctgctccctgatgccccaygtccccttcaagctggtgtccaccttcaagaattactactcgttggtgctggacagcgccctggaccgcgagagcgtgtcggcctatgagttggtggtaa

SEQ ID NO: 4467 - DNA, 201 bp, Homo sapiens
tatccttgcctgtacgtgaagacgctcaatttggtactgtcatcgccctaattagcgtgaacgacctcgattcaggtgccaacgggcaggtgacctgctcsctgatgccccatgtccccttcaagctggtgtccaccttcaagaattactactcgttggtgctggacagcgccctggaccgcgagagcgtgtcggcctatg

SEQ ID NO: 4468 - DNA, 201 bp, Homo sapiens
tgaccgccacggccacggttctggtgtcgctggtggagagcggccaggctccaaaagcgtcatcgaggcagtcggctggcgttttgggtccggaagcggcrctggtggatgtcaacgtgtacctgatcatcgccatctgcgcggtatccagcctgctggtgctcacgctgctgctgtacactgcgctgcggtgctcagcac

SEQ ID NO: 4469 - DNA, 201 bp, Homo sapiens
acttccttatccttgcctgtacgtgaagacgctcaatttggtactgtcatcgccctaattagcgtgaacgacctcgattcaggtgccaacgggcaggtgamctgctccctgatgccccatgtccccttcaagctggtgtccaccttcaagaattactactcgttggtgctggacagcgccctggaccgcgagagcgtgtcg

SEQ ID NO: 4470 - DNA, 201 bp, Homo sapiens
aatgataatgctcccactttcgaacagtctgaatacgaagtaagaatattcgaaaacgcagacaacggaacaacagttatcaaactgaatgcttctgatcsggatgaaggagccaatggggcaatttcatattcttttaatagccttgttgaaactatggttattgaccactttagcatagatcgaaatacgggagaaata

SEQ ID NO: 4471 - DNA, 201 bp, Homo sapiens
gtcacagtgctggatgtgaatgataatgctcccactttcgaacagtctgaatacgaagtaagaatattcgaaaacgcagacaacggaacaacagttatcaractgaatgcttctgatccggatgaaggagccaatggggcaatttcatattcttttaatagccttgttgaaactatggttattgaccactttagcatagat

SEQ ID NO: 4472 - DNA, 201 bp, Homo sapiens
gtgggccggatcgcgcaggacctggggctggagctggcggagctggtgccgcgcctgttccgggtggcgtccaaaagacaccgggaccttctggaggtaartctgcagaatggcattttgtttgtgaattctcggatcgaccgcgaggagctgtgcgggcggagcgcggagtgcagcatccacctggaggtgatcgtggac

SEQ ID NO: 4473 - DNA, 201 bp, Homo sapiens
gaagtgtcccctccagtcggtgcgggtgtcaacagcaacagctggacctttaaatacggaccaggcaaccccaaacaatccggtcccggtgagttgcccgmcaaattcattatcccaggatctcctgcaatcatctccatccggcaggagcctactaacagccaaattgacaaaagtgacttcataaccttcggcaaaaag

SEQ ID NO: 4474 - DNA, 201 bp, Homo sapiens
aagaaaaagaagaaaaagaagaagggtaacaagacccaggagaaaaaagagaaagggaacagcacgactgacaacagtgaccagtgaggtcctcaaatggraacaagccacttagccagtttttgtaataatggcaaatctctcccatgtagcaattccctgctcctttttcctatctacatgagccctcttagagacctc

SEQ ID NO: 4475 - DNA, 201 bp, Homo sapiens
gccagtgttccgggtaaaagaccaaaagctgtttgtttcagaatccagaatgccagactctcggtttccgctagagggcgcgtccgatgcagatgttggakctaactccgtgttaacctacaggcttagctctcatgattacttcatgctagatgtgaattcaaagaacgatgagaataaactggttgagctcgtattaag

SEQ ID NO: 4476 - DNA, 201 bp, Homo sapiens
tgcgcgagacgcggacgcgcaggagaacgcgctggtgtcctactcgcttgtggagcggcgggtgggcgagcgctcgctgtcgagctacatttcggtgcacrcggagagcggcaaggtgtacgcgctgcagccgctggaccacgaggagctagagctgctgcagttccaggtgagcgcgcgcgacgcgggcgtgccgcctct

SEQ ID NO: 4477 - DNA, 201 bp, Homo sapiens
gcgggcgtgccgcctctgggcagcaacgtgacgctgcaggtgttcgtgctggacgagaatgacaacgcgccggcactgctggagcctcgggtgggtggcaytggtggcgcagcgagcaagctggtgccgcggtctgtgggcgcgggccacgtggtagcgaaggtgcgcgcagtggacgccgactcgggctacaacgcgtgg

SEQ ID NO: 4478 - DNA, 201 bp, Homo sapiens
gcagccctcgcatcccgttccgcgtggggctgtacacgggcgagatcagcaccactcgtgtcctggacgaagcggactctccgcgccaccgtctgctggtsctggtgaaggatcatggtgaacctgcgctgaccgccacggccacggttctggtgtcgctggtggagagcggccaggctccaaaagcgtcatcgaggcagt

SEQ ID NO: 4479 - DNA, 201 bp, Homo sapiens
tgggtccggaagcggcgctggtggatgtcaacgtgtacctgatcatcgccatctgcgcggtatccagcctgctggtgctcacgctgctgctgtacactgckctgcggtgctcagcactgcccactgagggcgggtgccgggcgggcaagcccactctggtgtgctccagtgcggtggggagctggtcatactcgcaacaac

SEQ ID NO: 4480 - DNA, 201 bp, Homo sapiens
gtggggatcttctggaggtaaatctgcagaatggcattttgtttgtgaattctcggatcgaccgcgaggagctgtgcgggcggagcgcggagtgcagcatrcacctggaggtgatcgtggaaaggccgctgcaggttttccatgtggacgtggaggtgaaggacattaacgacaaccctccggtgttcccagcgacacaaa

SEQ ID NO: 4481 - DNA, 201 bp, Homo sapiens
ccgggcggtgtgcaaattccgtggggatcttctggaggtaaatctgcagaatggcattttgtttgtgaattctcggatcgaccgcgaggagctgtgcgggrggagcgcggagtgcagcatccacctggaggtgatcgtggaaaggccgctgcaggttttccatgtggacgtggaggtgaaggacattaacgacaaccctcc

SEQ ID NO: 4482 - DNA, 201 bp, Homo sapiens
gcgcagcccgagtatacggtgttcgtgaaggagaacaacccgccgggctgccacatcttcactgtgtcggcgggggacgcggacgcgcagaagaacgcgcyggtgtcctactcgctggtggagctgcgggtgggcgagcgcgcgctgtcgagctacgtgtcagtgcacgcggagagcggcaaggtgtacgcgctgcagccg

SEQ ID NO: 4483 - DNA, 201 bp, Homo sapiens
ggaccacggggagccctcgctgacagccacagccaccgtgctggtgtcgctggtggaaagcggccaggcaccaaaggcgtcgtcgcgggcatcgttgggcrttgcaggcccagagaccgagctggtggatgtcaacgtgtacctgatcatcgccatctgcgcggtgtccagtctgttggtgcttaccctgctgctgtacac

SEQ ID NO: 4484 - DNA, 201 bp, Homo sapiens
tccggagcttcatttattgctcacggccaccgatggaggcaaacccgagctgactggcaccgttcaattactcatcacggtactggacaacaatgacaatyccccagtgttcgacagaaccctgtatacggtgaaattaccagaaaacgtttctatcggaacgctggtgattcaccccaatgcctcagatttagacgaagg

SEQ ID NO: 4485 - DNA, 201 bp, Homo sapiens
gatattatttactccttctccagtgatgtttctccagatataaaatccaagttccacatggaccccttaagtggggcaatcacagtgataggacatatggrttttgaagaaagtagagcacacaagatcccagtcgaggctgtcgataaaggcttcccacccctggctggtcattgtacagttcttgtggaagttgtggat

SEQ ID NO: 4486 - DNA, 201 bp, Homo sapiens
gggctgtacactggtgagatcagcacgacacgagccctagatgagacggacgcaccgcgccaccgccttctggtgcttgtgaaggaccacggggagccctrgctgacagccacagccaccgtgctggtgtcgctggtggaaagcggccaggcaccaaaggcgtcgtcgcgggcatcgttgggcattgcaggcccagagacc

SEQ ID NO: 4487 - DNA, 201 bp, Homo sapiens
cagttgacgctgactcaggctacaacgcgtggctttcgtatgagttgcaaccggtggcggccggtgcgagcatcccgttccgcgtggggctgtacactggsgagatcagcacgacacgagccctagatgagacggacgcaccgcgccaccgccttctggtgcttgtgaaggaccacggggagccctcgctgacagccacag

SEQ ID NO: 4488 - DNA, 201 bp, Homo sapiens
cggagctggtgccgcgcctgttccgggcggtgtgcaaattccgtggggatcttctggaggtaaatctgcagaatggcattttgtttgtgaattctcggatrgaccgcgaggagctgtgcgggcggagcgcggagtgcagcatccacctggaggtgatcgtggaaaggccgctgcaggttttccatgtggacgtggaggtga

SEQ ID NO: 4489 - DNA, 201 bp, Homo sapiens
cttcgtgggccgcatcgcgcaggacctggggctggagctggcggagctggtgccgcgcctgttccgggcggtgtgcaaattccgtggggatcttctggagrtaaatctgcagaatggcattttgtttgtgaattctcggatcgaccgcgaggagctgtgcgggcggagcgcggagtgcagcatccacctggaggtgatcgt

SEQ ID NO: 4490 - DNA, 201 bp, Homo sapiens
cagctccactactcggtccccgaggaggctaaacatggcaacttcgtgggccgcatcgcgcaggacctggggctggagctggcggagctggtgccgcgccsgttccgggcggtgtgcaaattccgtggggatcttctggaggtaaatctgcagaatggcattttgtttgtgaattctcggatcgaccgcgaggagctgtgc

SEQ ID NO: 4491 - DNA, 201 bp, Homo sapiens
tagcagcttgggaggcagggagaggccagctccactactcggtccccgaggaggctaaacatggcaacttcgtgggccgcatcgcgcaggacctggggctsgagctggcggagctggtgccgcgcctgttccgggcggtgtgcaaattccgtggggatcttctggaggtaaatctgcagaatggcattttgtttgtgaatt

SEQ ID NO: 4492 - DNA, 201 bp, Homo sapiens
cagatgccaacgggcaggttacctgctccctgacgccccacgtccccttcaagctggtgtccacctacaagaattactactcgttggtgctggacagagcyctggaccgcgagagtgtgtccgcctacgagctggtggttaccgcgcgggaccggggctcgccttcactgtgggccacggccagggtgtctgtggaggtgg

SEQ ID NO: 4493 - DNA, 201 bp, Homo sapiens
aggagatccagagggtcagcctctactgctctcgcttctgatcctcgcaatgtgggtggtggggagcggccagctccactactccgtcccggaggaagccraacacggcaccttcgtgggccgcatcgcgcaggacctggggctggagctggcggagctggtgccgcgcctgttccagttggattccaaaggccgcgggga

SEQ ID NO: 4494 - DNA, 201 bp, Homo sapiens
gagtgcgcgcctggcaagccgacgctggtgtgttctagcgcggtggggagttggtcgtactcgcagcagaggaggcagagggtgtgctctggcgagggtcmgcagaagaccgacctcatggccttcagcccgggcctttctccttgtgctggatctacagagcgaacgggagaaccctctgcttcctcagattcaactggg

SEQ ID NO: 4495 - DNA, 201 bp, Homo sapiens
gctggtgtccacctacaagaattactactcgttggtgctggacagagctctggaccgcgagagtgtgtccgcctacgagctggtggttaccgcgcgggacsggggctcgccttcactgtgggccacggccagggtgtctgtggaggtggccgacgtgaacgacaacgcaccagcgttcgcgcagtccgagtacacggtgtt

SEQ ID NO: 4496 - DNA, 201 bp, Homo sapiens
acgacaacgcaccagcgttcgcgcagtccgagtacacggtgttcgtgaaggagaacaacccgccgggctgccacatcttcacggtgtctgcgcgggacgckgacgcgcaggagaacgccctggtgtcctactcgctggtggagcggcggttgggcgagcgctcgctgtcgagctacgtgtcagtgcacgcggagagcggca

SEQ ID NO: 4497 - DNA, 201 bp, Homo sapiens
ccctgacgccccacgtccccttcaagctggtgtccacctacaagaattactactcgttggtgctggacagagctctggaccgcgagagtgtgtccgcctaygagctggtggttaccgcgcgggaccggggctcgccttcactgtgggccacggccagggtgtctgtggaggtggccgacgtgaacgacaacgcaccagcgt

SEQ ID NO: 4498 - DNA, 201 bp, Homo sapiens
caagctctcatcatatgcaaattctcagaagggctgtgaacaccttagtaataaatttatcttttgaggtcattagcaaacatgaactcacagggatccasagatggtaaaattcaaaacagcctgtcaagttcaaaacagagaggtgaaagcagaagagacactttcctattttgcctaataggtctccttatatgcatc

SEQ ID NO: 4499 - DNA, 201 bp, Homo sapiens
cgaacgggagaaccctctgcttcctcagattcaactgggaaggtgggtttttctagcattttatttatttatataattttttttcttgaaagatattatcrattactcccaggggccgttcaaatagttttattcatttttctagaaatccagcagattttttttctgataaagtaaaccccttaacattggagccgactt

SEQ ID NO: 4500 - DNA, 201 bp, Homo sapiens
gacgtgccaaccagcaaccagcaggtaaaacctcttggacttgtattacggaaacttttagacagagaagaaactccggagcttcatttattgctcacggycaccgatggaggcaaacccgagctgactggcaccgttcaattactcatcacggtactggacaacaatgacaatgccccagtgttcgacagaaccctgtat

SEQ ID NO: 4501 - DNA, 201 bp, Homo sapiens
gcgatgttctctctgaatccagacaaatacagcccttttcccatgggaaagaggctcaattctttttcactctctctgtgctgaacgatggcgaacacagmagaatgggactgacgaaatcagatgatttcttctaatttggaggcaattttcactaattagaagaagactgagtatttgaaatgttatactcaagtcgag

SEQ ID NO: 4502 - DNA, 201 bp, Homo sapiens
tctttgccgcgatgttctctctgaatccagacaaatacagcccttttcccatgggaaagaggctcaattctttttcactctctctgtgctgaacgatggckaacacagcagaatgggactgacgaaatcagatgatttcttctaatttggaggcaattttcactaattagaagaagactgagtatttgaaatgttatactc

SEQ ID NO: 4503 - DNA, 201 bp, Homo sapiens
ttgggccacgtgatgtcactctttgccgcgatgttctctctgaatccagacaaatacagcccttttcccatgggaaagaggctcaattctttttcactctytctgtgctgaacgatggcgaacacagcagaatgggactgacgaaatcagatgatttcttctaatttggaggcaattttcactaattagaagaagactgag

SEQ ID NO: 4504 - DNA, 201 bp, Homo sapiens
gaaaaaattaagaaaatgaaataagttttgcagaataactgtgaaatttttattcatgaaatatgtacttacactttgggccacgtgatgtcactctttgscgcgatgttctctctgaatccagacaaatacagcccttttcccatgggaaagaggctcaattctttttcactctctctgtgctgaacgatggcgaacaca

SEQ ID NO: 4505 - DNA, 201 bp, Homo sapiens
tgttatactcaagtcgaggagatccagagggtcagcctctactgctctcgcttctgatcctcgcaatgtgggtggtggggagcggccagctccactactcsgtcccggaggaagccgaacacggcaccttcgtgggccgcatcgcgcaggacctggggctggagctggcggagctggtgccgcgcctgttccagttggatt

SEQ ID NO: 4506 - DNA, 201 bp, Homo sapiens
ctccggagcttcatttattgctcacggccaccgatggaggcaaacccgagctgactggcaccgttcaattactcatcacggtactggacaacaatgacaaygccccagtgttcgacagaaccctgtatacggtgaaattaccagaaaacgtttctatcggaacgctggtgattcaccccaatgcctcagatttagacgaag

SEQ ID NO: 4507 - DNA, 201 bp, Homo sapiens
tgactgaaattttgtctacacttagaacattttttgaaattcagtttacagaaattggagaaaatgctttttaaacaagtgtttcctttcttcaagaagayattctccttttaattgaaattttctccattcagtgataaaatgatcagccatgtgaagattcgaaacttcgagttcttttgaaattcagagtctgtaact

SEQ ID NO: 4508 - DNA, 201 bp, Homo sapiens
taaatctgcagaatggcattttgtttgtgaattctcggatcgaccgcgaggagctgtgcgggcggagcgcggagtgcagcatccacctggaggtgatcgtrgacaggccgctgcaggttttccatgtggacgtggaggtgaaggacattaacgacaaccctccagtgttcccagcgacacaaaagaatctgttcatcgcgg

SEQ ID NO: 4509 - DNA, 201 bp, Homo sapiens
tcaaaacgctctcggttcctgtaaaagaggacgcacaactggggacagttattgccctgattagtgtgatcgacctagacgcagatgccaacgggcaggtkacctgctccctgacgccccacgtccccttcaagctggtgtccacctacaagaattactactcgttggtgctggacagagctctggaccgcgagagtgtgt

SEQ ID NO: 4510 - DNA, 201 bp, Homo sapiens
gagggtcagcctctactgctctcgcttctgatcctcgcaatgtgggtggtggggagcggccagctccactactccgtcccggaggaagccgaacacggcamcttcgtgggccgcatcgcgcaggacctggggctggagctggcggagctggtgccgcgcctgttccagttggattccaaaggccgcggggaccttctggag

SEQ ID NO: 4511 - DNA, 201 bp, Homo sapiens
ctacacttagaacattttttgaaattcagtttacagaaattggagaaaatgctttttaaacaagtgtttcctttcttcaagaagacattctccttttaatygaaattttctccattcagtgataaaatgatcagccatgtgaagattcgaaacttcgagttcttttgaaattcagagtctgtaacttaaaacattaccctt

SEQ ID NO: 4512 - DNA, 120 bp, Homo sapiens
tagtcccaattactcaggaggctgaggcgagagaatcgcttgagcctgggacattgaggctgcagtgaactgtgatggcacaactgcatttcagcccgggwgacagcaagattctgtctc

SEQ ID NO: 4513 - DNA, 201 bp, Homo sapiens
aagactgagtatttgaaatgttatactcaagtcgaggagatccagagggtcagcctctactgctctcgcttctgatcctcgcaatgtgggtggtggggagmggccagctccactactccgtcccggaggaagccgaacacggcaccttcgtgggccgcatcgcgcaggacctggggctggagctggcggagctggtgccgc

SEQ ID NO: 4514 - DNA, 201 bp, Homo sapiens
atccagagggtcagcctctactgctctcgcttctgatcctcgcaatgtgggtggtggggagcggccagctccactactccgtcccggaggaagccgaacayggcaccttcgtgggccgcatcgcgcaggacctggggctggagctggcggagctggtgccgcgcctgttccagttggattccaaaggccgcggggaccttc

SEQ ID NO: 4515 - DNA, 201 bp, Homo sapiens
gtcgaggagatccagagggtcagcctctactgctctcgcttctgatcctcgcaatgtgggtggtggggagcggccagctccactactccgtcccggaggargccgaacacggcaccttcgtgggccgcatcgcgcaggacctggggctggagctggcggagctggtgccgcgcctgttccagttggattccaaaggccgcg

SEQ ID NO: 4516 - DNA, 201 bp, Homo sapiens
cgagtgcgcgcctggcaagccgacgctggtgtgttctagcgcggtggggagttggtcgtactcgcagcagaggaggcagagggtgtgctctggcgagggtmcgcagaagaccgacctcatggccttcagcccgggcctttctccttgtgctggatctacagagcgaacgggagaaccctctgcttcctcagattcaactgg

SEQ ID NO: 4517 - DNA, 201 bp, Homo sapiens
gtttcaacaatcattacttaagaaaaaattaagaaaatgaaataagttttgcagaataactgtgaaatttttattcatgaaatatgtacttacactttggrccacgtgatgtcactctttgccgcgatgttctctctgaatccagacaaatacagcccttttcccatgggaaagaggctcaattctttttcactctctctg

SEQ ID NO: 4518 - DNA, 201 bp, Homo sapiens
caacccgccgggctgccacatcttcacggtgtctgcgcgggacgctgacgcgcaggagaacgccctggtgtcctactcgctggtggagcggcggttgggcsagcgctcgctgtcgagctacgtgtcagtgcacgcggagagcggcaaggtgtacgcgctgcagccgttggaccacgaggagctggagctgctacagttcca

SEQ ID NO: 4519 - DNA, 201 bp, Homo sapiens
ggagcgcggagtgcagcatccacctggaggtgatcgtagacaggccgctgcaggttttccatgtggacgtggaggtgaaggacattaacgacaaccctccrgtgttcccagcgacacaaaagaatctgttcatcgcggaatccaggccgcttgactctcggtttccactagagggcgcgtccgatgcagatatcggggaga

SEQ ID NO: 4520 - DNA, 201 bp, Homo sapiens
tggaggtggccgacgtgaacgacaacgcaccagcgttcgcgcagtccgagtacacggtgttcgtgaaggagaacaacccgccgggctgccacatcttcackgtgtctgcgcgggacgctgacgcgcaggagaacgccctggtgtcctactcgctggtggagcggcggttgggcgagcgctcgctgtcgagctacgtgtcag

SEQ ID NO: 4521 - DNA, 201 bp, Homo sapiens
aagccgaacacggcaccttcgtgggccgcatcgcgcaggacctggggctggagctggcggagctggtgccgcgcctgttccagttggattccaaaggccgyggggaccttctggaggtaaatctgcagaatggcattttgtttgtgaattctcggatcgaccgcgaggagctgtgcgggcggagcgcggagtgcagcatcc

SEQ ID NO: 4522 - DNA, 201 bp, Homo sapiens
aacacggcaccttcgtgggccgcatcgcgcaggacctggggctggagctggcggagctggtgccgcgcctgttccagttggattccaaaggccgcggggaycttctggaggtaaatctgcagaatggcattttgtttgtgaattctcggatcgaccgcgaggagctgtgcgggcggagcgcggagtgcagcatccacctgg

SEQ ID NO: 4523 - DNA, 201 bp, Homo sapiens
ggaggaagccgaacacggcaccttcgtgggccgcatcgcgcaggacctggggctggagctggcggagctggtgccgcgcctgttccagttggattccaaakgccgcggggaccttctggaggtaaatctgcagaatggcattttgtttgtgaattctcggatcgaccgcgaggagctgtgcgggcggagcgcggagtgcag

SEQ ID NO: 4524 - DNA, 201 bp, Homo sapiens
tgcggtcggtgggcgccggcgtagtggtggggaaggtgcgcgcagtggacgccgactcgggctacaacgcgtggctttcatacgagctgcagccagaaacsgccagcgcgagcatcccgttccgcgtggggctgtacacgggcgagatcagcacaacgcgtgccctggacgaaacggacgcaccgcgccagcgcctactgg

SEQ ID NO: 4525 - DNA, 201 bp, Homo sapiens
gtcccggaggaagccgaacacggcaccttcgtgggccgcatcgcgcaggacctggggctggagctggcggagctggtgccgcgcctgttccagttggattscaaaggccgcggggaccttctggaggtaaatctgcagaatggcattttgtttgtgaattctcggatcgaccgcgaggagctgtgcgggcggagcgcggag

SEQ ID NO: 4526 - DNA, 201 bp, Homo sapiens
tccactactccgtcccggaggaagccgaacacggcaccttcgtgggccgcatcgcgcaggacctggggctggagctggcggagctggtgccgcgcctgttscagttggattccaaaggccgcggggaccttctggaggtaaatctgcagaatggcattttgtttgtgaattctcggatcgaccgcgaggagctgtgcgggc

SEQ ID NO: 4527 - DNA, 201 bp, Homo sapiens
actcaagtcgaggagatccagagggtcagcctctactgctctcgcttctgatcctcgcaatgtgggtggtggggagcggccagctccactactccgtcccsgaggaagccgaacacggcaccttcgtgggccgcatcgcgcaggacctggggctggagctggcggagctggtgccgcgcctgttccagttggattccaaag

SEQ ID NO: 4528 - DNA, 201 bp, Homo sapiens
ggagaacaacccgccgggctgccacatcttcacggtgtctgcgcgggacgctgacgcgcaggagaacgccctggtgtcctactcgctggtggagcggcggktgggcgagcgctcgctgtcgagctacgtgtcagtgcacgcggagagcggcaaggtgtacgcgctgcagccgttggaccacgaggagctggagctgctaca

SEQ ID NO: 4529 - DNA, 201 bp, Homo sapiens
ctggtgctggtgaaagaccacggggagccagcgctgacggccacggccactgtgctggtgtcgctggtggagagcggccaggcgccaaagtcatcgtcgcrggcgtcagtgggtgccacgggccccgaggtgacgctggtggatgtcaacgtgtacctgatcatcgccatctgcgcggtgtctagcctgttggttctcacg

SEQ ID NO: 4530 - DNA, 201 bp, Homo sapiens
atctgcagaatggcattttgtttgtgaattctcggatcgaccgcgaggagctgtgcgggcggagcgcggagtgcagcatccacctggaggtgatcgtagamaggccgctgcaggttttccatgtggacgtggaggtgaaggacattaacgacaaccctccagtgttcccagcgacacaaaagaatctgttcatcgcggaat

SEQ ID NO: 4531 - DNA, 201 bp, Homo sapiens
cacagtgataggacatatggattttgaagaaagtagagcacacaagatcccagtcgaggctgtcgataaaggcttcccacccctggctggtcattgtacasttcttgtggaagttgtggatgtaaatgacaatgctccacagttgactatcaaaacgctctcggttcctgtaaaagaggacgcacaactggggacagttat

SEQ ID NO: 4532 - DNA, 201 bp, Homo sapiens
ccctggaccgcgagagcgtgtcggtctatgagctggtggtgaccgcgcgggacgggggctcgccttcgctgtgggccaccgccagcgtgtctgtggaagtkgccgacgtgaacgacaacgctccggcgttcgcgcagccccagtataccgtgttcgtgaaggagaacaacccgccaggctgccacatcttcacggtgtctg

SEQ ID NO: 4533 - DNA, 201 bp, Homo sapiens
cattatcaggacactgtaaagtagtagtgaaactcctggatgtgaatgataataccccagagatggccataaccacccttttcctgcctgtcaaagaggaygctccactcagcacggtcattgctctgatcagcgtgtctgaccgtgactcaggtgccaacgggcaggtgacctgctccctaatgccccacgttcccttca

SEQ ID NO: 4534 - DNA, 201 bp, Homo sapiens
ggcatcaataaggaaatagtgtatttctttagtaatcttgttcttgacgatgtaaagtccaaatttataattaattctaatactggtgaaataaaagttamcggggaactggattatgaagactataactcatatgaaattaatattgatgccatggataaaagtacattcccattatcaggacactgtaaagtagtagtg

SEQ ID NO: 4535 - DNA, 201 bp, Homo sapiens
ataccccagagatggccataaccacccttttcctgcctgtcaaagaggacgctccactcagcacggtcattgctctgatcagcgtgtctgaccgtgactcrggtgccaacgggcaggtgacctgctccctaatgccccacgttcccttcaagctggtgtccaccttcaagaattactactcgttggtgctggacagcgccc

SEQ ID NO: 4536 - DNA, 201 bp, Homo sapiens
gagctgcagccagcgcctggcagtgcgcgcatcccgttccgcgtggggctgtacacaggcgagatcagcacaacacgctctctggatgagaccgaagcacygcgccaccgccttctggtgctggtgaaggaccatggagagcccccgctgacagccacagccacagtgctggtgtcgctggtggaaagtggccaggcgccg

SEQ ID NO: 4537 - DNA, 158 bp, Homo sapiens
gaaaggaaaagaaccttccatttttggctgtgccaagaagctcagaaaggtgataatytaaaaaatatatagttaattgggaattgaatttacaaaatacattgtgtggtgatgcaatagaaagctcataattggaacgagattgagatggtatattc

SEQ ID NO: 4538 - DNA, 201 bp, Homo sapiens
cggagagcggcaaggtgtacgcgctgcagccgctggaccacgaggaagtggagctgctgcagttccaggtgagcgcgcgcgacgcgggcgtgccgcctctrggcagcaacgtgacgctgcaggtgttcgtgctggacgagaacgacaacgcgccggcgctgctggtgcctcgagtgggtggcaccggcggcgcagtgagcg

SEQ ID NO: 4539 - DNA, 201 bp, Homo sapiens
cctggaggtgatcgtggacaggccgctgcaggttttccatgtggaggtggcagtgaaggacatcaatgacaatccgcccaggttctccagacaagaacaargattattcattttagagtcaagaatgccagattcgcggtttccgctagagggcgcgtcggatttggatattggagcaaatgcacaattgagatacaggtt

SEQ ID NO: 4540 - DNA, 160 bp, Homo sapiens
gaaaggaaaagaaccttccatttttggctgtgccaagaagctcagaaaggtgataatatyaaaaatatatagttaattgggaattgaatttacaaaatacattgtgtggtgatgcaatagaaagctcataattggaacgagattgagatggtatattccc

SEQ ID NO: 4541 - DNA, 201 bp, Homo sapiens
atattttgacttagatgttaaaacaaatgaagaagaaacgaactttttagagctggttttgaggaaatccttagatagagaagaaacacaagaacaccgtrtattagtgattgcaactgatggaggaaaacccgaactaacaggtacagttcagttgttgatcaatgtattggatgctaatgataacgccccagaatttga

SEQ ID NO: 4542 - DNA, 201 bp, Homo sapiens
ttgctctgatcagcgtgtctgaccgtgactcaggtgccaacgggcaggtgacctgctccctaatgccccacgttcccttcaagctggtgtccaccttcaayaattactactcgttggtgctggacagcgccctggaccgcgagagcgtgtcggtctatgagctggtggtgaccgcgcgggacgggggctcgccttcgctgt

SEQ ID NO: 4543 - DNA, 201 bp, Homo sapiens; identical to SEQ ID NO: 4456

SEQ ID NO: 4544 - DNA, 201 bp, Homo sapiens; identical to SEQ ID NO: 4448

SEQ ID NO: 4545 - DNA, 201 bp, Homo sapiens; identical to SEQ ID NO: 4473

SEQ ID NO: 4546 - DNA, 201 bp, Homo sapiens
ctcgggcgggtggcactggtggcgcagtgagcgagctggtgccatggtcggtgggtgtgggccacgtggtggcaaaggtgcgcgcggtggatgctgactcsggctacaacgcgtggctttcgtacgagctgcagccggggactggtggcgcgcgcatcccgttccgcgtggggctgtacactggcgagatcagcacaacgc

SEQ ID NO: 4547 - DNA, 201 bp, Homo sapiens; identical to SEQ ID NO: 4459

SEQ ID NO: 4548 - DNA, 201 bp, Homo sapiens
tgcatgcggagagcggcaaggtgtacgcgctgcagccgctggaccacgaggagctagagctgctgcagtttcaggtgaccgctcgcgatgccggcgtgccrcctctgggcagcaacgtgacgctgcaggtgttcgtgctggacgaaaacgacaacgcgccagcactgctagcgcctcgggcgggtggcactggtggcgcag

SEQ ID NO: 4549 - DNA, 201 bp, Homo sapiens
tgtcgagctacgtttcggtgcatgcggagagcggcaaggtgtacgcgctgcagccgctggaccacgaggagctagagctgctgcagtttcaggtgaccgckcgcgatgccggcgtgccacctctgggcagcaacgtgacgctgcaggtgttcgtgctggacgaaaacgacaacgcgccagcactgctagcgcctcgggcgg

SEQ ID NO: 4550 - DNA, 201 bp, Homo sapiens; identical to SEQ ID NO: 4474

SEQ ID NO: 4551 - DNA, 201 bp, Homo sapiens
tggtcacctgctccttgacgtcccacgtccccttcaagctggtgtccaccttcaagaattactactcgttggtgctggacagtgccctggaccgcgagagygtgtcagcctatgagctggtggtgaccgcgcgagacgggggctcgccttcgctgtgggccacggccagtgtttctgtggaggtggctgatgtgaacgaca

SEQ ID NO: 4552 - DNA, 201 bp, Homo sapiens
tcggtttccactagagggcgcctcggatgcagatatcggggagaacgccctgctcacttacagactgagcccaaatgaatacttttctctggaaaaaccayctgatgacgagctggtaaaaggtcttgggcttatattacggaaatctttagacagagaagaagctccggagatttttttagtgctcacagccactgatgg

SEQ ID NO: 4553 - DNA, 201 bp, Homo sapiens
ggccaaacacggcaccttcgtgggccgcatcgctcaggacctggggctggagctggcggagctggtgccgcgcctgttccgggtggcgtccaaaagacacsgggaccttctggaggtaaatctgcagaatggcattttgtttgtgaattctcggatcgaccgcgagaagctgtgcgggcggagcgcggagtgcagtatcca

SEQ ID NO: 4554 - DNA, 201 bp, Homo sapiens
gaggtaaatctgcagaatggcattttgtttgtgaattctcggatcgaccgcgagaagctgtgcgggcggagcgcggagtgcagtatccacctggaggtgaycgtggacaggccgctgcaggttttccatgtggacgtggaggtgaaggacattaacgacaacccgccggtgttcagagaaagggaacaaaaggtacctgtt

SEQ ID NO: 4555 - DNA, 154 bp, Homo sapiens
tgactgtgatgctggaaaaaatttactaaatatgtacttacagaaaagggtgaytgctcataaaatacctcaggcaagcgatcccttaaaactgattgtcccaactcagaggccctcattttctgcaatggtgattatcggaccaagaggcccg

SEQ ID NO: 4556 - DNA, 201 bp, Homo sapiens
tgtccacctacaagaattactactcgttggtgctggacagcgccctggaccgcgagagcgtgtcggcctatgagctggtggtgactgcgcgggatgggggytcgccttcgctgtgggccacggctagagtgtccgtggaggtggccgacgtgaacgacaatgcgcctgcgttcgcgcagcccgagtacacagtgttcgtga

SEQ ID NO: 4557 - DNA, 201 bp, Homo sapiens
tgatggtaatcgatggcggtaaaccagaactaacagggtctgtccagattcaaataaccgtcctggatgtgaatgacaatggtccggcgtttgataagccmagctataaagtagtgttgtctgaaaatgtccaaaacgacacaagagtgatccaactaaatgcttccgatccagacgaaggacttaatggagaaatttcct

SEQ ID NO: 4558 - DNA, 201 bp, Homo sapiens
tggtgctcacgctgctgctgtacactgcgctgcgttgctcagcgccgcccaccgtgagccggtgcgcgccgggcaagcccacgctggtgtgctccagcgcygtggggagttggtcttactcgcagcagaggaggcagagggtgtgctctgcagagagcccgcccaagacggacctcatggccttcagcccaagccttcagc

SEQ ID NO: 4559 - DNA, 201 bp, Homo sapiens
cctgaattagttcttcggaagttattggacagagagcaaacgccaaaactcaatttattgctgatggtaatcgatggcggtaaaccagaactaacagggtstgtccagattcaaataaccgtcctggatgtgaatgacaatggtccggcgtttgataagcccagctataaagtagtgttgtctgaaaatgtccaaaacgac

SEQ ID NO: 4560 - DNA, 201 bp, Homo sapiens
gtgctcacgctgctgctgtacactgcgctgcgttgctcagcgccgcccaccgtgagccggtgcgcgccgggcaagcccacgctggtgtgctccagcgccgyggggagttggtcttactcgcagcagaggaggcagagggtgtgctctgcagagagcccgcccaagacggacctcatggccttcagcccaagccttcagctg

SEQ ID NO: 4561 - DNA, 201 bp, Homo sapiens
gctacgtgtcggtgcacgcggagagcggcaaggtgtacgcgctgcagccgttggaccacgaggagctggagctgttgcagttccaggtgagcgcgcgcgaktctggcgtgccgcctctgggcagcaacgtgacgctgcaggtgttcgtgctggacgagaacgacaacgctccggcgctgctgacgcccggggctggcagcg

SEQ ID NO: 4562 - DNA, 201 bp, Homo sapiens
cagtggtatatgcatttaccataaatccgaacaatggagaaattaggacaaaaggcaaactagatttcgaagaaaagaaattatatgaaatatccgtggamgcagttgacaaaggaaatattccaatggcgggtcattgtacccttttggtggaagtactagatgtaaatgataacgccccagaggttaccatcacttctt

SEQ ID NO: 4563 - DNA, 201 bp, Homo sapiens
aaagcaagaaacgaataatcattgcagaatctagacctccggaaactcgatttccactagatggcgcatccgatgcagatattggagtaaactcggcattwacctaccgactggatcccaacgattatttcactttggacgcacaaaacagtcttgagcaaatgtcttcattatcacttgtactgaggaaaacactggaca

SEQ ID NO: 4564 - DNA, 201 bp, Homo sapiens
acaagaactactactcattagtgctggacagcgccctggaccgcgagagcgtatcagcctatgaactggtggtgaccgcgcgggacgggggctcgccttckctgtgggccacggccagcgtgtcggtgggggtggccgacgtgaacgacaacgcgccggcgttcgcgcagcccgagtacacggtgttcgtgaaggaaaaca

SEQ ID NO: 4565 - DNA, 201 bp, Homo sapiens
cgctggtggagagcggccaagcgccacaggcttcgtcgagggcgtcggcaggcgctgtgggtccagaagcggcgctggtggatgtcaatgtttacttgatsattgccatctgcgcggtgtccagcctgttggtgctcacgttgctgctgtatactgcgctgcggtgctcggcaccgcccaccgagggcgcgtgcgcgccgg

SEQ ID NO: 4566 - DNA, 201 bp, Homo sapiens
tcaatgggctggtcacctgctccttgacgtcccacgtccccttcaagctggtgtccaccttcaagaattactactcgttggtgctggacagtgccctggaycgcgagagcgtgtcagcctatgagctggtggtgaccgcgcgagacgggggctcgccttcgctgtgggccacggccagtgtttctgtggaggtggctgatg

SEQ ID NO: 4567 - DNA, 201 bp, Homo sapiens
tgctagcgcctcgggcgggtggcactggtggcgcagtgagcgagctggtgccatggtcggtgggtgtgggccacgtggtggcaaaggtgcgcgcggtggasgctgactccggctacaacgcgtggctttcgtacgagctgcagccggggactggtggcgcgcgcatcccgttccgcgtggggctgtacactggcgagatca

SEQ ID NO: 4568 - DNA, 201 bp, Homo sapiens
acgtttcggtgcatgcggagagcggcaaggtgtacgcgctgcagccgctggaccacgaggagctagagctgctgcagtttcaggtgaccgctcgcgatgcrggcgtgccacctctgggcagcaacgtgacgctgcaggtgttcgtgctggacgaaaacgacaacgcgccagcactgctagcgcctcgggcgggtggcactg

SEQ ID NO: 4569 - DNA, 201 bp, Homo sapiens
gcttgactctcggtttccactagagggcgcctcggatgcagatatcggggagaacgccctgctcacttacagactgagcccaaatgaatacttttctctgyaaaaaccacctgatgacgagctggtaaaaggtcttgggcttatattacggaaatctttagacagagaagaagctccggagatttttttagtgctcacagc

SEQ ID NO: 4570 - DNA, 201 bp, Homo sapiens
agcgcgcgctgtcgagctacgtttcggtgcatgcggagagcggcaaggtgtacgcgctgcagccgctggaccacgaggagctagagctgctgcagtttcakgtgaccgctcgcgatgccggcgtgccacctctgggcagcaacgtgacgctgcaggtgttcgtgctggacgaaaacgacaacgcgccagcactgctagcgc

SEQ ID NO: 4571 - DNA, 201 bp, Homo sapiens
ttcgtgtgtaccaagttgcaccagagcccaggctgttgcgctcagagctgctgtcgctctacagaggatctgaggtatggaagtaagatggtttcaaatcyttgcatgacatcagccaccatagatgtcactacagttgagagactttctcagacttatctctatcgggcctctctgggacttggttctgataataacagt

SEQ ID NO: 4572 - DNA, 201 bp, Homo sapiens
tctctaggccgagtgtttgcccaggaccccgacctggggaagaatggccttgtctcttatgagctgttggatgttatctctgaagggccatcagcctctarcttggtggcagtggaatcatccagtggggccatcactgccaaaacttcctttgactttgagcagctcagggggtttcatttccaagtagaaggccgggat

SEQ ID NO: 4573 - DNA, 201 bp, Homo sapiens
cttgtatttagtaattgccttggcttgtatttcctttttatttctggggtgcttacttttcttcgtgtgtaccaagttgcaccagagcccaggctgttgckctcagagctgctgtcgctctacagaggatctgaggtatggaagtaagatggtttcaaatccttgcatgacatcagccaccatagatgtcactacagttga

SEQ ID NO: 4574 - DNA, 201 bp, Homo sapiens
gctttactctcccgaatgcccaagatgacgacgagggaagcaatgggatactaagctacagcctaagccccagtcagcactttcgcctggacatgggatcrcgggttgacggcagcgaatacccggagttggtgttggagaaagcactggatcgcgaacagcgcgccacccacctgctggtgcttacagctcgggacggcg

SEQ ID NO: 4575 - DNA, 201 bp, Homo sapiens
tccgagttcaagccttggatccagatgaagggtccaatggggaagtccaatactccctaagcaacagcacgcaagcagagctgcgacaccgctttcacgtkcaccctaaaagtggggaggtgcaagtagctgcttcactaggtccgcctgaaacgctcttggaggcatacattgaggcgagggacgaaggtgtctttggtt

SEQ ID NO: 4576 - DNA, 201 bp, Homo sapiens
caaattttatggaatttgattcctttggcccggagatggctgctagctgtgttttgaaatatttcttagacaagcctttcacaacatttcatcaattgaaytaaacactccttcttagcacttcctgtgccaagaaatctggaagtatagaagtattagaagattgccctaggcctcaagggacttatagtttatttttga

SEQ ID NO: 4577 - DNA, 201 bp, Homo sapiens
cgggacggcgggctacctgcccgctcaggagacgcacaagtcaccatcattgtggtggacacaaatgacaacgcgcctgtatttgagcgctccgtataccrcaccaaggttccagagactgcacccaatgggactgtgttattccgagttcaagccttggatccagatgaagggtccaatggggaagtccaatactcccta

SEQ ID NO: 4578 - DNA, 201 bp, Homo sapiens
acggcctcagatagtggctcacccccacttagcacccgaaggacaatcactgtgtcagttgctgatgtgaatgacaatacaccaaactttcctcaaccccrgcaggaacttttcgttgctgaaaacaatggccctggggcctctctaggccgagtgtttgcccaggaccccgacctggggaagaatggccttgtctcttat

SEQ ID NO: 4579 - DNA, 201 bp, Homo sapiens
ccgtataccgcaccaaggttccagagactgcacccaatgggactgtgttattccgagttcaagccttggatccagatgaagggtccaatggggaagtccartactccctaagcaacagcacgcaagcagagctgcgacaccgctttcacgtgcaccctaaaagtggggaggtgcaagtagctgcttcactaggtccgcctg

SEQ ID NO: 4580 - DNA, 201 bp, Homo sapiens
aagtccaatactccctaagcaacagcacgcaagcagagctgcgacaccgctttcacgtgcaccctaaaagtggggaggtgcaagtagctgcttcactaggyccgcctgaaacgctcttggaggcatacattgaggcgagggacgaaggtgtctttggtttagctagcaccgctaaactgctggtggaggtgactgacgtga

SEQ ID NO: 4581 - DNA, 201 bp, Homo sapiens
cctttgacaactactacagcctgctgattgatgggcccctggaccgggagcagatcagtgaataccaagtcctgatcacggcctcagatagtggctcaccsccacttagcacccgaaggacaatcactgtgtcagttgctgatgtgaatgacaatacaccaaactttcctcaaccccagcaggaacttttcgttgctgaaa

SEQ ID NO: 4582 - DNA, 201 bp, Homo sapiens
aggccgagtgtttgcccaggaccccgacctggggaagaatggccttgtctcttatgagctgttggatgttatctctgaagggccatcagcctctagcttgstggcagtggaatcatccagtggggccatcactgccaaaacttcctttgactttgagcagctcagggggtttcatttccaagtagaaggccgggatggtgg

SEQ ID NO: 4583 - DNA, 201 bp, Homo sapiens
gcagcgggacagctcgagtactcagtgccggaggagacggagcggggcgtagccgtaggcaatctctccgcggacttgaggctgccagcggccgctatgtyctcgcggaactttcgcttcctttccagccaccgcgagctctacttcggggtggatctacccagcggcaatttggtggtcagagagccggcggaccgcgaa

SEQ ID NO: 4584 - DNA, 201 bp, Homo sapiens
gtgggtttcctgcggcgctgcagcgggacagctcgagtactcagtgccggaggagacggagcggggcgtagccgtaggcaatctctccgcggacttgaggmtgccagcggccgctatgtcctcgcggaactttcgcttcctttccagccaccgcgagctctacttcggggtggatctacccagcggcaatttggtggtcag

SEQ ID NO: 4585 - DNA, 201 bp, Homo sapiens
tccttcttagcacttcctgtgccaagaaatctggaagtatagaagtattagaagattgccctaggcctcaagggacttatagtttatttttgagaaacaarggcaaaaattaaaacctatttaagaacaataaaagtaatatgacataaaggtctaaaattaaaaataaaataccaaaatattttataagcaacagatgtg

SEQ ID NO: 4586 - DNA, 201 bp, Homo sapiens
cagatgaagggtccaatggggaagtccaatactccctaagcaacagcacgcaagcagagctgcgacaccgctttcacgtgcaccctaaaagtggggaggtkcaagtagctgcttcactaggtccgcctgaaacgctcttggaggcatacattgaggcgagggacgaaggtgtctttggtttagctagcaccgctaaactgc

SEQ ID NO: 4587 - DNA, 201 bp, Homo sapiens
agattcggattcacgtcctggacaccaatgacaactcacctctctttcctgccggcgacgtgcagctgcacatccccgagttcctgacgcccggagcccgytttactctcccgaatgcccaagatgacgacgagggaagcaatgggatactaagctacagcctaagccccagtcagcactttcgcctggacatgggatcgc

SEQ ID NO: 4588 - DNA, 201 bp, Homo sapiens
gcagtgagtgagctggtgccgtggtcggtgggtgcagggcacgtggtggcgaaggtgcgcgcagtggacgctgactcaggctacaacgcgtggctttcgtrcgagcttcagctgggtactggcagcgctcgcatcccgttccgcgtggggctatacacgggtgagatcagcacgacacgtgccctagacgaggctgactcc

SEQ ID NO: 4589 - DNA, 201 bp, Homo sapiens
tcacttcccatctcagagaacgcttccctgggcactgtcattgctctcatcacggtgtcggatcgcgactctggtacgaatggacatgtcacctgctcccrgacgccccacgtccctttcaagctggtgtccaccttcaagaattactactcgttggtgctggacagcgccctggaccgcgagagcgtgtcagcctatgag

SEQ ID NO: 4590 - DNA, 201 bp, Homo sapiens
tggtgtccaccttcaagaattactactcgttggtgctggacagcgccctggaccgcgagagcgtgtcagcctatgagctggtggtgaccgcacgggacggrggctcgccttcactgtgggccaccaccagcgtgtccatcgaggtggccgacgtgaacgacaacgcgccggcgttcgcacagcctgagtacacagtattcg

SEQ ID NO: 4591 - DNA, 201 bp, Homo sapiens
ggggccgaggggcctggacacggctgctctcgcttctgctcctcgcagcctggaaggtggggagcggccagctccgctactccgtccccgaggaggccaamcacggcaccttcgtgggccgcatcgcgcaggacctggggctggagctggaggagctggtgccgcgcctgttccgggtggcgtccaaaagacacggggacc

SEQ ID NO: 4592 - DNA, 201 bp, Homo sapiens
gttgacagccacggccaccgtgttagtgtcgttggtggaaagtggccaggcacccaaggcctcgtcgcgggcgtgggtgggcgccgcgggctcagaggctycgctggtggatgtcaacgtgtacctgatcatcgccatctgcgcggtatccagcctgttggtgctcacggtgctgctgtacactgcgctgcggtgctcggt

SEQ ID NO: 4593 - DNA, 201 bp, Homo sapiens
gtccccgaggaggccaaacacggcaccttcgtgggccgcatcgcgcaggacctggggctggagctggaggagctggtgccgcgcctgttccgggtggcgtscaaaagacacggggaccttctggaggtaaatctgcagaatggcattttgtttgtgaattctcggatcgaccgggaggagctgtgcgggcggagcgcggaa

SEQ ID NO: 4594 - DNA, 201 bp, Homo sapiens
taatggcgtcttctatcagaaggggccgaggggcctggacacggctgctctcgcttctgctcctcgcagcctggaaggtggggagcggccagctccgctastccgtccccgaggaggccaaacacggcaccttcgtgggccgcatcgcgcaggacctggggctggagctggaggagctggtgccgcgcctgttccgggtgg

SEQ ID NO: 4595 - DNA, 201 bp, Homo sapiens
taaacttaaaccagaaaatcgactagttttaaatctacagaataaacagtagagccttccttttagccacatgatgtcgctgtccaccatagagtgttctrtaggaaggaaaatacccagagcccctttgttacttcagagaagcggaggaataagagaagcagcaggactttaacagagactagaatatttaaatttttg

SEQ ID NO: 4596 - DNA, 201 bp, Homo sapiens; identical to SEQ ID NO: 4456

SEQ ID NO: 4597 - DNA, 201 bp, Homo sapiens; identical to SEQ ID NO: 4459

SEQ ID NO: 4598 - DNA, 201 bp, Homo sapiens
aagccacggataaaggaaatcccccaatgtcagatcactgcacagttctactcgaaattgtggacatcaatgataatgtacctgagttagttattcaatcrctatctttacctgtattagaagactctccacttagcacagtcatcgccctgatcagcgtgtccgaccgcgactcaggagtcaatggacaggtcacctgct

SEQ ID NO: 4599 - DNA, 201 bp, Homo sapiens
tttccaatggctgtaaagaatctgtttatttccgaatcccgacagcctggctctcggttttcgctagagggcgcatcagatgcagatatcggaacaaattsgttgttgacttacagtcttgattccactgaatattttaccttggacgttaaaagaaatgatgaggaaattaaatcccttggactcgtgttgaaaaaaaat

SEQ ID NO: 4600 - DNA, 201 bp, Homo sapiens
tccacctggaggtgatcgtggacaggccgctgcaggttttccatgtggaggtggaagtgaaggacattaatgacaacgcgccagtttttccaatggctgtraagaatctgtttatttccgaatcccgacagcctggctctcggttttcgctagagggcgcatcagatgcagatatcggaacaaattcgttgttgacttaca

SEQ ID NO: 4601 - DNA, 201 bp, Homo sapiens
agcggccagctccactactccgtctctgaggaggccaagcatggcaccttcgtgggccgcatcgcgcaggacctggggctggagctggcggagctggtgcmgcgcctgttccgggtggcgtccaaaagacacggggaccttctggaggtaaatctgcagaatggcattttgtttgtgaattctcggatagaccgcgaggaa

SEQ ID NO: 4602 - DNA, 201 bp, Homo sapiens
acggggaccttctggaggtaaatctgcagaatggcattttgtttgtgaattctcggatagaccgcgaggaactgtgcgggcggagcgcggagtgcagcatycacctggaggtgatcgtggacaggccgctgcaggttttccatgtggaggtggaagtgaaggacattaatgacaacgcgccagtttttccaatggctgtaa

SEQ ID NO: 4603 - DNA, 198 bp, Homo sapiens
gcattacgtattcagatactgctttgcttcatcctctctaaaatttaacaccgaggagtttaagaaatgaagataaggaactcgaattatttttaaaytttggatcaatgtaaaggcaatctaatatttggaaaatacttgcaatgttgttctcctggcgagaagatcctggagcccagtgcctgctgctttctcttc

SEQ ID NO: 4604 - DNA, 201 bp, Homo sapiens; identical to SEQ ID NO: 4448

SEQ ID NO: 4605 - DNA, 201 bp, Homo sapiens
gcctactggtgctggtgaaggaccacggtgaaccctcattgaccgccacggccactgtgctggtgtcgctggtggagagtggccaggcacccaaggcctcktcccaggcgtccgctggcgccacgggcccggaagctgcactggtggatgtcaacgtgtacttgatcgtcgccatctgcgcggtgtccagtctgttggtgc

SEQ ID NO: 4606 - DNA, 201 bp, Homo sapiens; identical to SEQ ID NO: 4473

SEQ ID NO: 4607 - DNA, 201 bp, Homo sapiens
ccaaatggtaccctagtggtgaccgttaacgccaccgatttggatgaaggagtaaataaggatatcgcgtattctttcaatacggacatgtcagcagataytctgtcaaaattccatttagatccagtcaatggacaaatcagtgtaaagggtaacatagatttcgaggaaagtaagtcatatgaaatccaggtagaagcc

SEQ ID NO: 4608 - DNA, 201 bp, Homo sapiens
catgtcagcagatattctgtcaaaattccatttagatccagtcaatggacaaatcagtgtaaagggtaacatagatttcgaggaaagtaagtcatatgaartccaggtagaagccacggataaaggaaatcccccaatgtcagatcactgcacagttctactcgaaattgtggacatcaatgataatgtacctgagttagt

SEQ ID NO: 4609 - DNA, 201 bp, Homo sapiens; identical to SEQ ID NO: 4474

SEQ ID NO: 4610 - DNA, 201 bp, Homo sapiens
ttggtgctggacagccctctggaccgcgagagcgtgtcggcctatgagctggtggtgactgctcgggacgggggctcgccttcactgtgggccacggccakcgtgtccgtggaggtggccgacgtgaacgacaatgcgccggcattctcgcagtccgagtacacggtgttcgtgaaggagaacaacccgccgggctgccac

SEQ ID NO: 4611 - DNA, 201 bp, Homo sapiens
tactcgaaattgtggacatcaatgataatgtacctgagttagttattcaatcactatctttacctgtattagaagactctccacttagcacagtcatcgcyctgatcagcgtgtccgaccgcgactcaggagtcaatggacaggtcacctgctcgctgacgccccacgtccccttcaagctggtgtccaccttcaagaatt

SEQ ID NO: 4612 - DNA, 201 bp, Homo sapiens
ccgccaaccgaaggcgactgtgggccgggcaagcccacgctggtgtgctccagcgcggtggggagctggtcatactcgcagcagaggcagcagagggtgtrctctggagaggggttgcccaagaccgacctcatggcttttagccctagccttcctccttgtccaattagccgggatagagaggagaaacaggatgtggac

SEQ ID NO: 4613 - DNA, 201 bp, Homo sapiens
atcgagaggacactcctaagcattatttactaataacagcaattgatggtgggaaaccagagctcactggcacgactcaactaaagatcactgttttagaygtaaacgacaacgccccagcgtttgagaggacgatctataaagtcagattactcgaaaatgcaccaaatggtaccctagtggtgaccgttaacgccaccg

SEQ ID NO: 4614 - DNA, 201 bp, Homo sapiens; identical to SEQ ID NO: 4448

SEQ ID NO: 4615 - DNA, 201 bp, Homo sapiens; identical to SEQ ID NO: 4456

SEQ ID NO: 4616 - DNA, 201 bp, Homo sapiens
cacctggaggtgatcgtggaaaggccgctgcaggttttccatgtggacgtggaggtgaaggacattaacgacaaccctccggtgttcccagcgacacaaargaatctgttcatcgcggaatccaggccgcttgactctcggtttccactagagggcgcgtccgatgcagatatcggggagaacgccctgctcacttacaga

SEQ ID NO: 4617 - DNA, 201 bp, Homo sapiens; identical to SEQ ID NO: 4473

SEQ ID NO: 4618 - DNA, 201 bp, Homo sapiens
ggagcgcggagtgcagcatccacctggaggtgatcgtggaaaggccgctgcaggttttccatgtggacgtggaggtgaaggacattaacgacaaccctccrgtgttcccagcgacacaaaagaatctgttcatcgcggaatccaggccgcttgactctcggtttccactagagggcgcgtccgatgcagatatcggggaga

SEQ ID NO: 4619 - DNA, 201 bp, Homo sapiens; identical to SEQ ID NO: 4459

SEQ ID NO: 4620 - DNA, 201 bp, Homo sapiens
ggtgtcctactcgctggtggagctgcgggtgggcgagcgcgcgctgtcgagctacgtgtcagtgcacgcggagagcggcaaggtgtacgcgctgcagccgytggaccacgaggagctggagctgttgcagttccaggtgagcgcgcgcgatgcgggcgtgccgcctctgggcagcaacgtgacgctgcaggtgttcgtgct

SEQ ID NO: 4621 - DNA, 201 bp, Homo sapiens
ttgcaggcccagagaccgagctggtggatgtcaacgtgtacctgatcatcgccatctgcgcggtgtccagtctgttggtgcttaccctgctgctgtacacrgcgttgcggtgctcagcgccgtcctctgagggcgcatgtagtttggtaaagcccactctggtgtgctccagcgcggtggggagctggtcattctcccagc

SEQ ID NO: 4622 - DNA, 201 bp, Homo sapiens; identical to SEQ ID NO: 4474

SEQ ID NO: 4623 - DNA, 201 bp, Homo sapiens
ccccagtgttcgacagaaccctgtatacggtgaaattaccagaaaacgtttctatcggaacgctggtgattcaccccaatgcctcagatttagacgaaggyttgaatggggatattatttactccttctccagtgatgtttctccagatataaaatccaagttccacatggaccccttaagtggggcaatcacagtgatag

SEQ ID NO: 4624 - DNA, 118 bp, Homo sapiens
caacaatggccacacatmgagattgaaatgaagggataaaaacattcctataaattcgaaggcaagttttgctgactagaaaaacaagccaataatttgaaatggtgtgcccgaatgg

SEQ ID NO: 4625 - DNA, 201 bp, Homo sapiens
ttttgaagaaagtagagcacacaagatcccagtcgaggctgtcgataaaggcttcccacccctggctggtcattgtacagttcttgtggaagttgtggatrtaaatgacaatgctccacagttgactctcacttccctgtctctccctattccagaggacgcccaaccaggtaccgtcatcacattgattagcgtgtttga

SEQ ID NO: 4626 - DNA, 201 bp, Homo sapiens
gctgacagccacagccaccgtgctggtgtcgctggtggaaagcggccaggcaccaaaggcgtcgtcgcgggcatcgttgggcattgcaggcccagagaccragctggtggatgtcaacgtgtacctgatcatcgccatctgcgcggtgtccagtctgttggtgcttaccctgctgctgtacacggcgttgcggtgctcagc

SEQ ID NO: 4627 - DNA, 201 bp, Homo sapiens
gagatcagcacgacacgagccctagatgagacggacgcaccgcgccaccgccttctggtgcttgtgaaggaccacggggagccctcgctgacagccacagscaccgtgctggtgtcgctggtggaaagcggccaggcaccaaaggcgtcgtcgcgggcatcgttgggcattgcaggcccagagaccgagctggtggatgtc

SEQ ID NO: 4628 - DNA, 201 bp, Homo sapiens
gaccgcgaggagctgtgcgggcggagcgcggagtgcagcatccacctggaggtgatcgtggaaaggccgctgcaggttttccatgtggacgtggaggtgarggacattaacgacaaccctccggtgttcccagcgacacaaaagaatctgttcatcgcggaatccaggccgcttgactctcggtttccactagagggcgcg

SEQ ID NO: 4629 - DNA, 201 bp, Homo sapiens
taaatctgcagaatggcattttgtttgtgaattctcggatcgaccgcgaggagctgtgcgggcggagcgcggagtgcagcatccacctggaggtgatcgtrgaaaggccgctgcaggttttccatgtggacgtggaggtgaaggacattaacgacaaccctccggtgttcccagcgacacaaaagaatctgttcatcgcgg

SEQ ID NO: 4630 - DNA, 201 bp, Homo sapiens
gttccgggcggtgtgcaaattccgtggggatcttctggaggtaaatctgcagaatggcattttgtttgtgaattctcggatcgaccgcgaggagctgtgcsggcggagcgcggagtgcagcatccacctggaggtgatcgtggaaaggccgctgcaggttttccatgtggacgtggaggtgaaggacattaacgacaaccc

SEQ ID NO: 4631 - DNA, 201 bp, Homo sapiens
gagctggcggagctggtgccgcgcctgttccgggcggtgtgcaaattccgtggggatcttctggaggtaaatctgcagaatggcattttgtttgtgaattstcggatcgaccgcgaggagctgtgcgggcggagcgcggagtgcagcatccacctggaggtgatcgtggaaaggccgctgcaggttttccatgtggacgtg

SEQ ID NO: 4632 - DNA, 135 bp, Homo sapiens
tgcgaagtgctttccaatccatgttagttactagttattacagctgtaaggataaaacacgtcatgtggattcattttgaattggtgctattggtatttcktctgttattgctaataaatgaaaatggtggtatg

SEQ ID NO: 4633 - DNA, 201 bp, Homo sapiens
ctccgctgtgggccacggccagggtgtctgtggaggtggccgacgtgaacgacaacgcgcctgcgttcgcgcagtccgagtacacggtgttcgtgaaggasaacaacccgccaggctgccacatcttcacggtgtctgcgtgggacgcggacgcgcaggagaacgccctggtgtcctactctctggtggagcggcggttgg

SEQ ID NO: 4634 - DNA, 201 bp, Homo sapiens
agaacgccctggtgtcctactctctggtggagcggcggttgggcgagcgctcgctgtcgagctacgtgtcggtgcacgcggagagcggcaaggtgtacgckctgcagccgctggaccacgaggagctggagctgctacagttccaggtgagcgcgcgcgatgggggcgtgccgcctctgggcagcaacttgacgctgcagg

SEQ ID NO: 4635 - DNA, 201 bp, Homo sapiens
caatttagaagtttgattaattatattatctatttaggcattaatataaaagaggtaggagtctgttatttaaaaaaagcattaaatttaaaaaaaaactrtcttgtctacttttagcttcattctcccatattttgaagggtgtgtaacttcagctctgcaggattgcatggggtaaaacttgttaccaacacatgtgaa

SEQ ID NO: 4636 - DNA, 201 bp, Homo sapiens
gagctggtgctgcggtcggtggttgcgggtcacgtggtggctaaggtgcgcgcagtggacgctgactctggatacaacgcgtggctgtcgtatgaattgckgtcggcggcggttggtgcacgcatcccgtttcgcgtggggctgtacacgggcgagatcagtacgacgcgcgctctggatgagactgactcgccacgccag

SEQ ID NO: 4637 - DNA, 201 bp, Homo sapiens
ccccagccttccaccatgcccaatggtagatgtggacggggaagatcagtctattggaggggaccactctaggaagccacgacagcccaaccctgactggrgttactctgcctccctgagagcaggcatgcacagctctgtgcacctagaggaggctggcattctacgggctggtccaggagggcctgatcagcagtggcc

SEQ ID NO: 4638 - DNA, 201 bp, Homo sapiens
cgaggaggccagacacggcaccttcgtgggccgcatcgcgcaggacctggggctggagctggcggagctggtgcagcgcctgttccgggtggcgtccaaaygacacggggaccttctggaggtaaatctgcagaatggcattttgtttgtgaattctcggattgaccgcgaggagctgtgcgggcggagcgtggagtgcag

SEQ ID NO: 4639 - DNA, 201 bp, Homo sapiens
cgcccaccgagggcgcatgtgggccggtgaagcccacgctggtgtgctctagcgcggtggggagctggtcttactcgcagcagaggcggcagagggtgtgstctggggagggcctgcccaaggcggacctcatggccttcagccccagccttccaccatgcccaatggtagatgtggacggggaagatcagtctattggag

SEQ ID NO: 4640 - DNA, 201 bp, Homo sapiens
ctcgctgtcgagctacgtgtcggtgcacgcggagagcggcaaggtgtacgcgctgcagccgctggaccacgaggagctggagctgctacagttccaggtgrgcgcgcgcgatgggggcgtgccgcctctgggcagcaacttgacgctgcaggtgttcgtgctggacgagaacgacaacgctcccgcgctgctggcgtctcc

SEQ ID NO: 4641 - DNA, 201 bp, Homo sapiens
cgtgccgcctctgggcagcaacttgacgctgcaggtgttcgtgctggacgagaacgacaacgctcccgcgctgctggcgtctcccgctggcagcgcgggckgtgcagtcagtgagctggtgctgcggtcggtggttgcgggtcacgtggtggctaaggtgcgcgcagtggacgctgactctggatacaacgcgtggctgtc

SEQ ID NO: 4642 - DNA, 201 bp, Homo sapiens
ctcccgcgctgctggcgtctcccgctggcagcgcgggcggtgcagtcagtgagctggtgctgcggtcggtggttgcgggtcacgtggtggctaaggtgcgsgcagtggacgctgactctggatacaacgcgtggctgtcgtatgaattgcagtcggcggcggttggtgcacgcatcccgtttcgcgtggggctgtacacgg

SEQ ID NO: 4643 - DNA, 201 bp, Homo sapiens
gctgctggatcgtgaagaaaatcctcagctaaagttgttgttgacagcaactgatggaggcaaacctgaatttaccggatctgtttctctgctgatcctgytgttagatgccaatgataacgcccctatctttgacagaccggtttatgaagttaagatgtatgaaaatcaagtgaaccaaacattagtaatacggctcaa

SEQ ID NO: 4644 - DNA, 201 bp, Homo sapiens
actaacacctatgatgttacctgaaatcaatctcccatatgtatgctgtatgctatgctaagactcctgaaatatacttactctgtgcttgtgtatgtgaktgttaatgcaactattacctagagtgaactttaagctttattgttgaatgtaattccattatatttccttttgtacacctgtgaaaaagtggagtagtgt

SEQ ID NO: 4645 - DNA, 201 bp, Homo sapiens
gctcgctgtcgagctacgtgtcggtgcacgcggagagcggcaaggtgtacgcgctgcagccgctggaccacgaggagctggagctgctacagttccaggtragcgcgcgcgatgggggcgtgccgcctctgggcagcaacttgacgctgcaggtgttcgtgctggacgagaacgacaacgctcccgcgctgctggcgtctc

SEQ ID NO: 4646 - DNA, 201 bp, Homo sapiens
tccggtcccggtgagttgcccgacaaattcattatcccaggatctcctgcaatcatctccatccggcaggagcctactaacagccaaattgacaaaagtgmcttcataaccttcggcaaaaaggaggagaccaagaaaaagaagaaaaagaagaagggtaacaagacccaggagaaaaaagagaaagggaacagcacgact

SEQ ID NO: 4647 - DNA, 201 bp, Homo sapiens
gaccagtgaggtcctcaaatggaaacaagccacttagccagtttttgtaataatggcaaatctctcccatgtagcaattccctgctcctttttcctatctrcatgagccctcttagagacctcagaaatctgcagaaagttccctgtgtctgtctagaacgcatttaacaggttttgtcgtaaaagctttactaagtctgg

SEQ ID NO: 4648 - DNA, 201 bp, Homo sapiens
tacgacgcgcgctctggatgagactgactcgccacgccagcgcctactggtgctggtgaaggaccatggcgagccgtcgctgacggccacggccactgtgrttgtgtcgcttgtggagggcagccaggcacccaaggcctcgtcgcgggcttcagtgggcgtggcgcccgaggtggccctggtggatgtcaacgtgtacct

SEQ ID NO: 4649 - DNA, 201 bp, Homo sapiens; identical to SEQ ID NO: 4456

SEQ ID NO: 4650 - DNA, 201 bp, Homo sapiens; identical to SEQ ID NO: 4448

SEQ ID NO: 4651 - DNA, 201 bp, Homo sapiens; identical to SEQ ID NO: 4553

SEQ ID NO: 4652 - DNA, 201 bp, Homo sapiens; identical to SEQ ID NO: 4473

SEQ ID NO: 4653 - DNA, 201 bp, Homo sapiens; identical to SEQ ID NO: 4554

SEQ ID NO: 4654 - DNA, 154 bp, Homo sapiens; identical to SEQ ID NO: 4555

SEQ ID NO: 4655 - DNA, 201 bp, Homo sapiens; identical to SEQ ID NO: 4556

SEQ ID NO: 4656 - DNA, 201 bp, Homo sapiens; identical to SEQ ID NO: 4459

SEQ ID NO: 4657 - DNA, 201 bp, Homo sapiens; identical to SEQ ID NO: 4557

SEQ ID NO: 4658 - DNA, 201 bp, Homo sapiens; identical to SEQ ID NO: 4558

SEQ ID NO: 4659 - DNA, 201 bp, Homo sapiens; identical to SEQ ID NO: 4474

SEQ ID NO: 4660 - DNA, 201 bp, Homo sapiens; identical to SEQ ID NO: 4559

SEQ ID NO: 4661 - DNA, 201 bp, Homo sapiens; identical to SEQ ID NO: 4560

SEQ ID NO: 4662 - DNA, 201 bp, Homo sapiens
cccttcaagctggtgtccaccttcaagaattactactcgttggtgttggacagcgccctggatcgcgagagcctgtcggtctatgagctggtggtgaccgrgcgggacgggggctcgccttcgctgtgggccacggccagggtgtccgtggaggtggccgacgtgaatgacaacgcgcctgcgttcgcgcagcccgagtac

SEQ ID NO: 4663 - DNA, 201 bp, Homo sapiens
aaaatcctacgaaattcaagtaaaggcagttgataaaggaagtcctccgatgtcaaatcactgtaaggttttggtgaaagtgctggatgtaaatgataatyctccagaactggcggtcacttcattgtatttgcctatcagagaggacgctccactcagcaccgtcatcgccctcatcaccgtgtctgaccgtgactcagg

SEQ ID NO: 4664 - DNA, 201 bp, Homo sapiens
gtggaggtggccgacgtgaatgacaacgcgcctgcgttcgcgcagcccgagtacacagtattcgtgaaggagaacaacccgccgggctgccacatcttcasggtgtctgcgcgggacgcggacgcgcaggagaacgcgctggtgtcctattcgctggtggaacggcgggtgggcgagcgcgcgctgtcgaactacgtgtca

SEQ ID NO: 4665 - DNA, 201 bp, Homo sapiens
gcgcgcatcccgttccgcgtggggctgtacacgggcgagatcagcacgactcgtgtcctggacgaggctgacttgtcgcgctaccgccttctggtgctagygaaggatcacggtgagccggcgctgacagccacggccactgtgcttgtatctctggtggagagcggccaggcgccaaaggcgtcttcgcgggcgtcggtg

SEQ ID NO: 4666 - DNA, 201 bp, Homo sapiens
tgcagccggcagcaggcggcgcgcgcatcccgttccgcgtggggctgtacacgggcgagatcagcacgactcgtgtcctggacgaggctgacttgtcgcgrtaccgccttctggtgctagtgaaggatcacggtgagccggcgctgacagccacggccactgtgcttgtatctctggtggagagcggccaggcgccaaagg

SEQ ID NO: 4667 - DNA, 201 bp, Homo sapiens
cccactgtttgaccaggccgtatacagagtccacttgttagagactacagcaaatggaacattagtgaccacattaaatgcctctgatgctgacgaaggtrtaaatggtgaagtcgtcttttcctttgacagtggtatttctcgtgacattcaagaaaaattcaaagttgattccagctcaggagaaattaggttaattga

SEQ ID NO: 4668 - DNA, 201 bp, Homo sapiens
tgtcgcgggcccagaggcggcgctggtggatgtcaacgtgtacctgatcatcgccatctgcgcggtgtccagcctgctggtgctcacactgctgctgtacycggcgctgcggtgctcagtgccgcccactgagggtgcgtgtgtgccgggcaagcccactctggtgtgctccagcgcgttggggagctggtcgaactcaca

SEQ ID NO: 4669 - DNA, 201 bp, Homo sapiens
ggacgggggctcgccttcgctgtgggccacggccagggtgtccgtggaggtggccgacgtgaatgacaacgcgcctgcgttcgcgcagcccgagtacacartattcgtgaaggagaacaacccgccgggctgccacatcttcacggtgtctgcgcgggacgcggacgcgcaggagaacgcgctggtgtcctattcgctggt

SEQ ID NO: 4670 - DNA, 201 bp, Homo sapiens
ggacagcgccctggatcgcgagagcctgtcggtctatgagctggtggtgaccgcgcgggacgggggctcgccttcgctgtgggccacggccagggtgtccytggaggtggccgacgtgaatgacaacgcgcctgcgttcgcgcagcccgagtacacagtattcgtgaaggagaacaacccgccgggctgccacatcttcac

SEQ ID NO: 4671 - DNA, 201 bp, Homo sapiens
tcatcgccctcatcaccgtgtctgaccgtgactcaggtgccaacgggcaggtgacttgctccttaatgccccacgtccccttcaagctggtgtccaccttsaagaattactactcgttggtgttggacagcgccctggatcgcgagagcctgtcggtctatgagctggtggtgaccgcgcgggacgggggctcgccttcgc

SEQ ID NO: 4672 - DNA, 201 bp, Homo sapiens
tccgatgtcaaatcactgtaaggttttggtgaaagtgctggatgtaaatgataatgctccagaactggcggtcacttcattgtatttgcctatcagagagmacgctccactcagcaccgtcatcgccctcatcaccgtgtctgaccgtgactcaggtgccaacgggcaggtgacttgctccttaatgccccacgtcccctt

SEQ ID NO: 4673 - DNA, 201 bp, Homo sapiens
gaggctgacttgtcgcgctaccgccttctggtgctagtgaaggatcacggtgagccggcgctgacagccacggccactgtgcttgtatctctggtggagakcggccaggcgccaaaggcgtcttcgcgggcgtcggtgggtgtcgcgggcccagaggcggcgctggtggatgtcaacgtgtacctgatcatcgccatctgc

SEQ ID NO: 4674 - DNA, 201 bp, Homo sapiens
cagccggcagcaggcggcgcgcgcatcccgttccgcgtggggctgtacacgggcgagatcagcacgactcgtgtcctggacgaggctgacttgtcgcgctrccgccttctggtgctagtgaaggatcacggtgagccggcgctgacagccacggccactgtgcttgtatctctggtggagagcggccaggcgccaaaggcg

SEQ ID NO: 4675 - DNA, 201 bp, Homo sapiens
ggtgtcctactcgctggtggagcggcggttgggcgaccgcgcgctgtcgagctacgtgtcggtgcacgcggagagcggcaaggtgtacgcgctgcagccgytggaccacgaggagctggagctgctacagttccaggtgagcgcgcgcgatgcgggcgtgccgcctctgagcagcaacgtgacgctgcaggtgttcgtgct

SEQ ID NO: 4676 - DNA, 201 bp, Homo sapiens
cgttggtggagagcggacaggcgccaaaggcctcttcccggactttggcgggcgccgcgagcccagaggctgcgctggtggatgtcaacgtgtacctgatmatcgccatctgcgtggtgtccagcctcctggtactcacgctgctgctgtatacggcgctgtggtggtcggcaacgcccactgagggcgcgtgcgcgccgg

SEQ ID NO: 4677 - DNA, 201 bp, Homo sapiens
acggtcattgccctgatcagcgtgtctgaccgtgactcaggtgtcaacggacaggtgacctgctcgctgacgccccacgttcccttcaagctggtgtccaycttcaagaattactactcgttggtgctggacagcgccctggaccgcgagaacgtgtgggcctatgaactggtggtgactgcgcgggatgggggttcgcct

SEQ ID NO: 4678 - DNA, 201 bp, Homo sapiens
cagtgaggcacttccatacaaaggaactccatcataccggatgccaccgtttaaggatcctttgaaacttcttaagaattcaacgagatttttaacctgaractgaagaatctggtactgtaagtgtaaagaagcttattttggaagccaatttcgtatgcgatgtttggttttcagagaaggggattgggcaccccacga

SEQ ID NO: 4679 - DNA, 201 bp, Homo sapiens
tggtaaatgcagtgcacagtactcacagttttaggcgcaaggtgtcgctctttacttggtggaaagttcatttaaaggttggtctgaacagtgaggcactyccatacaaaggaactccatcataccggatgccaccgtttaaggatcctttgaaacttcttaagaattcaacgagatttttaacctgaaactgaagaatct

SEQ ID NO: 4680 - DNA, 201 bp, Homo sapiens
tcccagtacgagaggacgctcagcccagcacggtcattgccctgatcagcgtgtctgaccgtgactcaggtgtcaacggacaggtgacctgctcgctgacsccccacgttcccttcaagctggtgtccaccttcaagaattactactcgttggtgctggacagcgccctggaccgcgagaacgtgtgggcctatgaactgg

SEQ ID NO: 4681 - DNA, 201 bp, Homo sapiens
gccggcactgctggcgactcaggctggcagcgcgggaggcgcagttaacaagctagtaccgcggtcggtgggtgcgggccacgtggtggcgaaggtgcgckcagtggatgcggactcaggctacaacgcgtggctttcatatgaattgcagccggcggcgggcggctcgcgcatcccgttccgcgtggggctgtacacggg

SEQ ID NO: 4682 - DNA, 201 bp, Homo sapiens
ccggggaagcccacgctggtgtgctcccgcgcggtggggagctggtcatactcgcagcagaggcggcagagggtgtgctctgaggagggcccacctaagasggacctcatggccttcagccccagtcttcctctaggtctgaataaagaggaggaaggggaaagacaggagccagggtcaaatcaccccggacaggtgagt

SEQ ID NO: 4683 - DNA, 201 bp, Homo sapiens
gaaggggattgggcaccccacgactacagctctggcttctcctcctcgaattctgggaggtggggagcggccagctccactactccgtctcggaggaggcyaaacacggcaccttcgtgggccgcatcgcgcaggacctggggctggagctggcggagctggtgcagcgcctgttccgggtggcgtccaaaacacatgggg

SEQ ID NO: 4684 - DNA, 201 bp, Homo sapiens
gtacagtctgggtggaaatcttggacaccaacgataactctcctgaagtcgccgtgacttccttgtccctcccagtacgagaggacgctcagcccagcacsgtcattgccctgatcagcgtgtctgaccgtgactcaggtgtcaacggacaggtgacctgctcgctgacgccccacgttcccttcaagctggtgtccacct

SEQ ID NO: 4685 - DNA, 201 bp, Homo sapiens
gtgccctggacgaggcagactcgccgcgccaccgacttctagtactggtgaaggatcacggtgagccggcgctgacggccacggccaccgtgctggtgtcrttggtggagagcggacaggcgccaaaggcctcttcccggactttggcgggcgccgcgagcccagaggctgcgctggtggatgtcaacgtgtacctgatca

SEQ ID NO: 4686 - DNA, 201 bp, Homo sapiens; identical to SEQ ID NO: 4456

SEQ ID NO: 4687 - DNA, 201 bp, Homo sapiens; identical to SEQ ID NO: 4448

SEQ ID NO: 4688 - DNA, 201 bp, Homo sapiens; identical to SEQ ID NO: 4473

SEQ ID NO: 4689 - DNA, 201 bp, Homo sapiens; identical to SEQ ID NO: 4459

SEQ ID NO: 4690 - DNA, 201 bp, Homo sapiens; identical to SEQ ID NO: 4675

SEQ ID NO: 4691 - DNA, 201 bp, Homo sapiens; identical to SEQ ID NO: 4676

SEQ ID NO: 4692 - DNA, 201 bp, Homo sapiens; identical to SEQ ID NO: 4677

SEQ ID NO: 4693 - DNA, 201 bp, Homo sapiens; identical to SEQ ID NO: 4678

SEQ ID NO: 4694 - DNA, 201 bp, Homo sapiens; identical to SEQ ID NO: 4474

SEQ ID NO: 4695 - DNA, 201 bp, Homo sapiens; identical to SEQ ID NO: 4679

SEQ ID NO: 4696 - DNA, 201 bp, Homo sapiens; identical to SEQ ID NO: 4680

SEQ ID NO: 4697 - DNA, 201 bp, Homo sapiens; identical to SEQ ID NO: 4681

SEQ ID NO: 4698 - DNA, 201 bp, Homo sapiens
ccggggaagcccacgctggtgtgctcccgcgcggtggggagctggtcatactcgcagcagaggcggcagagggtgtgctctgaggagggcccacctaagasggacctcatggccttcagccccagtcttcctctaggtctgaataaagaggaggaaggggaaagacaggagccagggtcaaatcaccccggacagccacga

SEQ ID NO: 4699 - DNA, 201 bp, Homo sapiens; identical to SEQ ID NO: 4683

SEQ ID NO: 4700 - DNA, 201 bp, Homo sapiens; identical to SEQ ID NO: 4684

SEQ ID NO: 4701 - DNA, 201 bp, Homo sapiens; identical to SEQ ID NO: 4685

SEQ ID NO: 4702 - DNA, 201 bp, Homo sapiens
ccctgagatagcactgacttccttatccttgcctgtacgtgaagacgctcaatttggtactgtcatcgccctaattagcgtgaacgacctcgattcaggtyccaacgggcaggtgaactgctcgctgacgcctcacgtccctttcaagctggtgtccaccttcaagaattactactcgttggtgctggacagtgccctgga

SEQ ID NO: 4703 - DNA, 201 bp, Homo sapiens
cagccgctggaccacgaggagctagagctgctgcagtttcaggtgagcgcgcgcgacgcgggcgtgccgcctctgggcagcaacgtgacgctgcaggtgtscgtgctggacgagaacgacaacgcgccggcgctgctggcgcctcgggtgggtggtactggtggtgcagtgagcgagctggtgccgcggtcactgggtgca

SEQ ID NO: 4704 - DNA, 201 bp, Homo sapiens
ccacatcttcacggtgtctgcgcgagacgcggacgcgcaggagaacgcgctggtgtcctactcgctggtggagcggcgggtgggcgagcgcgcgttgtcgmgctacatttcggtgcacgcggagagcggcaaggtgtacgcgctgcagccgctggaccacgaggagctagagctgctgcagtttcaggtgagcgcgcgcga

SEQ ID NO: 4705 - DNA, 201 bp, Homo sapiens
tcccatggcgggtcattgcaccgttttagtgagaattttggataaaaatgataacgtccctgagatagcactgacttccttatccttgcctgtacgtgaayacgctcaatttggtactgtcatcgccctaattagcgtgaacgacctcgattcaggtgccaacgggcaggtgaactgctcgctgacgcctcacgtcccttt

SEQ ID NO: 4706 - DNA, 201 bp, Homo sapiens
tcaggtgagcgcgcgcgacgcgggcgtgccgcctctgggcagcaacgtgacgctgcaggtgttcgtgctggacgagaacgacaacgcgccggcgctgctgkcgcctcgggtgggtggtactggtggtgcagtgagcgagctggtgccgcggtcactgggtgcaggccaagtggtggcgaaggtgcgcgcagtggacgccga

SEQ ID NO: 4707 - DNA, 201 bp, Homo sapiens
ttccttatccttgcctgtacgtgaagacgctcaatttggtactgtcatcgccctaattagcgtgaacgacctcgattcaggtgccaacgggcaggtgaacmgctcgctgacgcctcacgtccctttcaagctggtgtccaccttcaagaattactactcgttggtgctggacagtgccctggaccgcgagagcgtgtcggc

SEQ ID NO: 4708 - DNA, 201 bp, Homo sapiens
gcaggagaacgcgctggtgtcctactcgctggtggagcggcgggtgggcgagcgcgcgttgtcgagctacatttcggtgcacgcggagagcggcaaggtgmacgcgctgcagccgctggaccacgaggagctagagctgctgcagtttcaggtgagcgcgcgcgacgcgggcgtgccgcctctgggcagcaacgtgacgct

SEQ ID NO: 4709 - DNA, 201 bp, Homo sapiens
cttattcctgacagccacagatgggggcaaacctgagctcacaggcactgttcagctgctggtcacagtgctggatgtgaatgataatgctcccactttcsaacagtctgaatacgaagtaagaatattcgaaaatgcagacaacggaacaacagttatcagactgaatgcttctgatcgggatgaaggagcgaatggggc

SEQ ID NO: 4710 - DNA, 201 bp, Homo sapiens
gctgtgggccaccgccagcttgtctgtggaggtggccgacatgaatgacaatgctccggcgttcgcgcagcccgagtacacagtgttcgtgaaggagaacracccgccgggctgccacatcttcacggtgtctgcgcgagacgcggacgcgcaggagaacgcgctggtgtcctactcgctggtggagcggcgggtgggcga

SEQ ID NO: 4711 - DNA, 201 bp, Homo sapiens
gaatggcattttgtttgtgaattctcggatcgaccgcgaggagctgtgcgggcggagcgcggagtgcagcatccacctggaggtgatcgtggacaggccgrtgcaggttttccatgtggacgtggaggtgagggacattaacgacaacccgcccttgttcccggtagaggaacaaagagtgctgatttacgaatctaggct

SEQ ID NO: 4712 - DNA, 201 bp, Homo sapiens
agatcgaaatacgggagaaatagtgattcggggtaatttggattttgaacaagaaaacttatacaaaatcctcattgacgccacggacaaaggccatcctrccatggcgggtcattgcaccgttttagtgagaattttggataaaaatgataacgtccctgagatagcactgacttccttatccttgcctgtacgtgaaga

SEQ ID NO: 4713 - DNA, 201 bp, Homo sapiens
ccacggacaaaggccatcctcccatggcgggtcattgcaccgttttagtgagaattttggataaaaatgataacgtccctgagatagcactgacttccttmtccttgcctgtacgtgaagacgctcaatttggtactgtcatcgccctaattagcgtgaacgacctcgattcaggtgccaacgggcaggtgaactgctcgc

SEQ ID NO: 4714 - DNA, 201 bp, Homo sapiens
acaaattgggctcttattaaagaaatccttggacagagaggaagctcctgcacacaacttattcctgacagccacagatgggggcaaacctgagctcacaygcactgttcagctgctggtcacagtgctggatgtgaatgataatgctcccactttcgaacagtctgaatacgaagtaagaatattcgaaaatgcagacaa

SEQ ID NO: 4715 - DNA, 201 bp, Homo sapiens
tgcagtgagcgagctggtgccgcggtcactgggtgcaggccaagtggtggcgaaggtgcgcgcagtggacgccgactcaggctacaacgcgtggctttcgratgagctgcagcccccggcaagcagcgctcgcttcccgtttcgcgtggggctgtacacgggcgagatcagcaccactcgtgtcctggacgaagcggactc

SEQ ID NO: 4716 - DNA, 201 bp, Homo sapiens; identical to SEQ ID NO: 4456

SEQ ID NO: 4717 - DNA, 201 bp, Homo sapiens
cttcaagaattactactcgttggtgttggacagcgccctggatcgcgagagcctgtcggtctatgagctggtggtgaccgcgcgggacgggggctcgcctycgctgtgggccacggccagggtgtccgtggaggtggccgacgtgaatgacaacgcgcctgcgttcgcgcagcccgagtacacagtattcgtgaaggagaa

SEQ ID NO: 4718 - DNA, 201 bp, Homo sapiens
ttgctgcagttccaggtgagcgcgcgggatgcgggcgtgccgcctctgggcagcaacgtgacgctgcaggtgttcgtgctggacgagaacgacaacgcgcsggcgctgctggcgcctcgagtgggtggcactattggtgcagtcagtgagctggtgccgcgattggtgggtgcgggtcatgtggtggcgaaggtgcgcgca

SEQ ID NO: 4719 - DNA, 201 bp, Homo sapiens
tgcgcggtgtccagcctgctggtgctcacactgctgctgtacacggcgctgcggtgctcagtgccgcccactgagggtgcgtgtgtgccgggcaagcccaytctggtgtgctccagcgcgttggggagctggtcgaactcacagcagaggcggcagagggtgttctctagcgagggcccacccaagaccgacctcatggcc

SEQ ID NO: 4720 - DNA, 201 bp, Homo sapiens; identical to SEQ ID NO: 4459

SEQ ID NO: 4721 - DNA, 201 bp, Homo sapiens
tgtacctgatcatcgccatctgcgcggtgtccagcctgctggtgctcacactgctgctgtacacggcgctgcggtgctcagtgccgcccactgagggtgcrtgtgtgccgggcaagcccactctggtgtgctccagcgcgttggggagctggtcgaactcacagcagaggcggcagagggtgttctctagcgagggcccac

SEQ ID NO: 4722 - DNA, 201 bp, Homo sapiens
aagtcctccgatgtcaaatcactgtaaggttttggtgaaagtgctggatgtaaatgataatgctccagaactggcggtcacttcattgtatttgcctatcrgagaggacgctccactcagcaccgtcatcgccctcatcaccgtgtctgaccgtgactcaggtgccaacgggcaggtgacttgctccttaatgccccacgt

SEQ ID NO: 4723 - DNA, 201 bp, Homo sapiens
cctgagagaagacagaaacggtaaagagataaatgattggaaatattagataaaatggcatgattttgaagtaagaggagagcataagaaaggtgtagtcyttttgcaatggtgttttctaggagagggggcctgggagcccgggatctgcttctttggcttctgctcctcgcagcctgggaggtggggagcggccagctc

SEQ ID NO: 4724 - DNA, 201 bp, Homo sapiens
caaggtgtacgcactgcagcccctggaccacgaggagctggagttgctgcagttccaggtgagcgcgcgggatgcgggcgtgccgcctctgggcagcaacrtgacgctgcaggtgttcgtgctggacgagaacgacaacgcgccggcgctgctggcgcctcgagtgggtggcactattggtgcagtcagtgagctggtgcc

SEQ ID NO: 4725 - DNA, 201 bp, Homo sapiens
acggcgggtgggcgagcgcgcgctgtcgaactacgtgtcagtgcacgcggagagcggcaaggtgtacgcactgcagcccctggaccacgaggagctggagytgctgcagttccaggtgagcgcgcgggatgcgggcgtgccgcctctgggcagcaacgtgacgctgcaggtgttcgtgctggacgagaacgacaacgcgcc

SEQ ID NO: 4726 - DNA, 201 bp, Homo sapiens
tcgcgcagcccgagtacacagtattcgtgaaggagaacaacccgccgggctgccacatcttcacggtgtctgcgcgggacgcggacgcgcaggagaacgcsctggtgtcctattcgctggtggaacggcgggtgggcgagcgcgcgctgtcgaactacgtgtcagtgcacgcggagagcggcaaggtgtacgcactgcagc

SEQ ID NO: 4727 - DNA, 201 bp, Homo sapiens
cgagagcctgtcggtctatgagctggtggtgaccgcgcgggacgggggctcgccttcgctgtgggccacggccagggtgtccgtggaggtggccgacgtgmatgacaacgcgcctgcgttcgcgcagcccgagtacacagtattcgtgaaggagaacaacccgccgggctgccacatcttcacggtgtctgcgcgggacgc

SEQ ID NO: 4728 - DNA, 201 bp, Homo sapiens
tacctgatcatcgccatctgcgcggtgtccagcctgctggtgctcacactgctgctgtacacggcgctgcggtgctcagtgccgcccactgagggtgcgtrtgtgccgggcaagcccactctggtgtgctccagcgcgttggggagctggtcgaactcacagcagaggcggcagagggtgttctctagcgagggcccaccc

SEQ ID NO: 4729 - DNA, 110 bp, Homo sapiens
attgcagacrgatatagattgcattttgaaaatcaacgaatggatctaaaatttacattggccacatgatgtcgctgtacaccacaaagtcttgtcaatagaagggagct

SEQ ID NO: 4730 - DNA, 201 bp, Homo sapiens; identical to SEQ ID NO: 4448

SEQ ID NO: 4731 - DNA, 201 bp, Homo sapiens
gacgcggacgcgcaggagaacgcgctggtgtcctattcgctggtggaacggcgggtgggcgagcgcgcgctgtcgaactacgtgtcagtgcacgcggagarcggcaaggtgtacgcactgcagcccctggaccacgaggagctggagttgctgcagttccaggtgagcgcgcgggatgcgggcgtgccgcctctgggcagc

SEQ ID NO: 4732 - DNA, 201 bp, Homo sapiens; identical to SEQ ID NO: 4473

SEQ ID NO: 4733 - DNA, 127 bp, Homo sapiens
attgcagacagatatagattgcatttkgaaaatcaacgaatggatctaaaatttacattggccacatgatgtcgctgtacaccacaaagtcttgtcaatagaagggagctactgatcactaaaagtg

SEQ ID NO: 4734 - DNA, 104 bp, Homo sapiens
attrcagacagatatagattgcattttgaaaatcaacgaatggatctaaaatttacattggccacatgatgtcgctgtacaccacaaagtcttgtcaatagaag

SEQ ID NO: 4735 - DNA, 201 bp, Homo sapiens; identical to SEQ ID NO: 4474

SEQ ID NO: 4736 - DNA, 151 bp, Homo sapiens
attgcagacagatatagattgcattttgaaaatcaacgaatggatctaaartttacattggccacatgatgtcgctgtacaccacaaagtcttgtcaatagaagggagctactgatcactaaaagtgaaggaggaagctccattttgtcac

SEQ ID NO: 4737 - DNA, 201 bp, Homo sapiens
ccgcccactgagggtgcgtgtgtgccgggcaagcccactctggtgtgctccagcgcgttggggagctggtcgaactcacagcagaggcggcagagggtgtkctctagcgagggcccacccaagaccgacctcatggccttcagcccaggcctatctccaagtcttaacacgtcagaaagaaatgaacaaccagaagcaaat

SEQ ID NO: 4738 - DNA, 201 bp, Homo sapiens; identical to SEQ ID NO: 4436

SEQ ID NO: 4739 - DNA, 201 bp, Homo sapiens; identical to SEQ ID NO: 4432

SEQ ID NO: 4740 - DNA, 201 bp, Homo sapiens; identical to SEQ ID NO: 4426

SEQ ID NO: 4741 - DNA, 145 bp, Homo sapiens; identical to SEQ ID NO: 4438

SEQ ID NO: 4742 - DNA, 201 bp, Homo sapiens; identical to SEQ ID NO: 4429

SEQ ID NO: 4743 - DNA, 201 bp, Homo sapiens; identical to SEQ ID NO: 4437

SEQ ID NO: 4744 - DNA, 201 bp, Homo sapiens; identical to SEQ ID NO: 4439

SEQ ID NO: 4745 - DNA, 201 bp, Homo sapiens; identical to SEQ ID NO: 4433

SEQ ID NO: 4746 - DNA, 201 bp, Homo sapiens; identical to SEQ ID NO: 4428

SEQ ID NO: 4747 - DNA, 201 bp, Homo sapiens; identical to SEQ ID NO: 4440

SEQ ID NO: 4748 - DNA, 201 bp, Homo sapiens; identical to SEQ ID NO: 4441

SEQ ID NO: 4749 - DNA, 201 bp, Homo sapiens; identical to SEQ ID NO: 4435

SEQ ID NO: 4750 - DNA, 201 bp, Homo sapiens; identical to SEQ ID NO: 4492

SEQ ID NO: 4751 - DNA, 201 bp, Homo sapiens; identical to SEQ ID NO: 4493

SEQ ID NO: 4752 - DNA, 201 bp, Homo sapiens; identical to SEQ ID NO: 4494

SEQ ID NO: 4753 - DNA, 201 bp, Homo sapiens; identical to SEQ ID NO: 4495

SEQ ID NO: 4754 - DNA, 201 bp, Homo sapiens; identical to SEQ ID NO: 4496

SEQ ID NO: 4755 - DNA, 201 bp, Homo sapiens; identical to SEQ ID NO: 4497

SEQ ID NO: 4756 - DNA, 201 bp, Homo sapiens; identical to SEQ ID NO: 4500

SEQ ID NO: 4757 - DNA, 201 bp, Homo sapiens; identical to SEQ ID NO: 4501

SEQ ID NO: 4758 - DNA, 201 bp, Homo sapiens; identical to SEQ ID NO: 4448

SEQ ID NO: 4759 - DNA, 201 bp, Homo sapiens; identical to SEQ ID NO: 4502

SEQ ID NO: 4760 - DNA, 201 bp, Homo sapiens; identical to SEQ ID NO: 4503

SEQ ID NO: 4761 - DNA, 201 bp, Homo sapiens; identical to SEQ ID NO: 4504

SEQ ID NO: 4762 - DNA, 201 bp, Homo sapiens; identical to SEQ ID NO: 4505

SEQ ID NO: 4763 - DNA, 201 bp, Homo sapiens; identical to SEQ ID NO: 4506

SEQ ID NO: 4764 - DNA, 201 bp, Homo sapiens; identical to SEQ ID NO: 4510

SEQ ID NO: 4765 - DNA, 201 bp, Homo sapiens; identical to SEQ ID NO: 4509

SEQ ID NO: 4766 - DNA, 201 bp, Homo sapiens; identical to SEQ ID NO: 4508

SEQ ID NO: 4767 - DNA, 201 bp, Homo sapiens; identical to SEQ ID NO: 4456

SEQ ID NO: 4768 - DNA, 201 bp, Homo sapiens; identical to SEQ ID NO: 4513

SEQ ID NO: 4769 - DNA, 201 bp, Homo sapiens; identical to SEQ ID NO: 4514

SEQ ID NO: 4770 - DNA, 201 bp, Homo sapiens; identical to SEQ ID NO: 4515

SEQ ID NO: 4771 - DNA, 201 bp, Homo sapiens; identical to SEQ ID NO: 4516

SEQ ID NO: 4772 - DNA, 201 bp, Homo sapiens; identical to SEQ ID NO: 4517

SEQ ID NO: 4773 - DNA, 201 bp, Homo sapiens; identical to SEQ ID NO: 4518

SEQ ID NO: 4774 - DNA, 201 bp, Homo sapiens; identical to SEQ ID NO: 4459

SEQ ID NO: 4775 - DNA, 201 bp, Homo sapiens; identical to SEQ ID NO: 4519

SEQ ID NO: 4776 - DNA, 201 bp, Homo sapiens; identical to SEQ ID NO: 4520

SEQ ID NO: 4777 - DNA, 201 bp, Homo sapiens; identical to SEQ ID NO: 4521

SEQ ID NO: 4778 - DNA, 201 bp, Homo sapiens; identical to SEQ ID NO: 4522

SEQ ID NO: 4779 - DNA, 201 bp, Homo sapiens; identical to SEQ ID NO: 4523

SEQ ID NO: 4780 - DNA, 201 bp, Homo sapiens; identical to SEQ ID NO: 4524

SEQ ID NO: 4781 - DNA, 201 bp, Homo sapiens; identical to SEQ ID NO: 4525

SEQ ID NO: 4782 - DNA, 201 bp, Homo sapiens; identical to SEQ ID NO: 4526

SEQ ID NO: 4783 - DNA, 201 bp, Homo sapiens; identical to SEQ ID NO: 4473

SEQ ID NO: 4784 - DNA, 201 bp, Homo sapiens; identical to SEQ ID NO: 4527

SEQ ID NO: 4785 - DNA, 201 bp, Homo sapiens; identical to SEQ ID NO: 4528

SEQ ID NO: 4786 - DNA, 201 bp, Homo sapiens; identical to SEQ ID NO: 4474

SEQ ID NO: 4787 - DNA, 201 bp, Homo sapiens; identical to SEQ ID NO: 4529

SEQ ID NO: 4788 - DNA, 201 bp, Homo sapiens; identical to SEQ ID NO: 4530

SEQ ID NO: 4789 - DNA, 201 bp, Homo sapiens; identical to SEQ ID NO: 4531

SEQ ID NO: 4790 - DNA, 201 bp, Homo sapiens; identical to SEQ ID NO: 4456

SEQ ID NO: 4791 - DNA, 201 bp, Homo sapiens; identical to SEQ ID NO: 4448

SEQ ID NO: 4792 - DNA, 201 bp, Homo sapiens; identical to SEQ ID NO: 4473

SEQ ID NO: 4793 - DNA, 201 bp, Homo sapiens
attgtacccttttggtggaagtactagatgtaaatgataacgccccagaggttaccatcacttctttgtcactccccatcagagaagacactcagcctagmgccattattgccctaatcagtgtgtccgatcgtgactctggctcaaatggacaggtcacctgcaccttgacgccgcatgtccccttcaagctggtgtcca

SEQ ID NO: 4794 - DNA, 201 bp, Homo sapiens; identical to SEQ ID NO: 4459

SEQ ID NO: 4795 - DNA, 201 bp, Homo sapiens
tggacgcacaaaacagtcttgagcaaatgtcttcattatcacttgtactgaggaaaacactggacagagaggaaattcaggaacatagtttattactgacwgccagtgatggaggtaaacccgagctgactggcacagttcagctgctcatcacgattctggacgtgaatgacaacgccccggaattttaccaatccgttt

SEQ ID NO: 4796 - DNA, 201 bp, Homo sapiens; identical to SEQ ID NO: 4474

SEQ ID NO: 4797 - DNA, 201 bp, Homo sapiens
tgcaggtgttcgtgctggacgagaacgacaacgctccggcgctgctgacgcccggggctggcagcgcgggaggcacagtgagcgagctgatgccgcggtckgtgggtgcaggccacgtggtggcgaaggtgcgcgcggtggacgccgattcgggctacaatgcgtggctttcgtatgaattgcagctggcggcggtcggcg

SEQ ID NO: 4798 - DNA, 201 bp, Homo sapiens
ccgacgtgaacgacaacgcgccggcgttcgcgcagcccgagtacacggtgttcgtgaaggaaaacaatccgccgggctgccacatcttcacggtgtctgckcaggacgcggacgcacaggagaacgcgctggtctcctactcgctggtggagcggcgggtgggcgagcgtgcgctgtcgagctacgtgtcggtgcacgcgg

SEQ ID NO: 4799 - DNA, 201 bp, Homo sapiens
tcacgttgctgctgtatactgcgctgcggtgctcggcaccgcccaccgagggcgcgtgcgcgccgggcaagcccactctagtgtgctccagcgcggcaggsagttggtcgtactcgcagcagaggcggccgagggtgtgctctggggagggcccgcataagacggacctcatggccttcagtcccagccttcctccttgtc

SEQ ID NO: 4800 - DNA, 201 bp, Homo sapiens; identical to SEQ ID NO: 4456

SEQ ID NO: 4801 - DNA, 201 bp, Homo sapiens; identical to SEQ ID NO: 4459

SEQ ID NO: 4802 - DNA, 201 bp, Homo sapiens
gatgccatggataaaagtacattcccattatcaggacactgtaaagtagtagtgaaactcctggatgtgaatgataataccccagagatggccataaccamccttttcctgcctgtcaaagaggacgctccactcagcacggtcattgctctgatcagcgtgtctgaccgtgactcaggtgccaacgggcaggtgacctgc

SEQ ID NO: 4803 - DNA, 151 bp, Homo sapiens
gaaaggaaaagaaccttccatttttggctgtgccaagaagctcagaaaggygataatataaaaaatatatagttaattgggaattgaatttacaaaatacattgtgtggtgatgcaatagaaagctcataattggaacgagattgagatgg

SEQ ID NO: 4804 - DNA, 179 bp, Homo sapiens
gaaaggaaaagaaccttccatttttggctgtgccaagaagctcagaaaggtgataatataaaaaatatatagttaattsggaattgaatttacaaaatacattgtgtggtgatgcaatagaaagctcataattggaacgagattgagatggtatattcccggagaggaagtctgggatc

SEQ ID NO: 4805 - DNA, 201 bp, Homo sapiens
tcaagctggtgtccaccttcaagaattactactcgttggtgctggacagcgccctggaccgcgagagcgtgtcggtctatgagctggtggtgaccgcgcgrgacgggggctcgccttcgctgtgggccaccgccagcgtgtctgtggaagtggccgacgtgaacgacaacgctccggcgttcgcgcagccccagtataccg

SEQ ID NO: 4806 - DNA, 201 bp, Homo sapiens
tggctgtgccaagaagctcagaaaggtgataatataaaaaatatatagttaattgggaattgaatttacaaaatacattgtgtggtgatgcaatagaaagytcataattggaacgagattgagatggtatattcccggagaggaagtctgggatcccggctcctgctgctctggcttctcctcgcctactggaaggcaggg

SEQ ID NO: 4807 - DNA, 201 bp, Homo sapiens
ctgacagccacagccacagtgctggtgtcgctggtggaaagtggccaggcgccgaaggcctcatcgcgggcgtcggcgggcgctgtgggtcccgaggctgycctggtggatgtcaacgtgtacctgatcatcgccatctgtgcggtgtccagcctgctggtgctcacgctgctgctgtacaccgcgctgcggtgctcggcg

SEQ ID NO: 4808 - DNA, 201 bp, Homo sapiens
tgtggtgatgcaatagaaagctcataattggaacgagattgagatggtatattcccggagaggaagtctgggatcccggctcctgctgctctggcttctcytcgcctactggaaggcagggagcggccagctccactactcgatcccggaggaagccaaacacggaaccttcgttggccgcatcgcgcaggacctagggct

SEQ ID NO: 4809 - DNA, 201 bp, Homo sapiens
acgcgccggcgctgctggtgcctcgagtgggtggcaccggcggcgcagtgagcgagctggtgccgaggtcagtgggtgcgggccacgtggtggcgaaggtrcgcgcagtggaccctgattcgggctacaacgcttggctttcgtatgagctgcagccagcgcctggcagtgcgcgcatcccgttccgcgtggggctgtaca

SEQ ID NO: 4810 - DNA, 201 bp, Homo sapiens
agagggcgcgtcggatttggatattggagcaaatgcacaattgagatacaggttaaatccaaacgaatattttgacttagatgttaaaacaaatgaagaaraaacgaactttttagagctggttttgaggaaatccttagatagagaagaaacacaagaacaccgtttattagtgattgcaactgatggaggaaaacccga

SEQ ID NO: 4811 - DNA, 201 bp, Homo sapiens
tggtgatgcaatagaaagctcataattggaacgagattgagatggtatattcccggagaggaagtctgggatcccggctcctgctgctctggcttctcctygcctactggaaggcagggagcggccagctccactactcgatcccggaggaagccaaacacggaaccttcgttggccgcatcgcgcaggacctagggctgg

SEQ ID NO: 4812 - DNA, 201 bp, Homo sapiens
agttcagttgttgatcaatgtattggatgctaatgataacgccccagaatttgataaatccatttataatgtcagattgttggaaaatgcaccaagtgggrcattagttattaaactgaacgcctcagatgcagatgagggcatcaataaggaaatagtgtatttctttagtaatcttgttcttgacgatgtaaagtccaa

SEQ ID NO: 4813 - DNA, 106 bp, Homo sapiens
gaaagraaaagaaccttccatttttggctgtgccaagaagctcagaaaggtgataatataaaaaatatatagttaattgggaattgaatttacaaaatacattgtg

SEQ ID NO: 4814 - DNA, 201 bp, Homo sapiens
tgtcggtctatgagctggtggtgaccgcgcgggacgggggctcgccttcgctgtgggccaccgccagcgtgtctgtggaagtggccgacgtgaacgacaaygctccggcgttcgcgcagccccagtataccgtgttcgtgaaggagaacaacccgccaggctgccacatcttcacggtgtctgcacgggacgcggacgcgc

SEQ ID NO: 4815 - DNA, 201 bp, Homo sapiens; identical to SEQ ID NO: 4448

SEQ ID NO: 4816 - DNA, 201 bp, Homo sapiens
ccgtgttcgtgaaggagaacaacccgccaggctgccacatcttcacggtgtctgcacgggacgcggacgcgcaggagaacgccctggtgtcctactcgctkgtggagcggcgggtgggcgagcgcccgctgtcgagttacgtttcggtgcacgcggagagcggcaaggtgtacgcgctgcagccgctggaccacgaggaag

SEQ ID NO: 4817 - DNA, 201 bp, Homo sapiens
actcaggtgccaacgggcaggtgacctgctccctaatgccccacgttcccttcaagctggtgtccaccttcaagaattactactcgttggtgctggacagygccctggaccgcgagagcgtgtcggtctatgagctggtggtgaccgcgcgggacgggggctcgccttcgctgtgggccaccgccagcgtgtctgtggaag

SEQ ID NO: 4818 - DNA, 201 bp, Homo sapiens; identical to SEQ ID NO: 4473

SEQ ID NO: 4819 - DNA, 201 bp, Homo sapiens; identical to SEQ ID NO: 4474

SEQ ID NO: 4820 - DNA, 201 bp, Homo sapiens
attcaggtgccaacgggcaggtgaactgctcgctgacgcctcacgtccctttcaagctggtgtccaccttcaagaattactactcgttggtgctggacagygccctggaccgcgagagcgtgtcggcctatgagttggtggtaaccgcgcgggacgggggctcgccttcgctgtgggccaccgccagcttgtctgtggagg

SEQ ID NO: 4821 - DNA, 201 bp, Homo sapiens; identical to SEQ ID NO: 4456

SEQ ID NO: 4822 - DNA, 201 bp, Homo sapiens; identical to SEQ ID NO: 4459

SEQ ID NO: 4823 - DNA, 201 bp, Homo sapiens
gccatcctcccatggcgggtcattgcaccgttttagtgagaattttggataaaaatgataacgtccctgagatagcactgacttccttatccttgcctgtrcgtgaagacgctcaatttggtactgtcatcgccctaattagcgtgaacgacctcgattcaggtgccaacgggcaggtgaactgctcgctgacgcctcacg

SEQ ID NO: 4824 - DNA, 201 bp, Homo sapiens
agctcacaggcactgttcagctgctggtcacagtgctggatgtgaatgataatgctcccactttcgaacagtctgaatacgaagtaagaatattcgaaaaygcagacaacggaacaacagttatcagactgaatgcttctgatcgggatgaaggagcgaatggggcaatttcatattcttttaatagccttgttgcagcca

SEQ ID NO: 4825 - DNA, 201 bp, Homo sapiens
ggctttcgtatgagctgcagcccccggcaagcagcgctcgcttcccgtttcgcgtggggctgtacacgggcgagatcagcaccactcgtgtcctggacgargcggactctccgcgccaccggctgctggtgctggtgaaagaccacggtgagccggcgctgacagcgacggccacggttctggtgtcgctggtggagagtg

SEQ ID NO: 4826 - DNA, 201 bp, Homo sapiens; identical to SEQ ID NO: 4448

SEQ ID NO: 4827 - DNA, 201 bp, Homo sapiens; identical to SEQ ID NO: 4473

SEQ ID NO: 4828 - DNA, 201 bp, Homo sapiens
gcaggtgttcgtgctggacgagaacgacaacgcgccggcgctgctggcgcctcgggtgggtggtactggtggtgcagtgagcgagctggtgccgcggtcastgggtgcaggccaagtggtggcgaaggtgcgcgcagtggacgccgactcaggctacaacgcgtggctttcgtatgagctgcagcccccggcaagcagcgc

SEQ ID NO: 4829 - DNA, 201 bp, Homo sapiens
cgttgtcgagctacatttcggtgcacgcggagagcggcaaggtgtacgcgctgcagccgctggaccacgaggagctagagctgctgcagtttcaggtgagmgcgcgcgacgcgggcgtgccgcctctgggcagcaacgtgacgctgcaggtgttcgtgctggacgagaacgacaacgcgccggcgctgctggcgcctcggg

SEQ ID NO: 4830 - DNA, 201 bp, Homo sapiens
tacgtgaagacgctcaatttggtactgtcatcgccctaattagcgtgaacgacctcgattcaggtgccaacgggcaggtgaactgctcgctgacgcctcaygtccctttcaagctggtgtccaccttcaagaattactactcgttggtgctggacagtgccctggaccgcgagagcgtgtcggcctatgagttggtggtaa

SEQ ID NO: 4831 - DNA, 201 bp, Homo sapiens
cgctgctggcgcctcgggtgggtggtactggtggtgcagtgagcgagctggtgccgcggtcactgggtgcaggccaagtggtggcgaaggtgcgcgcagtkgacgccgactcaggctacaacgcgtggctttcgtatgagctgcagcccccggcaagcagcgctcgcttcccgtttcgcgtggggctgtacacgggcgaga

SEQ ID NO: 4832 - DNA, 201 bp, Homo sapiens
aggtgaactgctcgctgacgcctcacgtccctttcaagctggtgtccaccttcaagaattactactcgttggtgctggacagtgccctggaccgcgagagmgtgtcggcctatgagttggtggtaaccgcgcgggacgggggctcgccttcgctgtgggccaccgccagcttgtctgtggaggtggccgacatgaatgaca

SEQ ID NO: 4833 - DNA, 201 bp, Homo sapiens
gcaaggtgtacgcgctgcagccgctggaccacgaggagctagagctgctgcagtttcaggtgagcgcgcgcgacgcgggcgtgccgcctctgggcagcaamgtgacgctgcaggtgttcgtgctggacgagaacgacaacgcgccggcgctgctggcgcctcgggtgggtggtactggtggtgcagtgagcgagctggtgc

SEQ ID NO: 4834 - DNA, 201 bp, Homo sapiens
ccactttcgaacagtctgaatacgaagtaagaatattcgaaaatgcagacaacggaacaacagttatcagactgaatgcttctgatcgggatgaaggagcsaatggggcaatttcatattcttttaatagccttgttgcagccatggttattgaccactttagcatagatcgaaatacgggagaaatagtgattcggggta

SEQ ID NO: 4835 - DNA, 201 bp, Homo sapiens
aggagaacaacccgccgggctgccacatcttcacggtgtctgcgcgagacgcggacgcgcaggagaacgcgctggtgtcctactcgctggtggagcggcgrgtgggcgagcgcgcgttgtcgagctacatttcggtgcacgcggagagcggcaaggtgtacgcgctgcagccgctggaccacgaggagctagagctgctgc

SEQ ID NO: 4836 - DNA, 201 bp, Homo sapiens
acaggccgctgcaggttttccatgtggacgtggaggtgagggacattaacgacaacccgcccttgttcccggtagaggaacaaagagtgctgatttacgartctaggctgccagattctgtgtttccactggagggcgcgtccgatgcagatgttggctcaaattccatcttaacctataaactcagttctagcgaatact

SEQ ID NO: 4837 - DNA, 201 bp, Homo sapiens; identical to SEQ ID NO: 4474

SEQ ID NO: 4838 - DNA, 201 bp, Homo sapiens
acttccttatccttgcctgtacgtgaagacgctcaatttggtactgtcatcgccctaattagcgtgaacgacctcgattcaggtgccaacgggcaggtgamctgctcgctgacgcctcacgtccctttcaagctggtgtccaccttcaagaattactactcgttggtgctggacagtgccctggaccgcgagagcgtgtcg

SEQ ID NO: 4839 - DNA, 201 bp, Homo sapiens
tgcagactcaggctacaacgcgtggctttcgtatgagctgcagcctgggaccggcggtgcgcgcatcccgtttcgcgtggggctgtacacgggagagatckgcacgacccgtgccctggacgaggtggacgccccgcgccatcgcctactggtgctggtgaaggaccacggtgaaccctcattgaccgccacggccactgt

SEQ ID NO: 4840 - DNA, 201 bp, Homo sapiens
attatttactaataacagcaattgatggtgggaaaccagagctcactggcacgactcaactaaagatcactgttttagatgtaaacgacaacgccccagcytttgagaggacgatctataaagtcagattactcgaaaatgcaccaaatggtaccctagtggtgaccgttaacgccaccgatttggatgaaggagtaaata

SEQ ID NO: 4841 - DNA, 201 bp, Homo sapiens
gacaacgccccagcgtttgagaggacgatctataaagtcagattactcgaaaatgcaccaaatggtaccctagtggtgaccgttaacgccaccgatttggrtgaaggagtaaataaggatatcgcgtattctttcaatacggacatgtcagcagatattctgtcaaaattccatttagatccagtcaatggacaaatcagt

SEQ ID NO: 4842 - DNA, 201 bp, Homo sapiens
tattagaagactctccacttagcacagtcatcgccctgatcagcgtgtccgaccgcgactcaggagtcaatggacaggtcacctgctcgctgacgccccakgtccccttcaagctggtgtccaccttcaagaattactactcattggtgctggacagccctctggaccgcgagagcgtgtcggcctatgagctggtggtga

SEQ ID NO: 4843 - DNA, 201 bp, Homo sapiens
tctgtcaaaattccatttagatccagtcaatggacaaatcagtgtaaagggtaacatagatttcgaggaaagtaagtcatatgaaatccaggtagaagccycggataaaggaaatcccccaatgtcagatcactgcacagttctactcgaaattgtggacatcaatgataatgtacctgagttagttattcaatcactatc

SEQ ID NO: 4844 - DNA, 201 bp, Homo sapiens
aaataaggatatcgcgtattctttcaatacggacatgtcagcagatattctgtcaaaattccatttagatccagtcaatggacaaatcagtgtaaagggtracatagatttcgaggaaagtaagtcatatgaaatccaggtagaagccacggataaaggaaatcccccaatgtcagatcactgcacagttctactcgaaat

SEQ ID NO: 4845 - DNA, 201 bp, Homo sapiens
cctcgtcccaggcgtccgctggcgccacgggcccggaagctgcactggtggatgtcaacgtgtacttgatcgtcgccatctgcgcggtgtccagtctgttrgtgctcacactgctgctatatactgctctgcggtgctccgcgccgccaaccgaaggcgactgtgggccgggcaagcccacgctggtgtgctccagcgcgg

SEQ ID NO: 4846 - DNA, 201 bp, Homo sapiens
ttgtgaattctcggatagaccgcgaggaactgtgcgggcggagcgcggagtgcagcatccacctggaggtgatcgtggacaggccgctgcaggttttccasgtggaggtggaagtgaaggacattaatgacaacgcgccagtttttccaatggctgtaaagaatctgtttatttccgaatcccgacagcctggctctcggt

SEQ ID NO: 4847 - DNA, 201 bp, Homo sapiens
ggcggagctggtgccgcgcctgttccgggtggcgtccaaaagacacggggaccttctggaggtaaatctgcagaatggcattttgtttgtgaattctcggrtagaccgcgaggaactgtgcgggcggagcgcggagtgcagcatccacctggaggtgatcgtggacaggccgctgcaggttttccatgtggaggtggaagt

SEQ ID NO: 4848 - DNA, 201 bp, Homo sapiens
ctcggaggtggggagcggccagctccactactccgtctctgaggaggccaagcatggcaccttcgtgggccgcatcgcgcaggacctggggctggagctgycggagctggtgccgcgcctgttccgggtggcgtccaaaagacacggggaccttctggaggtaaatctgcagaatggcattttgtttgtgaattctcggat

SEQ ID NO: 4849 - DNA, 201 bp, Homo sapiens
tcgaattatttttaaattttggatcaatgtaaaggcaatctaatatttggaaaatacttgcaatgttgttctcctggcgagaagatcctggagcccagtgmctgctgctttctcttctgctcctcgcagcctcggaggtggggagcggccagctccactactccgtctctgaggaggccaagcatggcaccttcgtgggcc

SEQ ID NO: 4850 - DNA, 201 bp, Homo sapiens
gctagagggcgcatcagatgcagatatcggaacaaattcgttgttgacttacagtcttgattccactgaatattttaccttggacgttaaaagaaatgatyaggaaattaaatcccttggactcgtgttgaaaaaaaatttaaatcgagaggacactcctaagcattatttactaataacagcaattgatggtgggaaacc

SEQ ID NO: 4851 - DNA, 201 bp, Homo sapiens; identical to SEQ ID NO: 4456

SEQ ID NO: 4852 - DNA, 201 bp, Homo sapiens; identical to SEQ ID NO: 4571

SEQ ID NO: 4853 - DNA, 201 bp, Homo sapiens; identical to SEQ ID NO: 4572

SEQ ID NO: 4854 - DNA, 201 bp, Homo sapiens; identical to SEQ ID NO: 4459

SEQ ID NO: 4855 - DNA, 201 bp, Homo sapiens; identical to SEQ ID NO: 4573

SEQ ID NO: 4856 - DNA, 201 bp, Homo sapiens; identical to SEQ ID NO: 4574

SEQ ID NO: 4857 - DNA, 201 bp, Homo sapiens; identical to SEQ ID NO: 4575

SEQ ID NO: 4858 - DNA, 201 bp, Homo sapiens; identical to SEQ ID NO: 4448

SEQ ID NO: 4859 - DNA, 201 bp, Homo sapiens; identical to SEQ ID NO: 4577

SEQ ID NO: 4860 - DNA, 201 bp, Homo sapiens; identical to SEQ ID NO: 4473

SEQ ID NO: 4861 - DNA, 201 bp, Homo sapiens; identical to SEQ ID NO: 4578

SEQ ID NO: 4862 - DNA, 201 bp, Homo sapiens; identical to SEQ ID NO: 4579

SEQ ID NO: 4863 - DNA, 201 bp, Homo sapiens; identical to SEQ ID NO: 4474

SEQ ID NO: 4864 - DNA, 201 bp, Homo sapiens; identical to SEQ ID NO: 4580

SEQ ID NO: 4865 - DNA, 201 bp, Homo sapiens; identical to SEQ ID NO: 4581

SEQ ID NO: 4866 - DNA, 201 bp, Homo sapiens; identical to SEQ ID NO: 4582

SEQ ID NO: 4867 - DNA, 201 bp, Homo sapiens; identical to SEQ ID NO: 4584

SEQ ID NO: 4868 - DNA, 201 bp, Homo sapiens; identical to SEQ ID NO: 4583

SEQ ID NO: 4869 - DNA, 201 bp, Homo sapiens; identical to SEQ ID NO: 4586

SEQ ID NO: 4870 - DNA, 201 bp, Homo sapiens; identical to SEQ ID NO: 4587

SEQ ID NO: 4871 - DNA, 201 bp, Homo sapiens
tcgtgctggtgaaggaccacggcgaaccagcgttgacagccacggccaccgtgttagtgtcgttggtggaaagtggccaggcacccaaggcctcgtcgcgrgcgtgggtgggcgccgcgggctcagaggctacgctggtggatgtcaacgtgtacctgatcatcgccatctgcgcggtatccagcctgttggtgctcacgg

SEQ ID NO: 4872 - DNA, 201 bp, Homo sapiens; identical to SEQ ID NO: 4456

SEQ ID NO: 4873 - DNA, 201 bp, Homo sapiens; identical to SEQ ID NO: 4448

SEQ ID NO: 4874 - DNA, 201 bp, Homo sapiens
gggacgggggctcgccttcactgtgggccaccaccagcgtgtccatcgaggtggccgacgtgaacgacaacgcgccggcgttcgcacagcctgagtacacrgtattcgtgaaggagaacaacccgccgggctgccacatcttcacggtgtcagcgtgggatgcggacgcgcaggagaacgcgctggtgtcctactcgctgg

SEQ ID NO: 4875 - DNA, 201 bp, Homo sapiens; identical to SEQ ID NO: 4473

SEQ ID NO: 4876 - DNA, 201 bp, Homo sapiens
gccgggctgccacatcttcacggtgtcagcgtgggatgcggacgcgcaggagaacgcgctggtgtcctactcgctggtggagcggcgggtgggcgagcgcrcgttgtcgagctacgtttcggtgcacgcggagagcggcaaggtgtacgcgctgcagccgctggaccacgaggaagtggagctgctgcagttccaggtgag

SEQ ID NO: 4877 - DNA, 201 bp, Homo sapiens; identical to SEQ ID NO: 4459

SEQ ID NO: 4878 - DNA, 201 bp, Homo sapiens
gcgcgcgcgccaggaaagcccacgctggtgtgctccagcgccgtggggagctggtcttactcgcagcagaggcggcagagggtgtgctctggggaggaccyccccaagacggacctcatggccttcagccctagcttatctcaaggtccagactccgcagaagagaaacagctctcagaatcagaatacgtaggaaagcca

SEQ ID NO: 4879 - DNA, 201 bp, Homo sapiens
aggtgatcgtggacaggccgctgcaggttttccatgtggaagtggaggtgaaggacattaacgacaacccgccaatatttccaatgacagtaaagactatscggtttcccgaatcaaggctgcttgattctcggtttcctctagagggagcatctgatgcagatataggagtaaatgctcttctctcctacaagctcagct

SEQ ID NO: 4880 - DNA, 201 bp, Homo sapiens
aatttgatcaaaacattgaggattggtaatggcgtcttctatcagaaggggccgaggggcctggacacggctgctctcgcttctgctcctcgcagcctggraggtggggagcggccagctccgctactccgtccccgaggaggccaaacacggcaccttcgtgggccgcatcgcgcaggacctggggctggagctggagga

SEQ ID NO: 4881 - DNA, 201 bp, Homo sapiens; identical to SEQ ID NO: 4474

SEQ ID NO: 4882 - DNA, 201 bp, Homo sapiens
gctatgagtaaacttaaaccagaaaatcgactagttttaaatctacagaataaacagtagagccttccttttagccacatgatgtcgctgtccaccatagmgtgttctctaggaaggaaaatacccagagcccctttgttacttcagagaagcggaggaataagagaagcagcaggactttaacagagactagaatattta

SEQ ID NO: 4883 - DNA, 201 bp, Homo sapiens
gcagaatggcattttgtttgtgaattctcggatcgaccgggaggagctgtgcgggcggagcgcggaatgtagcatccacctggaggtgatcgtggacaggmcgctgcaggttttccatgtggaagtggaggtgaaggacattaacgacaacccgccaatatttccaatgacagtaaagactatccggtttcccgaatcaag

SEQ ID NO: 4884 - DNA, 201 bp, Homo sapiens
ggaccttctggaggtaaatctgcagaatggcattttgtttgtgaattctcggatcgaccgggaggagctgtgcgggcggagcgcggaatgtagcatccacstggaggtgatcgtggacaggccgctgcaggttttccatgtggaagtggaggtgaaggacattaacgacaacccgccaatatttccaatgacagtaaagac

SEQ ID NO: 4885 - DNA, 182 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 4886 - DNA, 201 bp, Homo sapiens
aagggagcttctgtgcatcgcctgagagcagcagggatgacttccaggagggaagggagggcattgtggcccggctaacagagagcctgttcctggacctkctcggagaggagaatgggggcttttgccagcaggacatgggggagtcatgccttcttccaccttcgggaagtacgagtgctcacatgccctgggatgagt

SEQ ID NO: 4887 - DNA, 201 bp, Homo sapiens
gggaagggagggcattgtggcccggctaacagagagcctgttcctggacctgctcggagaggagaatgggggcttttgccagcaggacatgggggagtcaygccttcttccaccttcgggaagtacgagtgctcacatgccctgggatgagttcccaagtgcagggcccaaggaggcacctccctggggcaaggagcagcc

SEQ ID NO: 4888 - DNA, 181 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 4889 - DNA, 201 bp, Homo sapiens
gaagggagggcattgtggcccggctaacagagagcctgttcctggacctgctcggagaggagaatgggggcttttgccagcaggacatgggggagtcatgycttcttccaccttcgggaagtacgagtgctcacatgccctgggatgagttcccaagtgcagggcccaaggaggcacctccctggggcaaggagcagcctc

SEQ ID NO: 4890 - DNA, 201 bp, Homo sapiens
gccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctgctcggagaggagaatgggggcttttgccagcaggacatgggggagtcatgccttctt

SEQ ID NO: 4891 - DNA, 201 bp, Homo sapiens
gggagggcattgtggcccggctaacagagagcctgttcctggacctgctcggagaggagaatgggggcttttgccagcaggacatgggggagtcatgcctycttccaccttcgggaagtacgagtgctcacatgccctgggatgagttcccaagtgcagggcccaaggaggcacctccctggggcaaggagcagcctctcc

SEQ ID NO: 4892 - DNA, 201 bp, Homo sapiens
tgagccagaaacctgggagcagatcctccgccgaaatgtcctccagcatggggcagctgcagcccccgtctcggcccccaccagtggctatcaggagtttrtacatgcggtggagcagggtggcacccaggccagtgcggtggtgggcttgggtcccccaggagaggctggttacaaggccttctcaagcctgcttgccag

SEQ ID NO: 4893 - DNA, 201 bp, Homo sapiens
agggcattgtggcccggctaacagagagcctgttcctggacctgctcggagaggagaatgggggcttttgccagcaggacatgggggagtcatgccttctyccaccttcgggaagtacgagtgctcacatgccctgggatgagttcccaagtgcagggcccaaggaggcacctccctggggcaaggagcagcctctccacc

SEQ ID NO: 4894 - DNA, 201 bp, Homo sapiens
ccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctggg

SEQ ID NO: 4895 - DNA, 201 bp, Homo sapiens
caaaatcgtgaactttgtctccgtgggacccacatacatgagggtctcttaggtgcatgtcctcttgttgctgagtctgcagatgaggactagggcttatycatgcctgggaaatgccacctcctggaaggcagccaggctggcagatttccaaaagacttgaagaaccatggtatgaaggtgattggccccactgacgtt

SEQ ID NO: 4896 - DNA, 201 bp, Homo sapiens
actggaccccgcccagcattgggctgggctcgccacatcccatgagagtagagggcactgggtcgccgtgccccacggcaggcccctgcaggaaaactgargcccttgggcacctcgacttgtgaacgagttgttggctgctccctccacagcttctgcagcagactgtccctgttgtaactgcccaaggcatgttttgcc

SEQ ID NO: 4897 - DNA, 201 bp, Homo sapiens
gcccagcattgggctgggctcgccacatcccatgagagtagagggcactgggtcgccgtgccccacggcaggcccctgcaggaaaactgaggcccttgggmacctcgacttgtgaacgagttgttggctgctccctccacagcttctgcagcagactgtccctgttgtaactgcccaaggcatgttttgcccaccagatca

SEQ ID NO: 4898 - DNA, 201 bp, Homo sapiens
gagggtctcttaggtgcatgtcctcttgttgctgagtctgcagatgaggactagggcttatccatgcctgggaaatgccacctcctggaaggcagccaggstggcagatttccaaaagacttgaagaaccatggtatgaaggtgattggccccactgacgttggcctaacactgggctgcagagactggaccccgcccagc

SEQ ID NO: 4899 - DNA, 201 bp, Homo sapiens
ctgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtga

SEQ ID NO: 4900 - DNA, 201 bp, Homo sapiens
catcctgcccctggcaatgctcagagctcaagccagacccccaaaatcgtgaactttgtctccgtgggacccacatacatgagggtctcttaggtgcatgycctcttgttgctgagtctgcagatgaggactagggcttatccatgcctgggaaatgccacctcctggaaggcagccaggctggcagatttccaaaagact

SEQ ID NO: 4901 - DNA, 201 bp, Homo sapiens
tccatcctgcccctggcaatgctcagagctcaagccagacccccaaaatcgtgaactttgtctccgtgggacccacatacatgagggtctcttaggtgcaygtcctcttgttgctgagtctgcagatgaggactagggcttatccatgcctgggaaatgccacctcctggaaggcagccaggctggcagatttccaaaaga

SEQ ID NO: 4902 - DNA, 201 bp, Homo sapiens
gactaaagcagggacaatttgctgccaaacacccatgcccagctgtatggctgggggctcctcgtatgcatggaacccccagaataaatatgctcagccaycctgtgggccgggcaatccagacagcaggcataaggcaccagttaccctgcatgttggcccagacctcaggtgctagggaaggcgggaaccttgggttga

SEQ ID NO: 4903 - DNA, 201 bp, Homo sapiens
ttcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatggaacccccagaataaatatgctcagcc

SEQ ID NO: 4904 - DNA, 201 bp, Homo sapiens
ttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatga

SEQ ID NO: 4905 - DNA, 201 bp, Homo sapiens
ctcgccccctacaacccccctgagggccccagacccctctccaggtggggttccactggaggccagtctgtgtccggcctccctggcaccctcgggcatcycagagaagagtaaatcctcatcatccttccatcctgcccctggcaatgctcagagctcaagccagacccccaaaatcgtgaactttgtctccgtgggacc

SEQ ID NO: 4906 - DNA, 201 bp, Homo sapiens
atgtctccgacactctgctgctgacctggagcaacccgtatccccctgacaattacctgtataatcatctcacctatgcagtcaacatttggagtgaaaaygacccggcagatttcagaatctataacgtgacctacctagaaccctccctccgcatcgcagccagcaccctgaagtctgggatttcctacagggcacggg

SEQ ID NO: 4907 - DNA, 201 bp, Homo sapiens
ggagcttctgtgcatcgcctgagagcagcagggatgacttccaggagggaagggagggcattgtggcccggctaacagagagcctgttcctggacctgctyggagaggagaatgggggcttttgccagcaggacatgggggagtcatgccttcttccaccttcgggaagtacgagtgctcacatgccctgggatgagttcc

SEQ ID NO: 4908 - DNA, 201 bp, Homo sapiens
  misc_feature (1)...(201): n = A,T,C or G, or insertion/deletion polymorphism (see Tables 1-2)
ctctacttgcgagtggaagatgaatggtcccaccaattgcagcaccgagctccgcctgttgtaccagctggtttttctgctctccgaagcccacacgtgtntccctgagaacaacggaggcgcggggtgcgtgtgccacctgctcatggatgacgtggtcagtgcggataactatacactggacctgtgggctgggcagca

SEQ ID NO: 4909 - DNA, 201 bp, Homo sapiens
aactatacactggacctgtgggctgggcagcagctgctgtggaagggctccttcaagcccagcgagcatgtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 4910 - DNA, 201 bp, Homo sapiens
gcattgtcatcctggccgtctgcctgttgtgctatgtcagcatcaccaagattaagaaagaatggtgggatcagattcccaacccagcccgcagccgcctsgtggctataataatccaggatgctcaggggtcacagtgggagaagcggtcccgaggccaggaaccagccaagtgcccacactggaagaattgtcttacca

SEQ ID NO: 4911 - DNA, 201 bp, Homo sapiens
aggatgctcaggggtcacagtgggagaagcggtcccgaggccaggaaccagccaagtgcccacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 4912 - DNA, 201 bp, Homo sapiens
caggtggggttccactggaggccagtctgtgtccggcctccctggcaccctcgggcatctcagagaagagtaaatcctcatcatccttccatcctgccccyggcaatgctcagagctcaagccagacccccaaaatcgtgaactttgtctccgtgggacccacatacatgagggtctcttaggtgcatgtcctcttgttgc

SEQ ID NO: 4913 - DNA, 201 bp, Homo sapiens
agcaacagaggacatgaaaaattgctgtgactaaagcagggacaatttgctgccaaacacccatgcccagctgtatggctgggggctcctcgtatgcatgsaacccccagaataaatatgctcagccaccctgtgggccgggcaatccagacagcaggcataaggcaccagttaccctgcatgttggcccagacctcaggt

SEQ ID NO: 4914 - DNA, 201 bp, Homo sapiens
actcctacagggagcccttcgagcagcacctcctgctgggcgtcagcgtttcctgcattgtcatcctggccgtctgcctgttgtgctatgtcagcatcacsaagattaagaaagaatggtgggatcagattcccaacccagcccgcagccgcctcgtggctataataatccaggatgctcaggggtcacagtgggagaagc

SEQ ID NO: 4915 - DNA, 201 bp, Homo sapiens
ccccaacctgagccagaaacctgggagcagatcctccgccgaaatgtcctccagcatggggcagctgcagcccccgtctcggcccccaccagtggctatcrggagtttgtacatgcggtggagcagggtggcacccaggccagtgcggtggtgggcttgggtcccccaggagaggctggttacaaggccttctcaagcctg

SEQ ID NO: 4916 - DNA, 201 bp, Homo sapiens
ccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcat

SEQ ID NO: 4917 - DNA, 201 bp, Homo sapiens
aagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagct

SEQ ID NO: 4918 - DNA, 201 bp, Homo sapiens
gtggcccggctaacagagagcctgttcctggacctgctcggagaggagaatgggggcttttgccagcaggacatgggggagtcatgccttcttccaccttygggaagtacgagtgctcacatgccctgggatgagttcccaagtgcagggcccaaggaggcacctccctggggcaaggagcagcctctccacctggagcca

SEQ ID NO: 4919 - DNA, 201 bp, Homo sapiens
cgaggagggatgagaaagtttatctgccctctcacaggactgtggcccatcaacactctgaaatgtacacccagagtatgtccttttgctggaatcttagraaatggagccgtacgctatacgacttttgaatatcccaacacgatcagtttttcttgtaacactgggttttatctgaatggcgctgattctgccaagtgc

SEQ ID NO: 4920 - DNA, 201 bp, Homo sapiens
gaatggaatgctacatggtgataaagtttctttcttctgcaaaaataaggaaaagaagtgtagctatacagaggatgctcagtgtatagatggcactatcraagtccccaaatgcttcaaggaacacagttctctggctttttggaaaactgatgcatccgatgtaaagccatgctaaggtggttttcagattccacataa

SEQ ID NO: 4921 - DNA, 157 bp, Homo sapiens
cagacgaaaaccactttggtagtgccagtgtgactcatccacaatgatttctccagygctcatcttgttctcgagttttctctgccatgttgctattgcaggacggacctgtcccaagccagatgatttaccattttccacagtggtcccgttaaaa

SEQ ID NO: 4922 - DNA, 185 bp, Homo sapiens
tcgaagtccccaaatgcttcaaggaacacagttctctggctttttggaaaactgatgcatccgatgtaaagccatgctaaggtggttttcagattccacayaaaatgtcacacttgtttcttgttcatccaaggaacctaattgaaatttaaaaataaagctactgaatttattgccgcacccat

SEQ ID NO: 4923 - DNA, 106 bp, Homo sapiens
cagacraaaaccactttggtagtgccagtgtgactcatccacaatgatttctccagtgctcatcttgttctcgagttttctctgccatgttgctattgcaggacgg

SEQ ID NO: 4924 - DNA, 201 bp, Homo sapiens
cttttgaatatcccaacacgatcagtttttcttgtaacactgggttttatctgaatggcgctgattctgccaagtgcactgaggaaggaaaatggagcccrgagcttcctgtctgtgctcccatcatctgccctccaccatccatacctacgtttgcaacacttcgtgtttataagccatcagctggaaacaattccctct

SEQ ID NO: 4925 - DNA, 201 bp, Homo sapiens
acatggtgataaagtttctttcttctgcaaaaataaggaaaagaagtgtagctatacagaggatgctcagtgtatagatggcactatcgaagtccccaaakgcttcaaggaacacagttctctggctttttggaaaactgatgcatccgatgtaaagccatgctaaggtggttttcagattccacataaaatgtcacactt

SEQ ID NO: 4926 - DNA, 201 bp, Homo sapiens
tggctgccatgatggatattctctggatggcccggaagaaatagaatgtaccaaactgggaaactggtctgccatgccaagttgtaaagcatcttgtaaaktacctgtgaaaaaagccactgtggtgtaccaaggagagagagtaaagattcaggaaaaatttaagaatggaatgctacatggtgataaagtttctttctt

SEQ ID NO: 4927 - DNA, 112 bp, Homo sapiens
cagacgaaaacmactttggtagtgccagtgtgactcatccacaatgatttctccagtgctcatcttgttctcgagttttctctgccatgttgctattgcaggacggacctgt

SEQ ID NO: 4928 - DNA, 201 bp, Homo sapiens
ctccagtgctcatcttgttctcgagttttctctgccatgttgctattgcaggacggacctgtcccaagccagatgatttaccattttccacagtggtcccrttaaaaacattctatgagccaggagaagagattacgtattcctgcaagccgggctatgtgtcccgaggagggatgagaaagtttatctgccctctcacag

SEQ ID NO: 4929 - DNA, 201 bp, Homo sapiens
aataaggaaaagaagtgtagctatacagaggatgctcagtgtatagatggcactatcgaagtccccaaatgcttcaaggaacacagttctctggctttttsgaaaactgatgcatccgatgtaaagccatgctaaggtggttttcagattccacataaaatgtcacacttgtttcttgttcatccaaggaacctaattgaa

SEQ ID NO: 4930 - DNA, 201 bp, Homo sapiens; identical to SEQ ID NO: 4919

SEQ ID NO: 4931 - DNA, 201 bp, Homo sapiens
aagcaatcctcctgcctcagcctccggagtagctgggattacagcagacgaaaaccactttggtagtgccagtgtgactcatccacaatgatttctccagygctcatcttgttctcgagttttctctgccatgttgctattgcaggacggacctgtcccaagccagatgatttaccattttccacagtggtcccgttaaaa

SEQ ID NO: 4932 - DNA, 201 bp, Homo sapiens
aagtggcatgatcttggttcactgcaaccactgcctcccaggttcaagcaatcctcctgcctcagcctccggagtagctgggattacagcagacgaaaacmactttggtagtgccagtgtgactcatccacaatgatttctccagtgctcatcttgttctcgagttttctctgccatgttgctattgcaggacggacctgt

SEQ ID NO: 4933 - DNA, 201 bp, Homo sapiens; identical to SEQ ID NO: 4928

SEQ ID NO: 4934 - DNA, 201 bp, Homo sapiens
ggagtgaagtggcatgatcttggttcactgcaaccactgcctcccaggttcaagcaatcctcctgcctcagcctccggagtagctgggattacagcagacraaaaccactttggtagtgccagtgtgactcatccacaatgatttctccagtgctcatcttgttctcgagttttctctgccatgttgctattgcaggacgg

SEQ ID NO: 4935 - DNA, 201 bp, Homo sapiens
cttttgaatatcccaacacgatcagtttttcttgtaacactgggttttatctgaatggcgctgattctgccaagtgcactgaggaaggaaaatggagcccrgagcttcctgtctgtgctcgtaagtctgtgggcaaggtgatcagctggtttgcccagaacctttctggttttagcactcaaagtctcacatctggaatct

SEQ ID NO: 4936 - DNA, 201 bp, Homo sapiens
ggaaggacgttcttatgttccccaacttgtgatttatacatctttgaccaggaggcccaggcatttcaatactaattatagttcttcaacatgtcagtgargtctgtctttagcaaaagcaagaggagggcaggtgcagtggttcacgcctgtaatgccagcactttgggagtccgaggagggtggctcacctgaggtcag

SEQ ID NO: 4937 - DNA, 201 bp, Homo sapiens; identical to SEQ ID NO: 4919

SEQ ID NO: 4938 - DNA, 201 bp, Homo sapiens; identical to SEQ ID NO: 4920

SEQ ID NO: 4939 - DNA, 201 bp, Homo sapiens; identical to SEQ ID NO: 4931

SEQ ID NO: 4940 - DNA, 185 bp, Homo sapiens; identical to SEQ ID NO: 4922

SEQ ID NO: 4941 - DNA, 201 bp, Homo sapiens; identical to SEQ ID NO: 4934

SEQ ID NO: 4942 - DNA, 201 bp, Homo sapiens; identical to SEQ ID NO: 4924

SEQ ID NO: 4943 - DNA, 201 bp, Homo sapiens; identical to SEQ ID NO: 4925

SEQ ID NO: 4944 - DNA, 201 bp, Homo sapiens; identical to SEQ ID NO: 4926

SEQ ID NO: 4945 - DNA, 201 bp, Homo sapiens; identical to SEQ ID NO: 4932

SEQ ID NO: 4946 - DNA, 201 bp, Homo sapiens; identical to SEQ ID NO: 4928

SEQ ID NO: 4947 - DNA, 201 bp, Homo sapiens; identical to SEQ ID NO: 4929

SEQ ID NO: 4948 - DNA, 201 bp, Homo sapiens
ttaacacagctaatttttttctctgaaaaatcatcgagacaaaagagccacagagtacaagtttttatgattttatagtcaaaagatgattattgattgtsagataggttaggttttggggggccagtagttcagtgagaatgtttatgtttacaactagccttcccagtaaaaaaaaaaaaaaaaaaaaaaaaaattgta

SEQ ID NO: 4949 - DNA, 201 bp, Homo sapiens
agatagatgtgttaaggctgttgcttcaacacggagcaaatgttaatggatcccattctatgtgtggatggaactccttgcaccaggcttcttttcaggawaatgctgagatcataaaattgcttcttagaaaaggagcaaacaaggaatgccaggatgactttggaatcacacctttatttgtggctgctcagtatggca

SEQ ID NO: 4950 - DNA, 201 bp, Homo sapiens
aaggagcaaacaaggaatgccaggatgactttggaatcacacctttatttgtggctgctcagtatggcaagctagaaagcttgagcatacttatttcatcrggtgcaaatgtcaattgtcaagccttggacaaagctacacccttgttcattgctgctcaagagggacacacaaaatgtgtggagcttttgctctccagtg

SEQ ID NO: 4951 - DNA, 201 bp, Homo sapiens
tctttactgtaatgaggacagttggcagttacctattcatgcagctgcacaaatgggccatacaaaaatcttggacttgttaataccacttactaaccggrcctgtgacactgggctaaacaaagtaagccctgtttactcagcagtgtttgggggacatgaagattgcctagaaatattactccggaatggctacagccc

SEQ ID NO: 4952 - DNA, 201 bp, Homo sapiens
aggcggcagccgcttcctgaagccattcccgctgctctccagtgggcaggcagaggtttgacccacacggagtgatagcgggaagaagacagtgtgaaccrtgcgggtgcgggtccttagatgagaaaattcgaagtagcgatgagatgtgagaaatggcggtgttcctgactgacctgccttcttgcagcttttcttctt

SEQ ID NO: 4953 - DNA, 201 bp, Homo sapiens
cttacgcggacacgtgctctacagttggacttgctgccagggaaggcaatgttaaagtcttaaggaaactgctcaaaaagggccgaagtgtcgatgttgcwgataacaggggatggatgccaattcatgaagcagcttatcacaactctgtagaatgtttgcaaatgttaattaatgcagattcatctgaaaactacatta

SEQ ID NO: 4954 - DNA, 201 bp, Homo sapiens
ttgtaaatcatgcaattaaagcacaagcaaaatataaggagtggttgccacatcttctggttgctggatttgacccactgattctactgtgcaattcttgkattgactcagtcagcattgacacccttatcttcactttggagtttactaattggaagacacttgcaccagctgttgaaaggatgctctctgctcgtgcct

SEQ ID NO: 4955 - DNA, 201 bp, Homo sapiens
actggtcaaacaaatggattttacagaggcttacgcggacacgtgctctacagttggacttgctgccagggaaggcaatgttaaagtcttaaggaaactgstcaaaaagggccgaagtgtcgatgttgctgataacaggggatggatgccaattcatgaagcagcttatcacaactctgtagaatgtttgcaaatgttaat

SEQ ID NO: 4956 - DNA, 201 bp, Homo sapiens
tcagctatacgcaatctccattctagccgctttcctcaagaaatcgtctacgtggaggagtaaaaaagctgttgaaaatggacagatagatgtgttaaggstgttgcttcaacacggagcaaatgttaatggatcccattctatgtgtggatggaactccttgcaccaggcttcttttcaggaaaatgctgagatcataaa

SEQ ID NO: 4957 - DNA, 201 bp, Homo sapiens; identical to SEQ ID NO: 4948

SEQ ID NO: 4958 - DNA, 201 bp, Homo sapiens; identical to SEQ ID NO: 4949

SEQ ID NO: 4959 - DNA, 201 bp, Homo sapiens; identical to SEQ ID NO: 4950

SEQ ID NO: 4960 - DNA, 201 bp, Homo sapiens; identical to SEQ ID NO: 4951

SEQ ID NO: 4961 - DNA, 201 bp, Homo sapiens; identical to SEQ ID NO: 4953

SEQ ID NO: 4962 - DNA, 201 bp, Homo sapiens; identical to SEQ ID NO: 4954

SEQ ID NO: 4963 - DNA, 201 bp, Homo sapiens
ggcagcacggcagatggattttacagaggcttacgcggacacgtgctctacagttggacttgctgccagggaaggcaatgttaaagtcttaaggaaactgstcaaaaagggccgaagtgtcgatgttgctgataacaggggatggatgccaattcatgaagcagcttatcacaactctgtagaatgtttgcaaatgttaat

SEQ ID NO: 4964 - DNA, 201 bp, Homo sapiens
gattcttttagaagctggggcagatcctaatgcaactactttagaagaaacgacaccattgtttttagctgttgaaaatggacagatagatgtgttaaggstgttgcttcaacacggagcaaatgttaatggatcccattctatgtgtggatggaactccttgcaccaggcttcttttcaggaaaatgctgagatcataaa

SEQ ID NO: 4965 - DNA, 201 bp, Homo sapiens; identical to SEQ ID NO: 4954

SEQ ID NO: 4966 - DNA, 201 bp, Homo sapiens; identical to SEQ ID NO: 4964

SEQ ID NO: 4967 - DNA, 201 bp, Homo sapiens; identical to SEQ ID NO: 4948

SEQ ID NO: 4968 - DNA, 201 bp, Homo sapiens; identical to SEQ ID NO: 4949

SEQ ID NO: 4969 - DNA, 183 bp, Homo sapiens
ggtcgcggagccgtccgcctacgggggccgggacgtcgcctgcgcgtctctcgttttcggacggctgcagcatcgcggtgggratcgaaagcgggggcttctgggacgcagctctggagacgcggcctcggaccagccatttcggtgtagaagtggcagcacggcagattcatctgaaaacta

SEQ ID NO: 4970 - DNA, 201 bp, Homo sapiens; identical to SEQ ID NO: 4950

SEQ ID NO: 4971 - DNA, 201 bp, Homo sapiens; identical to SEQ ID NO: 4951

SEQ ID NO: 4972 - DNA, 201 bp, Homo sapiens
atgcgcggtgcttaggaaatgaaagaagtcccgggtctgtctctctcactctcgctctcactgggggagggaaagaatggctttggtggctttgttcacayagctgatgcgtgccctgggaaggtgtccacagtgagccctgtgtgcaggactgtccacacggttcacaccttgtcaccatcaggcctttctggctcctga

SEQ ID NO: 4973 - DNA, 201 bp, Homo sapiens
ttcacatagctgatgcgtgccctgggaaggtgtccacagtgagccctgtgtgcaggactgtccacacggttcacaccttgtcaccatcaggcctttctggstcctgatagggtggagcaaaagtggaaaggaaaggaaagaggccttttctcacagccattatattaaatagtaggtcgattcacatcctcgtgctcctgg

SEQ ID NO: 4974 - DNA, 161 bp, Homo sapiens
accggaaggggggctgtgaggacgtgttccgaggaagccagagccggagccgtggcctgcsgggccggcgacatggatcccctgttccagcaaacgcacaagcaggtccacgagatccagtcttgcatgggacgcctggagacggcagacaagcagtctgt

SEQ ID NO: 4975 - DNA, 201 bp, Homo sapiens
gtcccgggtctgtctctctcactctcgctctcactgggggagggaaagaatggctttggtggctttgttcacatagctgatgcgtgccctgggaaggtgtycacagtgagccctgtgtgcaggactgtccacacggttcacaccttgtcaccatcaggcctttctggctcctgatagggtggagcaaaagtggaaaggaaa

SEQ ID NO: 4976 - DNA, 201 bp, Homo sapiens
gaaaacgaaatccaagcaagcatagaccagatattcagccgtctagaacgtctggagattttgtccagcaaggagccccctaacaaaaggcaaaatgccaracttcgggttgaccagttaaagtatgatgtccagcacctgcagactgcgctcagaaacttccagcatcggcgccatgcaagggagcagcaggagagacag

SEQ ID NO: 4977 - DNA, 201 bp, Homo sapiens
tggatgacctcattttagatgggcacaatattttagatggactgaggacccagagactgaccttgaaggggactcagaagaagatccttgacattgccaasatgctgggcttgtccaacacagtgatgcggctcatcgagaagcgggctttccaggacaagtactttatgataggtgggatgctgctgacctgtgtggtca

SEQ ID NO: 4978 - DNA, 143 bp, Homo sapiens
accggaaggggggctgtgaggacgtgttccgaggaagccagasccggagccgtggcctgccgggccggcgacatggatcccctgttccagcaaacgcacaagcaggtccacgagatccagtcttgcatgggacgcctggagac

SEQ ID NO: 4979 - DNA, 128 bp, Homo sapiens
gtagtgtgtatgtccttgtaacactctgttttcagggactacaacctttttccttctgtgaccagccccggattcaggctgtactaataccaggtatattrtggaatttagtataaaggccaatctgt

SEQ ID NO: 4980 - DNA, 179 bp, Homo sapiens
accggaaggggggctgtgaggacgtgttccgaggaagccagagccggagccgtggcctgccgggccggcgacatggatmccctgttccagcaaacgcacaagcaggtccacgagatccagtcttgcatgggacgcctggagacggcagacaagcagtctgtgcacatagtagaaaacga

SEQ ID NO: 4981 - DNA, 201 bp, Homo sapiens
ctccaccgcctcagtgtagggaagggtccaggccagggaaggagcaccctctagtggaggcgggggtgaattcttaggtcgagctgatgcaagaaactccrgtagccagcctctgtgaccttgtacatgagtttggtgtgcctattgtgatttaaaacaggtgggttatcaagaggaacttgagatctctttattacatgg

SEQ ID NO: 4982 - DNA, 161 bp, Homo sapiens; identical to SEQ ID NO: 4974

SEQ ID NO: 4983 - DNA, 201 bp, Homo sapiens
caccctctagtggaggcgggggtgaattcttaggtcgagctgatgcaagaaactccggtagccagcctctgtgaccttgtacatgagtttggtgtgcctaytgtgatttaaaacaggtgggttatcaagaggaacttgagatctctttattacatggacatttacttcagggggaccactgtaagaaaagccaaactccaa

SEQ ID NO: 4984 - DNA, 201 bp, Homo sapiens
tctccaccgcctcagtgtagggaagggtccaggccagggaaggagcaccctctagtggaggcgggggtgaattcttaggtcgagctgatgcaagaaactcyggtagccagcctctgtgaccttgtacatgagtttggtgtgcctattgtgatttaaaacaggtgggttatcaagaggaacttgagatctctttattacatg

SEQ ID NO: 4985 - DNA, 201 bp, Homo sapiens
ttgagacagtctcgctctgtcacccaggctggagtgcagtggcgcaatcttggctcactgcatcctctgcctcctgggttcaggtgatcctcatacctcakcctcctgattctagggttacaggtgttagccactggacctggcctctaaggtgattctgatgtgtgtattttggaaccactgtctcctagacagaaagct

SEQ ID NO: 4986 - DNA, 201 bp, Homo sapiens; identical to SEQ ID NO: 4976

SEQ ID NO: 4987 - DNA, 201 bp, Homo sapiens
ccttttttaaatctctaaggtgattttattttattttttatttttgagacagtctcgctctgtcacccaggctggagtgcagtggcgcaatcttggctcaytgcatcctctgcctcctgggttcaggtgatcctcatacctcagcctcctgattctagggttacaggtgttagccactggacctggcctctaaggtgattc

SEQ ID NO: 4988 - DNA, 201 bp, Homo sapiens
tggatgacctcattttagatgggcacaatattttagatggactgaggacccagagactgaccttgaaggggactcagaagaagatccttgacattgccaasatgctgggcttgtccaacacagtgatgcggctcatcgagaagcgggctttccaggacaagtactttatgataggcacccaaggatcctgccagacagcac

SEQ ID NO: 4989 - DNA, 143 bp, Homo sapiens; identical to SEQ ID NO: 4978

SEQ ID NO: 4990 - DNA, 201 bp, Homo sapiens
tctagtggaggcgggggtgaattcttaggtcgagctgatgcaagaaactccggtagccagcctctgtgaccttgtacatgagtttggtgtgcctattgtgrtttaaaacaggtgggttatcaagaggaacttgagatctctttattacatggacatttacttcagggggaccactgtaagaaaagccaaactccaagacca

SEQ ID NO: 4991 - DNA, 179 bp, Homo sapiens; identical to SEQ ID NO: 4980

SEQ ID NO: 4992 - DNA, 201 bp, Homo sapiens
cagtggcgcaatcttggctcactgcatcctctgcctcctgggttcaggtgatcctcatacctcagcctcctgattctagggttacaggtgttagccactgkacctggcctctaaggtgattctgatgtgtgtattttggaaccactgtctcctagacagaaagcttctgtctcaaagatgatcacattggtgtaaagagca

SEQ ID NO: 4993 - DNA, 201 bp, Homo sapiens; identical to SEQ ID NO: 4981

SEQ ID NO: 4994 - DNA, 161 bp, Homo sapiens; identical to SEQ ID NO: 4974

SEQ ID NO: 4995 - DNA, 201 bp, Homo sapiens; identical to SEQ ID NO: 4983

SEQ ID NO: 4996 - DNA, 201 bp, Homo sapiens; identical to SEQ ID NO: 4984

SEQ ID NO: 4997 - DNA, 109 bp, Homo sapiens
ttgagacagtctcgctctgtcacccaggctggagtgcagtggcgcaatcttggctcactgcatcctctgcctcctgggttcaggtgatcctcatacctcakcctcctga

SEQ ID NO: 4998 - DNA, 201 bp, Homo sapiens; identical to SEQ ID NO: 4976

SEQ ID NO: 4999 - DNA, 152 bp, Homo sapiens
ccttttttaaatctctaaggtgattttattttattttttatttttgagacagtctcgctctgtcacccaggctggagtgcagtggcgcaatcttggctcaytgcatcctctgcctcctgggttcaggtgatcctcatacctcagcctcctga

SEQ ID NO: 5000 - DNA, 201 bp, Homo sapiens; identical to SEQ ID NO: 4988

SEQ ID NO: 5001 - DNA, 143 bp, Homo sapiens; identical to SEQ ID NO: 4978

SEQ ID NO: 5002 - DNA, 201 bp, Homo sapiens; identical to SEQ ID NO: 4990

SEQ ID NO: 5003 - DNA, 179 bp, Homo sapiens; identical to SEQ ID NO: 4980

SEQ ID NO: 5004 - DNA, 201 bp, Homo sapiens
ttatattaaatagtaggtcgattcacatcctcgtgctcctggccacccctctagtggaggcgggggtgaattcttaggtcgagctgatgcaagaaactccrgtagccagcctctgtgaccttgtacatgagtttggtgtgcctattgtgatttaaaacaggtgggttatcaagaggaacttgagatctctttattacatgg

SEQ ID NO: 5005 - DNA, 201 bp, Homo sapiens; identical to SEQ ID NO: 4972

SEQ ID NO: 5006 - DNA, 201 bp, Homo sapiens; identical to SEQ ID NO: 4973

SEQ ID NO: 5007 - DNA, 161 bp, Homo sapiens; identical to SEQ ID NO: 4974

SEQ ID NO: 5008 - DNA, 201 bp, Homo sapiens
acccctctagtggaggcgggggtgaattcttaggtcgagctgatgcaagaaactccggtagccagcctctgtgaccttgtacatgagtttggtgtgcctaytgtgatttaaaacaggtgggttatcaagaggaacttgagatctctttattacatggacatttacttcagggggaccactgtaagaaaagccaaactccaa

SEQ ID NO: 5009 - DNA, 201 bp, Homo sapiens
attatattaaatagtaggtcgattcacatcctcgtgctcctggccacccctctagtggaggcgggggtgaattcttaggtcgagctgatgcaagaaactcyggtagccagcctctgtgaccttgtacatgagtttggtgtgcctattgtgatttaaaacaggtgggttatcaagaggaacttgagatctctttattacatg

SEQ ID NO: 5010 - DNA, 201 bp, Homo sapiens; identical to SEQ ID NO: 4975

SEQ ID NO: 5011 - DNA, 201 bp, Homo sapiens; identical to SEQ ID NO: 4985

SEQ ID NO: 5012 - DNA, 201 bp, Homo sapiens; identical to SEQ ID NO: 4976

SEQ ID NO: 5013 - DNA, 201 bp, Homo sapiens; identical to SEQ ID NO: 4977

SEQ ID NO: 5014 - DNA, 201 bp, Homo sapiens; identical to SEQ ID NO: 4987

SEQ ID NO: 5015 - DNA, 143 bp, Homo sapiens; identical to SEQ ID NO: 4978

SEQ ID NO: 5016 - DNA, 201 bp, Homo sapiens; identical to SEQ ID NO: 4990

SEQ ID NO: 5017 - DNA, 201 bp, Homo sapiens; identical to SEQ ID NO: 4992

SEQ ID NO: 5018 - DNA, 179 bp, Homo sapiens; identical to SEQ ID NO: 4980

SEQ ID NO: 5019 - DNA, 201 bp, Homo sapiens
gaagtcagctccgcgggggagctgaccctgacgtcagcagaccgagaccagtcccagttccagggggaggcctgcaggcccctggccccttccaccacctytgccctccgtctgcagacctcgtccatctgcaccaggctctgccttcactcccccaagtctttggaaatttgttcttttcctttgaagtcacattttctt

SEQ ID NO: 5020 - DNA, 201 bp, Homo sapiens
caggctctgccttcactcccccaagtctttggaaatttgttcttttcctttgaagtcacattttcttttaaaattttttgttttgcatccgaaaccgaaaraaataaagcggtgggaggcagggccattgtgttgagtggtggctcctggagatttgtgtggccccacccctacccccggcaacctcaacacagaggctgg

SEQ ID NO: 5021 - DNA, 201 bp, Homo sapiens
ttttcctttgaagtcacattttcttttaaaattttttgttttgcatccgaaaccgaaagaaataaagcggtgggaggcagggccattgtgttgagtggtgrctcctggagatttgtgtggccccacccctacccccggcaacctcaacacagaggctgggaagggtcgggggcccctggaagtagagccaaggtcccattc

SEQ ID NO: 5022 - DNA, 201 bp, Homo sapiens
ttcttttcctttgaagtcacattttcttttaaaattttttgttttgcatccgaaaccgaaagaaataaagcggtgggaggcagggccattgtgttgagtgrtggctcctggagatttgtgtggccccacccctacccccggcaacctcaacacagaggctgggaagggtcgggggcccctggaagtagagccaaggtccca

SEQ ID NO: 5023 - DNA, 201 bp, Homo sapiens
ggcgtaaaggccgtgcctctgagcacaaagaccagctctctcggctgaaggacagagaccccgagttctacaagttcctgcaggagaatgaccagagcctrctaaacttcagcgactcggacagctctgaggaggaagaggggccgttccactccctgccagatgtgctggaggaagccagtgaggaggaggatggagcgg

SEQ ID NO: 5024 - DNA, 201 bp, Homo sapiens
ggaggcctgcaggcccctggccccttccaccacctctgccctccgtctgcagacctcgtccatctgcaccaggctctgccttcactcccccaagtctttgraaatttgttcttttcctttgaagtcacattttcttttaaaattttttgttttgcatccgaaaccgaaagaaataaagcggtgggaggcagggccattgtg

SEQ ID NO: 5025 - DNA, 201 bp, Homo sapiens
ggcccctggccccttccaccacctctgccctccgtctgcagacctcgtccatctgcaccaggctctgccttcactcccccaagtctttggaaatttgttcytttcctttgaagtcacattttcttttaaaattttttgttttgcatccgaaaccgaaagaaataaagcggtgggaggcagggccattgtgttgagtggtgg

SEQ ID NO: 5026 - DNA, 201 bp, Homo sapiens
gtggagcagctgtacgacctcaccctggagtacctgcacagccaggcacactgcatcggcttcccggagctggtgctgcctgtggtcctgcagctgaagtygttcctccgggagtgcaaggtggccaactactgccggcaggtgcagcagctgcttgggaaggttcaggagaactcggcatacatctgcagccgccgccag

SEQ ID NO: 5027 - DNA, 201 bp, Homo sapiens
acgccatgaccacccgcaagaaggaaacataccagtctgtgtacaactggcagtatgtgcactgcctcttcctgtggtgccgggtcctgagcactgcgggycccagcgaagccctccagcccttggtctacccccttgcccaagtcatcattggctgtatcaagctcatccccactgcccgcttctacccgctgcgaatgc

SEQ ID NO: 5028 - DNA, 201 bp, Homo sapiens
ggagcccctcggccagccggcgtaaaggccgtgcctctgagcacaaagaccagctctctcggctgaaggacagagaccccgagttctacaagttcctgcargagaatgaccagagcctgctaaacttcagcgactcggacagctctgaggaggaagaggggccgttccactccctgccagatgtgctggaggaagccagtg

SEQ ID NO: 5029 - DNA, 201 bp, Homo sapiens
tgctgcggcacatcagcgtgctggtgccctgcttcctgaccttccccaagcagtgccgcatgctgctcaagagaatggtggtcgtatggagcactggggargagtctctgcgggtgctggctttcctggtcctcagcagagtctgccggcacaagaaggacactttccttggccccgtcctcaagcaaatgtacatcacgt

SEQ ID NO: 5030 - DNA, 201 bp, Homo sapiens
ccttgacggagctgctggccctggagccgggtgtggcctaccagcacgccttcctctacatccgccagctcgccatacacctgcgcaacgccatgaccacycgcaagaaggaaacataccagtctgtgtacaactggcagtatgtgcactgcctcttcctgtggtgccgggtcctgagcactgcgggccccagcgaagccc

SEQ ID NO: 5031 - DNA, 201 bp, Homo sapiens
gacgacggtgttggcggccgtgctgcggcacatcagcgtgctggtgccctgcttcctgaccttccccaagcagtgccgcatgctgctcaagagaatggtgrtcgtatggagcactggggaggagtctctgcgggtgctggctttcctggtcctcagcagagtctgccggcacaagaaggacactttccttggccccgtcct

SEQ ID NO: 5032 - DNA, 201 bp, Homo sapiens
tccagcagcccgctctgggggaagcttcgtgtggacatcaaggcttacctgggctcggccatacagctggtgtcctgtctgtcggagacgacggtgttggyggccgtgctgcggcacatcagcgtgctggtgccctgcttcctgaccttccccaagcagtgccgcatgctgctcaagagaatggtggtcgtatggagcact

SEQ ID NO: 5033 - DNA, 201 bp, Homo sapiens
cagaagctgctgtttggaaaggtggcaaaggatagcagcaggatgctgcagccgtccagcagcccgctctgggggaagcttcgtgtggacatcaaggcttwcctgggctcggccatacagctggtgtcctgtctgtcggagacgacggtgttggcggccgtgctgcggcacatcagcgtgctggtgccctgcttcctgacc

SEQ ID NO: 5034 - DNA, 201 bp, Homo sapiens
ggtcgggggcccctggaagtagagccaaggtcccattctcctgcttgggtgaagtttgaccggcaagggcgtggccccctccatagggggacgtggccgtygtgggggacaagggctgctctcctgtgccgagttctcgctccggggcccgcagggttggtggctgcagtggcagagccacggggaagctggccacgtaga

SEQ ID NO: 5035 - DNA, 201 bp, Homo sapiens
ggcatacatctgcagccgccgccagagggtttccttcggcgtctctgagcagcaggcagtggaagcctgggagaagctgacccgggaagaggggacacccytgaccttgtactacagccactggcgcaagctgcgtgaccgggagatccagctggagatcagtggcaaagagcggctggaagacctgaacttccctgagat

SEQ ID NO: 5036 - DNA, 201 bp, Homo sapiens
gacctcattggctgtctccagaagctgctgtttggaaaggtggcaaaggatagcagcaggatgctgcagccgtccagcagcccgctctgggggaagcttcrtgtggacatcaaggcttacctgggctcggccatacagctggtgtcctgtctgtcggagacgacggtgttggcggccgtgctgcggcacatcagcgtgctg

SEQ ID NO: 5037 - DNA, 201 bp, Homo sapiens
tgacgtcagcagaccgagaccagtcccagttccagggggaggcctgcaggcccctggccccttccaccacctctgccctccgtctgcagacctcgtccatytgcaccaggctctgccttcactcccccaagtctttggaaatttgttcttttcctttgaagtcacattttcttttaaaattttttgttttgcatccgaaac

SEQ ID NO: 5038 - DNA, 201 bp, Homo sapiens; identical to SEQ ID NO: 5026

SEQ ID NO: 5039 - DNA, 201 bp, Homo sapiens; identical to SEQ ID NO: 5019

SEQ ID NO: 5040 - DNA, 201 bp, Homo sapiens; identical to SEQ ID NO: 5027

SEQ ID NO: 5041 - DNA, 201 bp, Homo sapiens; identical to SEQ ID NO: 5028

SEQ ID NO: 5042 - DNA, 201 bp, Homo sapiens; identical to SEQ ID NO: 5029

SEQ ID NO: 5043 - DNA, 201 bp, Homo sapiens; identical to SEQ ID NO: 5030

SEQ ID NO: 5044 - DNA, 201 bp, Homo sapiens; identical to SEQ ID NO: 5031

SEQ ID NO: 5045 - DNA, 201 bp, Homo sapiens; identical to SEQ ID NO: 5032

SEQ ID NO: 5046 - DNA, 201 bp, Homo sapiens; identical to SEQ ID NO: 5033

SEQ ID NO: 5047 - DNA, 201 bp, Homo sapiens
ctcggcatacatctgcagccgccgccagagggtttccttcggcgtctctgagcagcaggcagaagcctgggagaagctgacccgggaagaggggacacccytgaccttgtactacagccactggcgcaagctgcgtgaccgggagatccagctggagatcagtggcaaagagcggctggaagacctgaacttccctgagat

SEQ ID NO: 5048 - DNA, 131 bp, Homo sapiens
caggctctgccttcactcccccaagtctttggaaatttgttcttttcctttgaagtcacattttcttttaaaattttttgttttgcatccgaaaccgaaaraaataaagcggtgggaggcagggccattgt

SEQ ID NO: 5049 - DNA, 201 bp, Homo sapiens; identical to SEQ ID NO: 5036

SEQ ID NO: 5050 - DNA, 201 bp, Homo sapiens; identical to SEQ ID NO: 5023

SEQ ID NO: 5051 - DNA, 200 bp, Homo sapiens
ggaggcctgcaggcccctggccccttccaccacctctgccctccgtctgcagacctcgtccatctgcaccaggctctgccttcactcccccaagtctttgraaatttgttcttttcctttgaagtcacattttcttttaaaattttttgttttgcatccgaaaccgaaagaaataaagcggtgggaggcagggccattgt

SEQ ID NO: 5052 - DNA, 201 bp, Homo sapiens; identical to SEQ ID NO: 5037

SEQ ID NO: 5053 - DNA, 189 bp, Homo sapiens
ggcccctggccccttccaccacctctgccctccgtctgcagacctcgtccatctgcaccaggctctgccttcactcccccaagtctttggaaatttgttcytttcctttgaagtcacattttcttttaaaattttttgttttgcatccgaaaccgaaagaaataaagcggtgggaggcagggccattgt

SEQ ID NO: 5054 - DNA, 201 bp, Homo sapiens; identical to SEQ ID NO: 5019

SEQ ID NO: 5055 - DNA, 201 bp, Homo sapiens; identical to SEQ ID NO: 5020

SEQ ID NO: 5056 - DNA, 201 bp, Homo sapiens; identical to SEQ ID NO: 5021

SEQ ID NO: 5057 - DNA, 201 bp, Homo sapiens; identical to SEQ ID NO: 5022

SEQ ID NO: 5058 - DNA, 201 bp, Homo sapiens; identical to SEQ ID NO: 5023

SEQ ID NO: 5059 - DNA, 201 bp, Homo sapiens; identical to SEQ ID NO: 5024

SEQ ID NO: 5060 - DNA, 201 bp, Homo sapiens; identical to SEQ ID NO: 5025

SEQ ID NO: 5061 - DNA, 201 bp, Homo sapiens; identical to SEQ ID NO: 5026

SEQ ID NO: 5062 - DNA, 201 bp, Homo sapiens; identical to SEQ ID NO: 5027

SEQ ID NO: 5063 - DNA, 201 bp, Homo sapiens; identical to SEQ ID NO: 5028

SEQ ID NO: 5064 - DNA, 201 bp, Homo sapiens; identical to SEQ ID NO: 5029

SEQ ID NO: 5065 - DNA, 201 bp, Homo sapiens; identical to SEQ ID NO: 5030

SEQ ID NO: 5066 - DNA, 201 bp, Homo sapiens; identical to SEQ ID NO: 5031

SEQ ID NO: 5067 - DNA, 201 bp, Homo sapiens; identical to SEQ ID NO: 5032

SEQ ID NO: 5068 - DNA, 201 bp, Homo sapiens; identical to SEQ ID NO: 5033

SEQ ID NO: 5069 - DNA, 201 bp, Homo sapiens; identical to SEQ ID NO: 5034

SEQ ID NO: 5070 - DNA, 201 bp, Homo sapiens; identical to SEQ ID NO: 5035

SEQ ID NO: 5071 - DNA, 201 bp, Homo sapiens; identical to SEQ ID NO: 5036

SEQ ID NO: 5072 - DNA, 201 bp, Homo sapiens; identical to SEQ ID NO: 5037

SEQ ID NO: 5073 - DNA, 201 bp, Homo sapiens; identical to SEQ ID NO: 5019

SEQ ID NO: 5074 - DNA, 201 bp, Homo sapiens; identical to SEQ ID NO: 5021

SEQ ID NO: 5075 - DNA, 201 bp, Homo sapiens; identical to SEQ ID NO: 5020

SEQ ID NO: 5076 - DNA, 201 bp, Homo sapiens; identical to SEQ ID NO: 5022

SEQ ID NO: 5077 - DNA, 201 bp, Homo sapiens; identical to SEQ ID NO: 5025

SEQ ID NO: 5078 - DNA, 201 bp, Homo sapiens; identical to SEQ ID NO: 5024

SEQ ID NO: 5079 - DNA, 201 bp, Homo sapiens; identical to SEQ ID NO: 5023

SEQ ID NO: 5080 - DNA, 201 bp, Homo sapiens; identical to SEQ ID NO: 5026

SEQ ID NO: 5081 - DNA, 201 bp, Homo sapiens; identical to SEQ ID NO: 5027

SEQ ID NO: 5082 - DNA, 201 bp, Homo sapiens; identical to SEQ ID NO: 5028

SEQ ID NO: 5083 - DNA, 201 bp, Homo sapiens; identical to SEQ ID NO: 5029

SEQ ID NO: 5084 - DNA, 201 bp, Homo sapiens; identical to SEQ ID NO: 5030

SEQ ID NO: 5085 - DNA, 201 bp, Homo sapiens; identical to SEQ ID NO: 5031

SEQ ID NO: 5086 - DNA, 201 bp, Homo sapiens; identical to SEQ ID NO: 5032

SEQ ID NO: 5087 - DNA, 201 bp, Homo sapiens; identical to SEQ ID NO: 5033

SEQ ID NO: 5088 - DNA, 201 bp, Homo sapiens; identical to SEQ ID NO: 5034

SEQ ID NO: 5089 - DNA, 201 bp, Homo sapiens; identical to SEQ ID NO: 5035

SEQ ID NO: 5090 - DNA, 201 bp, Homo sapiens; identical to SEQ ID NO: 5036

SEQ ID NO: 5091 - DNA, 201 bp, Homo sapiens; identical to SEQ ID NO: 5037

SEQ ID NO: 5092 - DNA, 201 bp, Homo sapiens
ctgctaccactgtgaagattgtgagccttggcggtggctgtaacatgatccagcctgtcaatgcggctgtggcccagagtccccagactattcccatcgcyaccctcttggttaaccctacttccttcccctgtccattgaaccagccccttgtggcctcctctgtctcacccttaattgtttctggcaattctgtgaatc

SEQ ID NO: 5093 - DNA, 201 bp, Homo sapiens
attgaaccagccccttgtggcctcctctgtctcacccttaattgtttctggcaattctgtgaatcttcctataccatccacccctgaagataaggcccacrtgaatgtggacattgcttgtgctgtggctgatggggaaaatgcctttcagggcctagaacccaaattagagccccaggaactatctcctctctctgctac

SEQ ID NO: 5094 - DNA, 201 bp, Homo sapiens
ggccagtctgccatccatccaggaagaactgcggcacatggctgatggtgctagagaggtaggaaatatgactggaaccactgagatcaactcagatcaargcctagaaaaagacaactcagagttggggagtgaaactcggtacccactgctattgcctaagggtgtagtcctgaaactgaagccagttgccgaccgttt

SEQ ID NO: 5095 - DNA, 201 bp, Homo sapiens
ggcttacccgctggccgcctcctgacaagcgggagggatccgcggtggacccagggaagcggaggagcctggcggccaccccctcttcctcacttccctgyactctcatcgctctcggcctccgacacgaaaaggaagcaaatgagctgatggaagatctgtttgaaactagacagggtcttgccatgttctggaactcat

SEQ ID NO: 5096 - DNA, 201 bp, Homo sapiens
acattgcttgtgctgtggctgatggggaaaatgcctttcagggcctagaacccaaattagagccccaggaactatctcctctctctgctactgttttcccsaaagtggaacatagcccagggcctccaccagtcgataaacagtgccaagaaggattgtcagagaacagtgcctatcgctggaccgttgtgaaaacagagg

SEQ ID NO: 5097 - DNA, 201 bp, Homo sapiens
ggagggaaggcaagctctggagccgctccctcagggcatccaggagtctctaaacaactcttcccctggggatttagaggaagttgtcaagatggaacctsaagatgctacagaggaaatcagtggatttctttgagctaggagaataagagtctggagactgggagccttcacttcggcctccgattggtggcgcatagg

SEQ ID NO: 5098 - DNA, 201 bp, Homo sapiens
ccccagattttgcaactggggctcttgagcagcttgctttagcctgctcccactctgtggaatatacttttgcttcaataaatctgtgcttttattgcttmattgtttcattgatttgtgcaatttgttcagttcttcattcaacattccaagaacctggacaaattgtagtcaagaccctccgacagtaacatattttgg

SEQ ID NO: 5099 - DNA, 201 bp, Homo sapiens
ggtggcgcatagggtgtaaccaataggaaacccctaaagggtacttaaaccccagattttgcaactggggctcttgagcagcttgctttagcctgctcccmctctgtggaatatacttttgcttcaataaatctgtgcttttattgcttcattgtttcattgatttgtgcaatttgttcagttcttcattcaacattccaa

SEQ ID NO: 5100 - DNA, 201 bp, Homo sapiens
acccactgctattgcctaagggtgtagtcctgaaactgaagccagttgccgaccgtttccccaagaaggcttggagacagaagcgttcatcagtcctgaarcccctccttatccaacccagcccctctctccagcccagcttcaaccctgggaaaacaccagcccaatcaactcattcagaagcccctccgagcaaaatgg

SEQ ID NO: 5101 - DNA, 201 bp, Homo sapiens; identical to SEQ ID NO: 5100

SEQ ID NO: 5102 - DNA, 201 bp, Homo sapiens; identical to SEQ ID NO: 5092

SEQ ID NO: 5103 - DNA, 201 bp, Homo sapiens; identical to SEQ ID NO: 5093

SEQ ID NO: 5104 - DNA, 201 bp, Homo sapiens; identical to SEQ ID NO: 5094

SEQ ID NO: 5105 - DNA, 201 bp, Homo sapiens; identical to SEQ ID NO: 5096

SEQ ID NO: 5106 - DNA, 201 bp, Homo sapiens; identical to SEQ ID NO: 5097

SEQ ID NO: 5107 - DNA, 201 bp, Homo sapiens; identical to SEQ ID NO: 5098

SEQ ID NO: 5108 - DNA, 201 bp, Homo sapiens; identical to SEQ ID NO: 5099

SEQ ID NO: 5109 - DNA, 201 bp, Homo sapiens; identical to SEQ ID NO: 5092

SEQ ID NO: 5110 - DNA, 201 bp, Homo sapiens
ggcttacccgctggccgcctcctgacaagcgggagggatccgcggtggacccagggaagcggaggagcctggcggccaccccctcttcctcacttccctgyactctcatcgctctcggcctccgacacgaaaaggaagcaaatgagctgatggaagatctgtttgaaactttccaagatgagatgggattctccaacatgg

SEQ ID NO: 5111 - DNA, 201 bp, Homo sapiens; identical to SEQ ID NO: 5093

SEQ ID NO: 5112 - DNA, 201 bp, Homo sapiens; identical to SEQ ID NO: 5094

SEQ ID NO: 5113 - DNA, 201 bp, Homo sapiens; identical to SEQ ID NO: 5096

SEQ ID NO: 5114 - DNA, 201 bp, Homo sapiens; identical to SEQ ID NO: 5097

SEQ ID NO: 5115 - DNA, 201 bp, Homo sapiens; identical to SEQ ID NO: 5098

SEQ ID NO: 5116 - DNA, 201 bp, Homo sapiens; identical to SEQ ID NO: 5099

SEQ ID NO: 5117 - DNA, 201 bp, Homo sapiens; identical to SEQ ID NO: 5100

SEQ ID NO: 5118 - DNA, 201 bp, Homo sapiens
tggccagagggccatgctgaagtttgctgctgccactggagccactccaattgctggccacttcactcctggaaccttcacttccgggagccacagcttcytgtggttactgaccccagggctgaccaccagcctctcacggaggtatcttatgttaacttacctaccattgcgctgtgtaacacagattctcctctgcgc

SEQ ID NO: 5119 - DNA, 201 bp, Homo sapiens
catcataaatctgaagaggacctgggagaagcttctgctggcagctcgtgccattgttgccattgaaaaccctgctgatgtcagtgttatatcctccaggratactggccagagggccatgctgaagtttgctgctgccactggagccactccaattgctggccacttcactcctggaaccttcacttccgggagccacag

SEQ ID NO: 5120 - DNA, 201 bp, Homo sapiens
ctcctgagttcactgctactcagcctgaggttgcagactggtctgaaggtctgcaggtgccctctgtgtctattcagtagttccctactgaagactggagygctcagcctgccacggaagactggtctgcagctcccactgctcaggccactgaatgggtaggagcaaccactgaatggtcttaagctgttcttgcatggg

SEQ ID NO: 5121 - DNA, 201 bp, Homo sapiens
cgtgccattgttgccattgaaaaccctgctgatgtcagtgttatatcctccaggaatactggccagagggccatgctgaagtttgctgctgccactggagmcactccaattgctggccacttcactcctggaaccttcacttccgggagccacagcttcctgtggttactgaccccagggctgaccaccagcctctcacgg

SEQ ID NO: 5122 - DNA, 201 bp, Homo sapiens
gatgtcagtgttatatcctccaggaatactggccagagggccatgctgaagtttgctgctgccactggagccactccaattgctggccacttcactcctgsaaccttcacttccgggagccacagcttcctgtggttactgaccccagggctgaccaccagcctctcacggaggtatcttatgttaacttacctaccattg

SEQ ID NO: 5123 - DNA, 201 bp, Homo sapiens
caccagcctctcacggaggtatcttatgttaacttacctaccattgcgctgtgtaacacagattctcctctgcgctatgtggacattgccatcccatgcarcaataagggagctcactcagtgggttggatgtggtggatgctggctcaggaagttctgcgcatgcgtggcaccatttcccgtgaacacccatgggaggtc

SEQ ID NO: 5124 - DNA, 201 bp, Homo sapiens
acctgggagaagcttctgctggcagctcgtgccattgttgccattgaaaaccctgctgatgtcagtgttatatcctccaggaatactggccagagggccaygctgaagtttgctgctgccactggagccactccaattgctggccacttcactcctggaaccttcacttccgggagccacagcttcctgtggttactgacc

SEQ ID NO: 5125 - DNA, 201 bp, Homo sapiens
gctactcagcctgaggttgcagactggtctgaaggtctgcaggtgccctctgtgtctattcagtagttccctactgaagactggagcgctcagcctgccayggaagactggtctgcagctcccactgctcaggccactgaatgggtaggagcaaccactgaatggtcttaagctgttcttgcatgggctcttaagcaacat

SEQ ID NO: 5126 - DNA, 201 bp, Homo sapiens
aagtttgctgctgccactggagccactccaattgctggccacttcactcctggaaccttcactaaccggatccaggcagccttccgggagccacagcttcytgtggttactgaccccagggctgaccaccagcctctcacggaggtatcttatgttaacttacctaccattgcgctgtgtaacacagattctcctctgcgc

SEQ ID NO: 5127 - DNA, 201 bp, Homo sapiens
catcataaatctgaagaggacctgggagaagcttctgctggcagctcgtgccattgttgccattgaaaaccctgctgatgtcagtgttatatcctccaggratactggccagagggccatgctgaagtttgctgctgccactggagccactccaattgctggccacttcactcctggaaccttcactaaccggatccaggc

SEQ ID NO: 5128 - DNA, 201 bp, Homo sapiens; identical to SEQ ID NO: 5120

SEQ ID NO: 5129 - DNA, 201 bp, Homo sapiens
cgtgccattgttgccattgaaaaccctgctgatgtcagtgttatatcctccaggaatactggccagagggccatgctgaagtttgctgctgccactggagmcactccaattgctggccacttcactcctggaaccttcactaaccggatccaggcagccttccgggagccacagcttcctgtggttactgaccccagggct

SEQ ID NO: 5130 - DNA, 201 bp, Homo sapiens
gatgtcagtgttatatcctccaggaatactggccagagggccatgctgaagtttgctgctgccactggagccactccaattgctggccacttcactcctgsaaccttcactaaccggatccaggcagccttccgggagccacagcttcctgtggttactgaccccagggctgaccaccagcctctcacggaggtatcttat

SEQ ID NO: 5131 - DNA, 201 bp, Homo sapiens; identical to SEQ ID NO: 5123

SEQ ID NO: 5132 - DNA, 201 bp, Homo sapiens
acctgggagaagcttctgctggcagctcgtgccattgttgccattgaaaaccctgctgatgtcagtgttatatcctccaggaatactggccagagggccaygctgaagtttgctgctgccactggagccactccaattgctggccacttcactcctggaaccttcactaaccggatccaggcagccttccgggagccacag

SEQ ID NO: 5133 - DNA, 201 bp, Homo sapiens; identical to SEQ ID NO: 5125

SEQ ID NO: 5134 - DNA, 201 bp, Homo sapiens
ttggacacaagccttctccaggtgtggttcccaacaaaggtcagtttcccttggctgtgggagcccaggagttgtttctgtgcactggtcctatgtgccgytatgctgaagacctggcccccatgttgaaggtcatggcaggacctgggatcaaaaggttaaaactagacacaaaggtacatttaaaagacttaaaatttt

SEQ ID NO: 5135 - DNA, 201 bp, Homo sapiens
cgatggcaccttcatttaccgcccgcattcagttgttcctcttgcgggcgctaggctttctcataggcttagtaggccgagcagctttagtcttagggggyccaaagtttgcctcaaagacccctcggccggtgactgaaccattgcttctgctttcggggatgcagctggccaagctgatccgacagagaaaggtgaaat

SEQ ID NO: 5136 - DNA, 201 bp, Homo sapiens
tgcgtaaagagctggtggatatgctaggtgatgatggtgtgttcttatatccctcacatcccacagtggcacctaagcatcatgtccctctaacacggccyttcaactttgcttacacaggtgtcttcagtgccctgggtttgcctgtgacccaatgcccactgggactgaatgccaaaggactccctttaggcatccagg

SEQ ID NO: 5137 - DNA, 201 bp, Homo sapiens
ggctgggtctgtccaggaaagttttaggaggaccttctgcaaggttaatgtgtgtgtgtgtttgtgttcgtgtggtggtgtttctattaattgggtgaaaycaagcaccagcagacaagcagagaaacaactggggaatttattgactcatttagttattctttctacttttatttccttctctaactgttggtcttacta

SEQ ID NO: 5138 - DNA, 201 bp, Homo sapiens; identical to SEQ ID NO: 5134

SEQ ID NO: 5139 - DNA, 201 bp, Homo sapiens; identical to SEQ ID NO: 5135

SEQ ID NO: 5140 - DNA, 201 bp, Homo sapiens; identical to SEQ ID NO: 5136

SEQ ID NO: 5141 - DNA, 201 bp, Homo sapiens; identical to SEQ ID NO: 5137

SEQ ID NO: 5142 - DNA, 201 bp, Homo sapiens
gtggggaaagctgggaaggaggagcggaaaggagcagcccaggaaaagaagcaactggggatcaaagacaaagaagacaagaaaggagccaagctgctcgrgaaagaggaccgtcccaacagcaagaagcacaaggcaaaggatgacaagaaagtcataaaatctgcaagtcaggacaggttttctttggaagaccctacc

SEQ ID NO: 5143 - DNA, 201 bp, Homo sapiens
gagggaacacccagctggctgagcggatacctacctcaccctgtctgatgaccctcatctctgctgaaggagagtcaaagcaaaaagccccaaaagaagasaagagacctccctgggccccacctcctcagcacaactttctgaaaaactggcagcgtaacacagccctgcggaagaagcagcaggaagccctcagcgaac

SEQ ID NO: 5144 - DNA, 168 bp, Homo sapiens
acctgatggtcctggctgatgagctcagccccataaagaatgtcgaggaggctttgcgcctctgcaggtgactctcgggcccaagcaaccttctggaaaaygggttaataaataaatcaataaagaaccttcaagtttctactacttccgtgtgcctctgtgtcttgc

SEQ ID NO: 5145 - DNA, 201 bp, Homo sapiens
aggaagccccactccatccgggtggagacaggattaccagcccagagggacgcttcataccgctacacctgggatcggagtctgtttctgatctaccgacrcaaggagctgcagagaatcatggaagagctggatttcagccagcaggatattgatggcctggaggtggtgggcaaagggtggcccttctcggctgttact

SEQ ID NO: 5146 - DNA, 201 bp, Homo sapiens
tgactgcacacttccaacccggcgtgataggaaaagctgggagaacagtgggttctggagtcgactggaatacttgggagatgagatgacaggtctggtcrtgaccaagacaaaaactcagcgtggcctcatggagcccatcactcacatcaggaagccccactccatccgggtggagacaggattaccagcccagaggga

SEQ ID NO: 5147 - DNA, 201 bp, Homo sapiens
gtgggttctggagtcgactggaatacttgggagatgagatgacaggtctggtcatgaccaagacaaaaactcagcgtggcctcatggagcccatcactcayatcaggaagccccactccatccgggtggagacaggattaccagcccagagggacgcttcataccgctacacctgggatcggagtctgtttctgatctacc

SEQ ID NO: 5148 - DNA, 201 bp, Homo sapiens
caagtcaggacaggttttctttggaagaccctacccctgacatcatcctctcttctcaagaacccatagaccccctggtcatggggaaatacacccagagsctgcacagtgaggtccgtgggctgctggacaccctggtgaccgacctgatggtcctggctgatgagctcagccccataaagaatgtcgaggaggctttgc

SEQ ID NO: 5149 - DNA, 201 bp, Homo sapiens
tggcctggaggtggtgggcaaagggtggcccttctcggctgttactgtggaagactacacagtgtttgaaagaagtcagggaagctcctctgaagacacarcatacttaggcacattggccagttcctctgatgtctccatgcctattctcggcccttctctgctgttctgtgggaagccagcttgctggatcagaggcag

SEQ ID NO: 5150 - DNA, 201 bp, Homo sapiens
tcatcctctcttctcaagaacccatagaccccctggtcatggggaaatacacccagaggctgcacagtgaggtccgtgggctgctggacaccctggtgacygacctgatggtcctggctgatgagctcagccccataaagaatgtcgaggaggctttgcgcctctgcaggtgactctcgggcccaagcaaccttctggaaa

SEQ ID NO: 5151 - DNA, 201 bp, Homo sapiens; identical to SEQ ID NO: 5143

SEQ ID NO: 5152 - DNA, 201 bp, Homo sapiens; identical to SEQ ID NO: 5146

SEQ ID NO: 5153 - DNA, 168 bp, Homo sapiens; identical to SEQ ID NO: 5144

SEQ ID NO: 5154 - DNA, 201 bp, Homo sapiens; identical to SEQ ID NO: 5145

SEQ ID NO: 5155 - DNA, 201 bp, Homo sapiens; identical to SEQ ID NO: 5148

SEQ ID NO: 5156 - DNA, 201 bp, Homo sapiens; identical to SEQ ID NO: 5147

SEQ ID NO: 5157 - DNA, 201 bp, Homo sapiens; identical to SEQ ID NO: 5150

SEQ ID NO: 5158 - DNA, 201 bp, Homo sapiens; identical to SEQ ID NO: 5149

SEQ ID NO: 5159 - DNA, 198 bp, Homo sapiens
gagggaacacccagctggctgagcggatacctacctcaccctgtctgatgaccctcatctctgctgaaggagagtcaaagcaaaaagccccaaaagaagasaagagacctccctgggccccacctcctcagcacaactttctgaaaaactggcagcgtaacacagccctgcggaagaagcagcaggaagccctcagcg

SEQ ID NO: 5160 - DNA, 201 bp, Homo sapiens
acttaggaagttgaagtttggcattaaaataaaggactcgccaccactctgtgcaccttcttgagggagttcattcgtccggagcgcctcacagcttagtrcgcctgcgcacgcgcgaactgcggccccgcctctcctttggggacgggagacgtgcgtcgggtcgcgggacgggggctgcgcatgcgccttcatttcgtc

SEQ ID NO: 5161 - DNA, 120 bp, Homo sapiens
aaatcagttatttttagctttttagaactttgatctgctagggattgtcaaaataatctccttgaggcatctttatttttaaaatgagattaaagtatgtkatttgcttgttatgtggct

SEQ ID NO: 5162 - DNA, 201 bp, Homo sapiens
ctgggaagctgccagtgagatttcagagaccaagagcgcgaaggggcgggcgatgtggcaatccgtctgggatgtgaaaagcgtggagcgcatttagaggmattcgacgaaaacacaggaaatcactcctctcccgctcctgggcgccgctgccactggggcagaggactgggaaccgcggcagcgggataagtggcccag

SEQ ID NO: 5163 - DNA, 201 bp, Homo sapiens
aagaggattaatgattgaaacttaaaattgagacaatcttgtgtttcctaaactgttacagtacatttctcagcatccttgtgacagaaagctgcaagaakggcactttttgattcatacagggatttcttatgtctttggctacactagatattttgtgattggcaagacatgtatttaaacaataaactaaaaggaaat

SEQ ID NO: 5164 - DNA, 201 bp, Homo sapiens
tttaaatagttttactattttaaatgattgccgtacaattagtagacttgaagacaagttttaaatatttttcttcaaaggcttgttaaaccaatcatgtwaaaaggaaattcttggttttggtttgttgttgttagcattagtcatatttgatttagagggtaacttaaatcagttatttttagctttttagaactttga

SEQ ID NO: 5165 - DNA, 201 bp, Homo sapiens
gcgcacgcgcgaactgcggccccgcctctcctttggggacgggagacgtgcgtcgggtcgcgggacgggggctgcgcatgcgccttcatttcgtcagcccrctgttgcgtgctgccagcgggaactgtgtaggggtagattttcgctgcagtgttccccgagcctgttagacgcagcgcgccgggagactgagagaggaaa

SEQ ID NO: 5166 - DNA, 201 bp, Homo sapiens
agtgcgcctgcgcacgcgcgaactgcggccccgcctctcctttggggacgggagacgtgcgtcgggtcgcgggacgggggctgcgcatgcgccttcatttmgtcagcccgctgttgcgtgctgccagcgggaactgtgtaggggtagattttcgctgcagtgttccccgagcctgttagacgcagcgcgccgggagactga

SEQ ID NO: 5167 - DNA, 201 bp, Homo sapiens
cttccctgttcccgaactttctgaccaagagggtgattccagttctgaagaggattaatgattgaaacttaaaattgagacaatcttgtgtttcctaaacwgttacagtacatttctcagcatccttgtgacagaaagctgcaagaatggcactttttgattcatacagggatttcttatgtctttggctacactagatat

SEQ ID NO: 5168 - DNA, 201 bp, Homo sapiens
acaggtggtccaggctatccagcgccacatacactttgatgttgtaaagtgcatcctggtggccagcccaggatttgtgagggagcagttctgcgactacmtgtttcaacaagcagtgaagaccgacaacaaactgctcctggaaaaccggtccaaatttcttcaggtacatgcctcctccggacacaagtactccctgaa

SEQ ID NO: 5169 - DNA, 201 bp, Homo sapiens; identical to SEQ ID NO: 5160

SEQ ID NO: 5170 - DNA, 120 bp, Homo sapiens; identical to SEQ ID NO: 5161

SEQ ID NO: 5171 - DNA, 201 bp, Homo sapiens; identical to SEQ ID NO: 5162

SEQ ID NO: 5172 - DNA, 201 bp, Homo sapiens; identical to SEQ ID NO: 5163

SEQ ID NO: 5173 - DNA, 201 bp, Homo sapiens; identical to SEQ ID NO: 5164

SEQ ID NO: 5174 - DNA, 201 bp, Homo sapiens; identical to SEQ ID NO: 5165

SEQ ID NO: 5175 - DNA, 201 bp, Homo sapiens; identical to SEQ ID NO: 5166

SEQ ID NO: 5176 - DNA, 201 bp, Homo sapiens; identical to SEQ ID NO: 5167

SEQ ID NO: 5177 - DNA, 201 bp, Homo sapiens; identical to SEQ ID NO: 5168

SEQ ID NO: 5178 - DNA, 201 bp, Homo sapiens
aaggcacattacaaaaggctaaatgctgctgtttctaagtggaagcactgttgaacaacactcttaggtggaataagaaaattagggttaaactgtaacaytgtaatcggacgaacaaatcagcatctttgatcctcaggttaaaatttaatcttaaatttagaaattcaaagtaacagcctttaaccattaaccttgagg

SEQ ID NO: 5179 - DNA, 201 bp, Homo sapiens
ctgagacagattacacgatagacagatagatagatagatagatagatagatagatagatagatagatagatattgatagagaacatgttgtgtctatatamatatccaatgacacacagtataatcatgttttaaattatgccaaaagtactgattatatcaagcccagtaaacataatgctacacagcacccattcttta

SEQ ID NO: 5180 - DNA, 201 bp, Homo sapiens
aaagaggcttgtagtaaacagatatttttacaaaatttgatgcttctgcaaccataataattttatctataaatgcgtatatacatatatatatatatatwcacatacactcacatgcagatatttacatatatagatattctcttttccttttataaaatcaaagtctaggctcaattggaaaatggaaatatttgcacc

SEQ ID NO: 5181 - DNA, 201 bp, Homo sapiens
gaaaatgggtgcttattggttctccgttagttggccaacccaaaaacagaactggagatgtctataagtgtccagttgggagaggtgaatcattaccttgygtaaagttggatctaccagttaatacatcaattcccaatgtcacagaagtaaaggagaacatgacatttggatcaactttagtcaccaacccaaatggag

SEQ ID NO: 5182 - DNA, 201 bp, Homo sapiens; identical to SEQ ID NO: 5162

SEQ ID NO: 5183 - DNA, 201 bp, Homo sapiens
tatctttgttggtgagcagacactcagagatcctttaattatctgacacaccagggaaatcttggcaatcaactaaggacctgtgacactcataactatgwttacatttggctttagcatatttcaggtaatatctttatgaaaaaaagatgaagtatggaattgtaggaactcttttgcaatagactgagatccaatgtt

SEQ ID NO: 5184 - DNA, 201 bp, Homo sapiens
atatagcaaaagctttccccagtagctgatgaatttagaactttatacaagactccctagcattttcctcctcccacaggctggagaatttcagtgctatsagactgggcagtaggagccagagccaatttgcaggatctcttttccttctgccttccagttggcttctcttctcagctgcgtggtggggatgatttgggg

SEQ ID NO: 5185 - DNA, 201 bp, Homo sapiens
cctgcttttcacaacattgagaaacaggcccagagcctgtctcatgtgccaggtgcagtcacattattgttaaaataaagtggcttctgacaaatcagttyttcaaaatagcatcctatgtacttttcatttcttccaacaaccctcaggcccccttttgccagttttctcccccaggggagattttcaagactactggag

SEQ ID NO: 5186 - DNA, 201 bp, Homo sapiens
tatttaatgattaagaaatgtactagactctatcatttacttttaaaacatttaattagaaaaacaggtgatatttaagactatttataaacttattggcyaaattgccaaaaagtttctttttctctaactttggtattctaaataattgattattgctcccattgtaaactgaaccatgtatgcactctcttttctgac

SEQ ID NO: 5187 - DNA, 201 bp, Homo sapiens
acttcttctgacatcagccaagtcaatgtttcgcttatcttgtggaaaccaacttttataaaatcatatttttccagcttaaatcttactataaggggagracttcggagtgaaaatgcatctctggttttaagtagcagcaatcaaaaaagagagcttgctattcaaatatccaaagatgggctaccgggcagagtgcca

SEQ ID NO: 5188 - DNA, 201 bp, Homo sapiens
tagtaaagctaacggatccattgaaattcatactcagcatctgtgactactagacaaagcccatttactgaaccataagtgtgcacttttaaactaaattrttaactgaaagggaaaaaatagaaatgagggcattttgaagtttttagaaaagagaggaagagctgttggccagatcaaagagatacttataagcccggc

SEQ ID NO: 5189 - DNA, 201 bp, Homo sapiens
tttttaaactaatttccaaagaatttagctgaagactcagagtcagcctacctcttgactctccacatccgcatctaagatcctgaaggccaaaggaatgygcctgtgggatgccaaagccatcagtagctggaagaaagaatacctctttctagaggtttggtgtcctcttgctggcctgtcattatttggaaatacgcg

SEQ ID NO: 5190 - DNA, 201 bp, Homo sapiens
ccacatagaaattaaatgttataaatttatttttttaaactaatttccaaagaatttagctgaagactcagagtcagcctacctcttgactctccacatcygcatctaagatcctgaaggccaaaggaatgcgcctgtgggatgccaaagccatcagtagctggaagaaagaatacctctttctagaggtttggtgtcctc

SEQ ID NO: 5191 - DNA, 201 bp, Homo sapiens
aacctcctgaaaccctttctgataatgtagtaaacatttctatcccggtaaaatatgaagttggactacagttttacagctctgcaagtgaataccacatktcaattgctgccaatgagacagtccctgaagttattaattctactgaggacattggaaatgaaattaatatcttctacttgattagaaaaagtggatctt

SEQ ID NO: 5192 - DNA, 201 bp, Homo sapiens
gcactccttctacatgttgcatgactttcaggactctgtgagaataacgttggactttaatcttaccgatccagaaaatgggcctgttcttgatgattctytaccaaactcagtacatgaatatattccctttgccaaagattgtggaaataaggaaaaatgtatctcagacctcagcctgcatgtcgccaccactgaaaa

SEQ ID NO: 5193 - DNA, 201 bp, Homo sapiens
aatgaaatacgacagcagagaaagatgccactgaaatgctgaaattatctttgctgagcagcttttgaatgctaagggttccagtatgtgacccaaagaargagttgtctcaactccttggtacagggttcattcaaacccccaagctgtgagagtgtgtttatttttaattttttaaaaggtatttaatttccaaccaca

SEQ ID NO: 5194 - DNA, 201 bp, Homo sapiens
agtatattaaatgggttaaattaagcttttacagaacatgcttaattttgatattgagctctaaatgcaaaactcttttatactgaaaaaacacttaaagyagttttgtgtggcatcacagtgatttgtcatgaaaagccatatatgggggacatgctaaaatggcttctgaatgaaatacgacagcagagaaagatgcca

SEQ ID NO: 5195 - DNA, 201 bp, Homo sapiens
ctgcatgtgtgaactactgctgtaaagtttgctgacatttctgcaacaacatttctccatctgatttaccagaacctgtaacaagaccagaacatgtattyatccagaaactcctgggctctgctttgttcaaagaggagcaaatccacatagaaattaaatgttataaatttatttttttaaactaatttccaaagaatt

SEQ ID NO: 5196 - DNA, 201 bp, Homo sapiens
tgttcttatgccccaagatctgcaccttacatcaggcacccgggaatgcttctcattgaaattttaccataccaaaaaatatgtaagggtgactcatcacycctaactttggactccttgctttgagatcggtatttttttctctctctttacatatagcaaaagctttccccagtagctgatgaatttagaactttatac

SEQ ID NO: 5197 - DNA, 201 bp, Homo sapiens
caagtgaacccactgaaaagcatttcttcaatgtctctgatgaattggctctagtcaccattgttaaaactctgggagaaagaatatttgccctggaagcyacagctgaccagtcagcagcttcatttgaaatggaaatgtctcagactggcttcagtgctcattattcacaggactgggtcatgcttggagcagtaggag

SEQ ID NO: 5198 - DNA, 201 bp, Homo sapiens
tagtataatggaggagggacaaagcagaatatacttccaagctggaacatctttaagacatttacaaactgttatgggacactatcagcaactacgcctgbggaagctagcaggatttagctcttcaatggccctccaaatgcacccaacaatcgccaacctcacccatggaaatcatctaaaaaatgaaaagaagggcct

SEQ ID NO: 5199 - DNA, 201 bp, Homo sapiens
tatccacggagaaatggatttaaatggtgacggtctgacagatgtgactattgggggccttggtggtgctgccctcttctggtcccgagatgtggccgtarttaaagtgaccatgaattttgagccaaataaagtgaatattcaaaagaaaaactgccatatggagggaaaggaaacagtatgcataaatgctacagtgtg

SEQ ID NO: 5200 - DNA, 110 bp, Homo sapiens
ggtatttttgtataattctgtcttatctggtgcatcagctgtgtattttacgtcaaggtaaatgagcatcctgttttatatgttaaattttaaaaatgackttttcaaag

SEQ ID NO: 5201 - DNA, 201 bp, Homo sapiens
tgaagtagtcattatggttcattggaatctactgtagcataagctcctaggttgctccatttcttaggaaaatagcaatgaatgaatgtatagtagctgcwtgtgtgaactactgctgtaaagtttgctgacatttctgcaacaacatttctccatctgatttaccagaacctgtaacaagaccagaacatgtattcatcc

SEQ ID NO: 5202 - DNA, 201 bp, Homo sapiens
cattcaggaacaaagaagcataacctttgttgactcttgtaatttattatatgcttcatttaaacccattttgtaaagaaatcaggtaacagtcatttaayctgatataattagaaatagctgagagagtaaaaaagcattttgaatgtcctatgtatggcatatcctgtacaccaattgaaggtcagagctttggtattt

SEQ ID NO: 5203 - DNA, 201 bp, Homo sapiens
ttcttgaagtagtcattatggttcattggaatctactgtagcataagctcctaggttgctccatttcttaggaaaatagcaatgaatgaatgtatagtagytgcatgtgtgaactactgctgtaaagtttgctgacatttctgcaacaacatttctccatctgatttaccagaacctgtaacaagaccagaacatgtattc

SEQ ID NO: 5204 - DNA, 201 bp, Homo sapiens
actgttttatttctgatattgcctgccattactcaggatgcaagagatgctctgcattccttattaggaaaaattggcctgtaaggagaatggtatactgygtattactactgtgagactgtaaaattgttaatggacagtgtaaagaattgtattcattttattagcaagaaaaatattgcatacaagaactactgccct

SEQ ID NO: 5205 - DNA, 201 bp, Homo sapiens
aaaattaagtcaccaagaatacatttagcatctttgtgttgggttctatacctaaaaattttccctccctgcccaaggtgattggaaagtactgcaattgrgctaaaattttatctaggatggaaaatcaggatagactcgtttaaaaacaagtatattaaatgggttaaattaagcttttacagaacatgcttaattttg

SEQ ID NO: 5206 - DNA, 201 bp, Homo sapiens
attaaccaaggctaatttcctggagtttaatacactttggattcaagtaaaaacaatcacttaatgcagcaacatctcagaccctcttcactctagaaccrttttatacaagagaactcaacatttactgttttatttctgatattgcctgccattactcaggatgcaagagatgctctgcattccttattaggaaaaatt

SEQ ID NO: 5207 - DNA, 201 bp, Homo sapiens
ccaagaagtcactgctttttaggtgtgttgcatcaatatttaaataaaatcccagaaatgtattttaaagaatttcaggtttgaaaactcaaaccaacagraagatatcacacctttgtatgtgcttctttgttcttgaagtagtcattatggttcattggaatctactgtagcataagctcctaggttgctccatttctt

SEQ ID NO: 5208 - DNA, 201 bp, Homo sapiens
aagaaaagaattacctgaaaaagatcatttctccctattcaaatgagaatattttcccttggtagaatccatatacaatatggattgaaaattaagtcacsaagaatacatttagcatctttgtgttgggttctatacctaaaaattttccctccctgcccaaggtgattggaaagtactgcaattgagctaaaattttat

SEQ ID NO: 5209 - DNA, 201 bp, Homo sapiens
ctgggaagcagtgagccaacataattgtcctttcctctacagaatagctgtgcagaaggggaccaccacacttaggaccagtgccaggtgacaatctttcygtcatgctgctgcagcattttgcaccttgagagacaggaaaaaaaatgggggtgagggagtggaagatgatgaaactatttctcttttatgtctacatcc

SEQ ID NO: 5210 - DNA, 201 bp, Homo sapiens
tctaggctcaattggaaaatggaaatatttgcaccaaaagaaaaaagtgccattgttgtgatcaatggagtaaagctggggtatagtagaggctggggaakccctgcccatgttctctccaaggccacagcttgcacaccgtgaatggtggccccactggctccatggagtgtgccttcacgcgggggaatgtccttgtcc

SEQ ID NO: 5211 - DNA, 201 bp, Homo sapiens
gatatccatgttcagcatgacagtcagcactcgtaaatgccaagaaaagaattacctgaaaaagatcatttctccctattcaaatgagaatattttccctyggtagaatccatatacaatatggattgaaaattaagtcaccaagaatacatttagcatctttgtgttgggttctatacctaaaaattttccctccctgcc

SEQ ID NO: 5212 - DNA, 201 bp, Homo sapiens
cacaatgaaagccagttgtggtcttgaaaaatctctctattgcattacttatcctcacccttgttttttaagaggtagagagagattactgggaagcagtkagccaacataattgtcctttcctctacagaatagctgtgcagaaggggaccaccacacttaggaccagtgccaggtgacaatctttccgtcatgctgctg

SEQ ID NO: 5213 - DNA, 201 bp, Homo sapiens
tgccggattgttgctgttaatgctgctcattttagcactgtggaagattggattcttcaaaagaccactgaaaaagaaaatggagaaatgaaatattttaygaaagaaaataataacaattattcaataatctatcctcaggtttgcctcaaatatgtgacaagaaatgtataattcatgacatagtcatgtaactatgta

SEQ ID NO: 5214 - DNA, 201 bp, Homo sapiens
aaatcaggatagactcgtttaaaaacaagtatattaaatgggttaaattaagcttttacagaacatgcttaattttgatattgagctctaaatgcaaaacycttttatactgaaaaaacacttaaagtagttttgtgtggcatcacagtgatttgtcatgaaaagccatatatgggggacatgctaaaatggcttctgaat

SEQ ID NO: 5215 - DNA, 201 bp, Homo sapiens
aaagaagacacgatttatgaagctgatttgcagtaccgtgtcaccctagattcactaagacaaatatcacgaagttttttctctggaactcaagagagaarggttcaaaggaacatcacagttcgaaaatcagaatgcactaagcactccttctacatgttgcatgactttcaggactctgtgagaataacgttggacttt

SEQ ID NO: 5216 - DNA, 201 bp, Homo sapiens
tctggagatgtgctctatattgctggacagcctcggtacaatcatacaggccaggtcattatctacaggatggaagatggaaacatcaaaattctccagaygctcagtggagaacagattggttcctactttggcagtattttaacaacaactgacattgacaaggattctaatactgacattcttctagtcggagcccct

SEQ ID NO: 5217 - DNA, 201 bp, Homo sapiens
gtgttacagcttttttaaatgaccttcttgaaagaatggatattggtcctaaacagacacaggttggaattgtacagtatggagaaaacgtgacccatgarttcaacctcaataagtattcttccaccgaagaggtacttgttgcagcaaagaaaatagtccagagaggtggccgccagactatgacagctcttggaatag

SEQ ID NO: 5218 - DNA, 201 bp, Homo sapiens
tggcttctgacaaatcagtttttcaaaatagcatcctatgtacttttcatttcttccaacaaccctcaggcccccttttgccagttttctcccccaggggrgattttcaagactactggagaaaaatctgttaataaaacatttgctctgagtaccagcttcagtgactcaatcatttatacaggatttcagtgttttgtt

SEQ ID NO: 5219 - DNA, 201 bp, Homo sapiens
tgagctaaaattttatctaggatggaaaatcaggatagactcgtttaaaaacaagtatattaaatgggttaaattaagcttttacagaacatgcttaattytgatattgagctctaaatgcaaaactcttttatactgaaaaaacacttaaagtagttttgtgtggcatcacagtgatttgtcatgaaaagccatatatgg

SEQ ID NO: 5220 - DNA, 201 bp, Homo sapiens
ccttggtagaatccatatacaatatggattgaaaattaagtcaccaagaatacatttagcatctttgtgttgggttctatacctaaaaattttccctccckgcccaaggtgattggaaagtactgcaattgagctaaaattttatctaggatggaaaatcaggatagactcgtttaaaaacaagtatattaaatgggttaa

SEQ ID NO: 5221 - DNA, 201 bp, Homo sapiens
gcgtgagcagcagccgggacccccgggctgccatccagaatgggttttggttctttaagttcctgatcctggtgggcctcaccgtgggtgccttctacatycctgacggctccttcaccaacatctggttctacttcggcgtcgtgggctccttcctcttcatcctcatccagctggtgctgctcatcgactttgcgcact

SEQ ID NO: 5222 - DNA, 201 bp, Homo sapiens
cctgggtgtgtgaggagggggccgggatccccaccgtcctgcagggccacatcgactgtggctccctgcttggctaccgcgctgtctaccgcatgtgcttygccacggcggccttcttcttctttttcaccctgctcatgctctgcgtgagcagcagccgggacccccgggctgccatccagaatgggttttggttcttta

SEQ ID NO: 5223 - DNA, 201 bp, Homo sapiens
gagagggagaaggggctgcagcggctgctgaatctcgggactcgctttcctttgtccctgacgggttgtgtgtgtgtgtgtgtgtgtgtgtgtgtgtgtgwgagagagagagagagagaggagggggtgtaggggagagctgagggtctagagatttactttacagcctttttctgagaatgagatcagcatagacagcac

SEQ ID NO: 5224 - DNA, 201 bp, Homo sapiens
gcaggcctcggtcatcaccctctacaccatgtttgtcacctggtcagccctatccagtatccctgaacagaaatgcaacccccatttgccaacccagctgrgcaacgagacagttgtggcaggccccgagggctatgagacccagtggtgggatgccccgagcattgtgggcctcatcatcttcctcctgtgcaccctctt

SEQ ID NO: 5225 - DNA, 201 bp, Homo sapiens
gtgtccatcattatgctgagcccgggcgtggagagtcagctctacaagctgccctgggtgtgtgaggagggggccgggatccccaccgtcctgcagggccrcatcgactgtggctccctgcttggctaccgcgctgtctaccgcatgtgcttcgccacggcggccttcttcttctttttcaccctgctcatgctctgcgtg

SEQ ID NO: 5226 - DNA, 201 bp, Homo sapiens
gtgccttctacattcctgacggctccttcaccaacatctggttctacttcggcgtcgtgggctccttcctcttcatcctcatccagctggtgctgctcatygactttgcgcactcctggaaccagcggtggctgggcaaggccgaggagtgcgattcccgtgcctggtacgcaggcctcttcttcttcactctcctcttct

SEQ ID NO: 5227 - DNA, 201 bp, Homo sapiens
atgggttttggttctttaagttcctgatcctggtgggcctcaccgtgggtgccttctacattcctgacggctccttcaccaacatctggttctacttcggygtcgtgggctccttcctcttcatcctcatccagctggtgctgctcatcgactttgcgcactcctggaaccagcggtggctgggcaaggccgaggagtgcg

SEQ ID NO: 5228 - DNA, 201 bp, Homo sapiens
gtgaggagggggccgggatccccaccgtcctgcagggccacatcgactgtggctccctgcttggctaccgcgctgtctaccgcatgtgcttcgccacggcrgccttcttcttctttttcaccctgctcatgctctgcgtgagcagcagccgggacccccgggctgccatccagaatgggttttggttctttaagttcctga

SEQ ID NO: 5229 - DNA, 167 bp, Homo sapiens
gagcggggctgctggagagagcggggaactcccaccacagtggggcatccggcactgaagccctggtgttcctggtcacgtcccccaggggaccctgcccbcttcctggacttcgtgccttactgagtctctaagactttttctaataaacaagccagtgcgtgtac

SEQ ID NO: 5230 - DNA, 188 bp, Homo sapiens
ccttgtcctcaggctccacgggagcggggctgctggagagagcggggaactcccaccacagtggggcatccggcactgaagccctggtgttcctggtcacktcccccaggggaccctgcccacttcctggacttcgtgccttactgagtctctaagactttttctaataaacaagccagtgcgtgtac

SEQ ID NO: 5231 - DNA, 114 bp, Homo sapiens
actgaagccctggtgttcctggtcacgtcccccaggggaccctgcccacttcctggacttcgtgccttactgagtctctaagactttttctaataaacaarccagtgcgtgtac

SEQ ID NO: 5232 - DNA, 201 bp, Homo sapiens; identical to SEQ ID NO: 5221

SEQ ID NO: 5233 - DNA, 201 bp, Homo sapiens; identical to SEQ ID NO: 5222

SEQ ID NO: 5234 - DNA, 201 bp, Homo sapiens; identical to SEQ ID NO: 5224

SEQ ID NO: 5235 - DNA, 201 bp, Homo sapiens; identical to SEQ ID NO: 5225

SEQ ID NO: 5236 - DNA, 201 bp, Homo sapiens; identical to SEQ ID NO: 5226

SEQ ID NO: 5237 - DNA, 201 bp, Homo sapiens; identical to SEQ ID NO: 5227

SEQ ID NO: 5238 - DNA, 201 bp, Homo sapiens; identical to SEQ ID NO: 5228

SEQ ID NO: 5239 - DNA, 167 bp, Homo sapiens; identical to SEQ ID NO: 5229

SEQ ID NO: 5240 - DNA, 188 bp, Homo sapiens; identical to SEQ ID NO: 5230

SEQ ID NO: 5241 - DNA, 114 bp, Homo sapiens; identical to SEQ ID NO: 5231

SEQ ID NO: 5242 - DNA, 201 bp, Homo sapiens; identical to SEQ ID NO: 5221

SEQ ID NO: 5243 - DNA, 201 bp, Homo sapiens; identical to SEQ ID NO: 5222

SEQ ID NO: 5244 - DNA, 201 bp, Homo sapiens; identical to SEQ ID NO: 5224

SEQ ID NO: 5245 - DNA, 201 bp, Homo sapiens; identical to SEQ ID NO: 5225

SEQ ID NO: 5246 - DNA, 201 bp, Homo sapiens; identical to SEQ ID NO: 5226

SEQ ID NO: 5247 - DNA, 201 bp, Homo sapiens; identical to SEQ ID NO: 5227

SEQ ID NO: 5248 - DNA, 201 bp, Homo sapiens; identical to SEQ ID NO: 5228

SEQ ID NO: 5249 - DNA, 167 bp, Homo sapiens; identical to SEQ ID NO: 5229

SEQ ID NO: 5250 - DNA, 188 bp, Homo sapiens; identical to SEQ ID NO: 5230

SEQ ID NO: 5251 - DNA, 114 bp, Homo sapiens; identical to SEQ ID NO: 5231

SEQ ID NO: 5252 - DNA, 201 bp, Homo sapiens; identical to SEQ ID NO: 5221

SEQ ID NO: 5253 - DNA, 201 bp, Homo sapiens; identical to SEQ ID NO: 5222

SEQ ID NO: 5254 - DNA, 201 bp, Homo sapiens; identical to SEQ ID NO: 5224

SEQ ID NO: 5255 - DNA, 201 bp, Homo sapiens; identical to SEQ ID NO: 5225

SEQ ID NO: 5256 - DNA, 201 bp, Homo sapiens; identical to SEQ ID NO: 5226

SEQ ID NO: 5257 - DNA, 201 bp, Homo sapiens; identical to SEQ ID NO: 5227

SEQ ID NO: 5258 - DNA, 201 bp, Homo sapiens; identical to SEQ ID NO: 5228

SEQ ID NO: 5259 - DNA, 167 bp, Homo sapiens; identical to SEQ ID NO: 5229

SEQ ID NO: 5260 - DNA, 188 bp, Homo sapiens; identical to SEQ ID NO: 5230

SEQ ID NO: 5261 - DNA, 114 bp, Homo sapiens; identical to SEQ ID NO: 5231

SEQ ID NO: 5262 - DNA, 201 bp, Homo sapiens; identical to SEQ ID NO: 5221

SEQ ID NO: 5263 - DNA, 201 bp, Homo sapiens; identical to SEQ ID NO: 5222

SEQ ID NO: 5264 - DNA, 201 bp, Homo sapiens; identical to SEQ ID NO: 5224

SEQ ID NO: 5265 - DNA, 201 bp, Homo sapiens; identical to SEQ ID NO: 5225

SEQ ID NO: 5266 - DNA, 201 bp, Homo sapiens; identical to SEQ ID NO: 5226

SEQ ID NO: 5267 - DNA, 201 bp, Homo sapiens; identical to SEQ ID NO: 5227

SEQ ID NO: 5268 - DNA, 201 bp, Homo sapiens; identical to SEQ ID NO: 5228

SEQ ID NO: 5269 - DNA, 167 bp, Homo sapiens; identical to SEQ ID NO: 5229

SEQ ID NO: 5270 - DNA, 188 bp, Homo sapiens; identical to SEQ ID NO: 5230

SEQ ID NO: 5271 - DNA, 114 bp, Homo sapiens; identical to SEQ ID NO: 5231

SEQ ID NO: 5272 - DNA, 201 bp, Homo sapiens
tcagacactctgtcaacagcactctcccccagttctctacctccaaaaatatccacagctttccacacccagcagagtgaaggtgcagagaccacaggacrgcctcatgagaggagctcattctctccaggtgtgtctcaagaaatatttactctacatgaaacaacaacatggccttcctcattctccagcaaaggccac

SEQ ID NO: 5273 - DNA, 201 bp, Homo sapiens
tccacaagcacctctcctcaggaatcaccagctgtttcccaaaggggtcacactcaagccccgcagaccacacaagaatcacaaaccacgaggtccgtctmccccatgactgacaccaagacagtcaccaccccaggttcttccttcacagccagtgggcactcgccctcagaaattgttcctcaggacgcacccaccata

SEQ ID NO: 5274 - DNA, 201 bp, Homo sapiens
aggacaagaaccagcagagggtctgacactatcagcctggcgtcccaggcaaccgacaccttctcaacagtcccacccacacctccatcgatcacatccastgggcttacatctccacaaacccagacccacactctgtcaccttcagggtctggtaaaaccttcaccacggccctcatcagcaacgccacccctcttcct

SEQ ID NO: 5275 - DNA, 201 bp, Homo sapiens
tcctcaggacgcacccaccataagtgcagcaacaacctttgccccagctcccaccggggatggtcacacaacccaggccccgaccacagcactgcaggcarcacccagcagccatgatgccaccctggggccctcaggaggcacgtcactttccaaaacaggtgcccttactctggccaactctgtagtgtcaacaccagg

SEQ ID NO: 5276 - DNA, 201 bp, Homo sapiens
gagggtcccctgggtgtccctgagctgcctgtgtctctgcctccttccgcatgtggtcccaggaaccacagaggacacattaataactggaagtaaaactsctgccccagtcacctcaacaggctcaacaacagcgacactagagggacaatcaactgcagcttcttcaaggacctctaatcaggacatatcagcttcatc

SEQ ID NO: 5277 - DNA, 201 bp, Homo sapiens
gacatcactatctgtaagtggaaccatttctgcaatcacttccaaagtttcaaccatatggtggtcagacactctgtcaacagcactctcccccagttctytacctccaaaaatatccacagctttccacacccagcagagtgaaggtgcagagaccacaggacggcctcatgagaggagctcattctctccaggtgtgtc

SEQ ID NO: 5278 - DNA, 201 bp, Homo sapiens
ctggagaggctcttctcagcagcccaagctacagtgtgactcagatgataaaaacggccacatccccatcttcttcacctatgctggatagacacacatcmcaacaaattacaacggcaccatcaacaaatcattcaacaatacattccacaagcacctctcctcaggaatcaccagctgtttcccaaaggggtcacactc

SEQ ID NO: 5279 - DNA, 201 bp, Homo sapiens
gtttctcaggagacattcccttctggtgaaacaaccatctcatccccttccagtgtcagcaatacattcctggtaacatcaaaggtgttcagaatgccaayctccagagactctactcttggaaacacagaggagacatcactatctgtaagtggaaccatttctgcaatcacttccaaagtttcaaccatatggtggtca

SEQ ID NO: 5280 - DNA, 201 bp, Homo sapiens
ctcacaccggttacaacatcaactgttttatcctcaccaagtggattcaacccaagtggaacagtttctcaggagacattcccttctggtgaaacaaccayctcatccccttccagtgtcagcaatacattcctggtaacatcaaaggtgttcagaatgccaatctccagagactctactcttggaaacacagaggagaca

SEQ ID NO: 5281 - DNA, 201 bp, Homo sapiens
cttggaaacacagaagagacatcaacagcaggaactgaaagttctaccccagtgacctcagcagtctcaataacagctggacaggaaggacaatcacgaamaacttcctggaggacctctatccaagacacatcagcttcttctcagaaccactggactcggagcacgcagaccaccagggaatctcaaaccagcacccta

SEQ ID NO: 5282 - DNA, 201 bp, Homo sapiens
gacaacctccacaggctccactcttggaaacccaggggagacatcatcagtacctgttactggaagtcttatgccagtcacctcagcagccttagtaacakttgatccagaaggacaatcaccagcaactttctcaaggacttctactcaggacacaacagctttttctaagaaccaccagactcagagcgtggagaccac

SEQ ID NO: 5283 - DNA, 201 bp, Homo sapiens
atcagtacctgttactggaagtcttatgccagtcacctcagcagccttagtaacagttgatccagaaggacaatcaccagcaactttctcaaggacttctmctcaggacacaacagctttttctaagaaccaccagactcagagcgtggagaccaccagagtatctcaaatcaacaccctcaacaccctcacaccggttac

SEQ ID NO: 5284 - DNA, 201 bp, Homo sapiens
attctccagcaaaggccacacaacttggtcacaaacagaactgccctcaacatcaacaggtgctgccactaggcttgtcacaggaaatccatctacagggrcagctggcactattccaagggtcccctctaaggtctcagcaataggggaaccaggagagcccaccacatactcctcccacagcacaactctcccaaaaac

SEQ ID NO: 5285 - DNA, 201 bp, Homo sapiens
gagctgcccagagaggcactactgggctcagggaaagctgtgctgccagatgtgtgagccaggaacattcctcgtgaaggactgtgaccagcatagaaagrctgctcagtgtgatccttgcataccgggggtctccttctctcctgaccaccacacccggccccactgtgagagctgtcggcactgtaactctggtcttct

SEQ ID NO: 5286 - DNA, 201 bp, Homo sapiens
ttccttgttttcaccctggccggggccctgttcctccatcaacgaaggaaatatagatcaaacaaaggagaaagtcctgtggagcctgcagagccttgtcrttacagctgccccagggaggaggagggcagcaccatccccatccaggaggattaccgaaaaccggagcctgcctgctccccctgagccagcacctgcggg

SEQ ID NO: 5287 - DNA, 201 bp, Homo sapiens
gcttggaggtgctaactccagaggccagcatcagcaactgggcacagaaaggagccgcctgggcagggaccatggcacggccacatccctggtggctgtgygttctggggaccctggtggggctctcagctactccagcccccaagagctgcccagagaggcactactgggctcagggaaagctgtgctgccagatgtgtg

SEQ ID NO: 5288 - DNA, 201 bp, Homo sapiens
gttacagctgccccagggaggaggagggcagcaccatccccatccaggaggattaccgaaaaccggagcctgcctgctccccctgagccagcacctgcggkagctgcactacagccctggcctccacccccaccccgccgaccatccaagggagagtgagacctggcagccacaactgcagtcccatcctcttgtcagggc

SEQ ID NO: 5289 - DNA, 201 bp, Homo sapiens
gagagaaaaaaaaaacagccacaatagagattctgccttcaaaggttggcttgccacctgaagcagccactgcccagggggtgcaaagaagagacagcagygcccagcttggaggtgctaactccagaggccagcatcagcaactgggcacagaaaggagccgcctgggcagggaccatggcacggccacatccctggtgg

SEQ ID NO: 5290 - DNA, 201 bp, Homo sapiens
gcgcccgagcagtacacgatgaccccaagataatgtggtccctccacattgccaaagtgcagagtgaccgtgagtacaagaaagattttgagaaatacaaracaaggtacagcagcccagtggacatgcttggtatcgttttggccaagaagtgtcagaccttggtcagcgatgtggactataaacatcctctgcatgaat

SEQ ID NO: 5291 - DNA, 201 bp, Homo sapiens
tggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcct

SEQ ID NO: 5292 - DNA, 201 bp, Homo sapiens
acccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacatt

SEQ ID NO: 5293 - DNA, 201 bp, Homo sapiens
agaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagcca

SEQ ID NO: 5294 - DNA, 201 bp, Homo sapiens
acctgcgtactacaaaagtcaacaaacaaatcagcgatatcctttataaattggaatacaacaaggccaaacccagaggctacaccacaatccacgacacrcccatgttgctgcatgtccgcaaggttaaagatgaagtcagtgatctgaaatacaaagaagtataccaaagaaataaatccaactgcaccattgagccag

SEQ ID NO: 5295 - DNA, 201 bp, Homo sapiens
aagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagt

SEQ ID NO: 5296 - DNA, 201 bp, Homo sapiens
cgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaa

SEQ ID NO: 5297 - DNA, 201 bp, Homo sapiens
cagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaa

SEQ ID NO: 5298 - DNA, 201 bp, Homo sapiens
atacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacac

SEQ ID NO: 5299 - DNA, 201 bp, Homo sapiens
ggagaaggtcaagaaagcaggcgatgcattaaatgagaggaagtatcgacagcacccagataccgtcaagttcacaagtgtgcctgattccatgggcatgrtgttggctcagcataacacaaagcagctaagtgatttgaactacaaggtagagggagagaaactgaagcacaagtatactattgaccctgaattgcctca

SEQ ID NO: 5300 - DNA, 201 bp, Homo sapiens
tgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatag

SEQ ID NO: 5301 - DNA, 201 bp, Homo sapiens
catccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaag

SEQ ID NO: 5302 - DNA, 201 bp, Homo sapiens
gggcatcggatggatccctattggttccctggaggtggagaaggtcaagaaagcaggcgatgcattaaatgagaggaagtatcgacagcacccagataccrtcaagttcacaagtgtgcctgattccatgggcatgatgttggctcagcataacacaaagcagctaagtgatttgaactacaaggtagagggagagaaact

SEQ ID NO: 5303 - DNA, 201 bp, Homo sapiens
tgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattc

SEQ ID NO: 5304 - DNA, 201 bp, Homo sapiens
atgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcag

SEQ ID NO: 5305 - DNA, 201 bp, Homo sapiens
actggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtac

SEQ ID NO: 5306 - DNA, 201 bp, Homo sapiens
ctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggat

SEQ ID NO: 5307 - DNA, 201 bp, Homo sapiens
ataaagacgagtataacagcttcttgaagggcatcggatggatccctattggttccctggaggtggagaaggtcaagaaagcaggcgatgcattaaatgasaggaagtatcgacagcacccagataccgtcaagttcacaagtgtgcctgattccatgggcatgatgttggctcagcataacacaaagcagctaagtgatt

SEQ ID NO: 5308 - DNA, 201 bp, Homo sapiens
cctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaag

SEQ ID NO: 5309 - DNA, 201 bp, Homo sapiens
atgagaacaccaaaaccagctaccatacccctggggacatggttagcatcacagctgcaaagatggcccaggatgtcgctaccaatgtcaactacaaacarccattgcatcattacacatacctacctgacgccatgagtcttgagcatacgaggaatgtcaatcaaattcagagtgataatgtgtataaagacgagtata

SEQ ID NO: 5310 - DNA, 201 bp, Homo sapiens
atgcagatgaggtgtccttcaaggatggagatgccatcataaatgttcaagcaattgatgaaggctggatgtatggcactgtgcagaggactggcaggacyggaatgctcccagccaactacgttgaagctatttaggcatttcaaagcatcacacttgtctgcaggacttacagatcctgcagtcaatgtttcggtttag

SEQ ID NO: 5311 - DNA, 201 bp, Homo sapiens
aagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatg

SEQ ID NO: 5312 - DNA, 201 bp, Homo sapiens
gcccggaactgaggagagttgcccaggcccagaaagctctcagtgatgttgcctacaaaaaaggtctcgctgaacagcaagctcaattcacgcctctggcygatcctccagatatagaatttgccaagaaagtaaccaatcaagtgagcaagcaaaaatacaaagaagactatgaaaataaaatcaaaggcaaatggagtg

SEQ ID NO: 5313 - DNA, 201 bp, Homo sapiens
gtgagcaagcaaaaatacaaagaagactatgaaaataaaatcaaaggcaaatggagtgagacaccttgctttgaagttgcaaatgccagaatgaatgctgrtaacattagcacagttaagaaataccaggaagattttgaaaacatgaaagaccagatctacttcatgcagaccgaaacaccagagtataaaatgaataaa

SEQ ID NO: 5314 - DNA, 201 bp, Homo sapiens
ccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggc

SEQ ID NO: 5315 - DNA, 201 bp, Homo sapiens
tggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaac

SEQ ID NO: 5316 - DNA, 201 bp, Homo sapiens
cctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagca

SEQ ID NO: 5317 - DNA, 201 bp, Homo sapiens
tcatatcaaagcagccaaggacgcctacaaagtcaacaccaatctggactataagaaacagtacgaagccaacaaagcccactggaagtggactcctgacygaccggacttcctccaggctgccaagtcatccctgcagcaaagcgattttgaatataagctggaccgggagttcctcaagggttgcaagctttctgtcac

SEQ ID NO: 5318 - DNA, 201 bp, Homo sapiens
tccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaa

SEQ ID NO: 5319 - DNA, 201 bp, Homo sapiens
gtctgagaacaagtacaaggaccatgtcaagaagcacttggcacagggctcatacacaacactaccagagacccgggacactgttcacgtcaaggaagtgmccaagcatgtcagtgatacaaattacaaaaagaagtttgtcaaggagaaaggaaaatccaactactccatcatgctggagccaccagaggtgaaacatgc

SEQ ID NO: 5320 - DNA, 201 bp, Homo sapiens
gtcaatgtgatttatggtagtaccatcctttctcctttgggttttaaaataagttgcagaacagacactttaaaagcttctgcaatattatttctgtgccyagagtctttctccattataaacatgttttaacattatttcttttctaaaacagggattttgaatatgccaaacacattaaaggaaaaatagcagagatgt

SEQ ID NO: 5321 - DNA, 201 bp, Homo sapiens
agatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaac

SEQ ID NO: 5322 - DNA, 201 bp, Homo sapiens
gccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagca

SEQ ID NO: 5323 - DNA, 201 bp, Homo sapiens
tatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatg

SEQ ID NO: 5324 - DNA, 201 bp, Homo sapiens
caagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggcca

SEQ ID NO: 5325 - DNA, 201 bp, Homo sapiens
agtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgacgtcatccatgctcggcaggcctatgacctccagagcgataatatgt

SEQ ID NO: 5326 - DNA, 201 bp, Homo sapiens
agttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaagg

SEQ ID NO: 5327 - DNA, 201 bp, Homo sapiens
agaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcct

SEQ ID NO: 5328 - DNA, 201 bp, Homo sapiens
ctccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggcatgacttaatagccaagggcaacaa

SEQ ID NO: 5329 - DNA, 201 bp, Homo sapiens
gaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctataca

SEQ ID NO: 5330 - DNA, 201 bp, Homo sapiens
gttttggacaccccagagatacagagagtccgggagaaccaaaagaacttcagccttctccaataccagtgtgaccttaaaaacagtaaaggaaaaattayagttgttcaagacacgccagaaatactgcgtgtaaaagaaaatcagaagaatttcagctcggttttatataaagaggatgtctcaccaggaacggctatc

SEQ ID NO: 5331 - DNA, 201 bp, Homo sapiens
agatacagagagtccgggagaaccaaaagaacttcagccttctccaataccagtgtgaccttaaaaacagtaaaggaaaaattacagttgttcaagacacrccagaaatactgcgtgtaaaagaaaatcagaagaatttcagctcggttttatataaagaggatgtctcaccaggaacggctatcggaaagacacctgaga

SEQ ID NO: 5332 - DNA, 201 bp, Homo sapiens
ttggctggatcccactggattctgtggaccatgtaagggttactaagaaccaggaaatgatgagtcagatcaaatataagaaaaatgcccttgaaaactaycctaactttagaagtgtggtggatcctccagagattgttttagccaagattaattctgtcaatcaaagtgatgtaaaatataaagaaacatttaataaag

SEQ ID NO: 5333 - DNA, 201 bp, Homo sapiens
tgctgggggtggtgctggccaagaagtgccagaccttagtcagcgatgtggactacaagaactacctgcaccagtggacatgcctgcccgaccagagcgaygtcatccatgctcggcaggcctatgacctccagagcgataatatgtacaagtctgatctccagtggatgagaggcattggctgggtgtccattggctctt

SEQ ID NO: 5334 - DNA, 201 bp, Homo sapiens
gtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagca

SEQ ID NO: 5335 - DNA, 201 bp, Homo sapiens
tgtgaaacataaatacaccatgagtcctgatcttcctcagtttctccaggccaagtgcaatgcttacaatataagtgacgtctgttataaacgggattggyatgacttaatagccaagggcaacaatgtgctgggcgatgctattcccatcactgcagccaaggcatcgagaaacattgccagtgattataaatacaagga

SEQ ID NO: 5336 - DNA, 201 bp, Homo sapiens
cgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacac

SEQ ID NO: 5337 - DNA, 201 bp, Homo sapiens
cagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtgg

SEQ ID NO: 5338 - DNA, 201 bp, Homo sapiens
ccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggcca

SEQ ID NO: 5339 - DNA, 201 bp, Homo sapiens
ccactggattctgtggaccatgtaagggttactaagaaccaggaaatgatgagtcagatcaaatataagaaaaatgcccttgaaaactatcctaactttasaagtgtggtggatcctccagagattgttttagccaagattaattctgtcaatcaaagtgatgtaaaatataaagaaacatttaataaagcaaagggcaaa

SEQ ID NO: 5340 - DNA, 201 bp, Homo sapiens
gttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctggatgagcgc

SEQ ID NO: 5341 - DNA, 201 bp, Homo sapiens
tacaccacatatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacct

SEQ ID NO: 5342 - DNA, 201 bp, Homo sapiens
tcaagaagcacttggcacagggctcatacacaacactaccagagacccgggacactgttcacgtcaaggaagtgaccaagcatgtcagtgatacaaattasaaaaagaagtttgtcaaggagaaaggaaaatccaactactccatcatgctggagccaccagaggtgaaacatgctatggaagtggccaagaagcaaagtg

SEQ ID NO: 5343 - DNA, 201 bp, Homo sapiens
gcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgat

SEQ ID NO: 5344 - DNA, 201 bp, Homo sapiens
caagatcaggagactattacaggtttacgtgtctggcgtactaatcctggttcggtttttgactatgatccagcagaagacaacatccagtcccgaagctkacacatgattaatgtccaagctcagcgccggagccgggagcagtcacgatctgccagtgcactaagcgtcagtgggggtgaggagaagtctgagcattca

SEQ ID NO: 5345 - DNA, 201 bp, Homo sapiens
cgaccagagcgacgtcatccatgctcggcaggcctatgacctccagagcgataatatgtacaagtctgatctccagtggatgagaggcattggctgggtgyccattggctctttggatgtggaaaaatgcaaaagggcaactgaaattttgagtgataaaatctatcgccagcctccagacagattcaaatttaccagtgt

SEQ ID NO: 5346 - DNA, 201 bp, Homo sapiens
tatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagaca

SEQ ID NO: 5347 - DNA, 201 bp, Homo sapiens; identical to SEQ ID NO: 5320

SEQ ID NO: 5348 - DNA, 201 bp, Homo sapiens; identical to SEQ ID NO: 5294

SEQ ID NO: 5349 - DNA, 201 bp, Homo sapiens; identical to SEQ ID NO: 5295

SEQ ID NO: 5350 - DNA, 201 bp, Homo sapiens; identical to SEQ ID NO: 5296

SEQ ID NO: 5351 - DNA, 201 bp, Homo sapiens; identical to SEQ ID NO: 5326

SEQ ID NO: 5352 - DNA, 201 bp, Homo sapiens; identical to SEQ ID NO: 5297

SEQ ID NO: 5353 - DNA, 201 bp, Homo sapiens
cccaacacctatcactccagagatggagagagtcaaacgcaatcaagagaactttagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcac

SEQ ID NO: 5354 - DNA, 201 bp, Homo sapiens; identical to SEQ ID NO: 5330

SEQ ID NO: 5355 - DNA, 201 bp, Homo sapiens; identical to SEQ ID NO: 5331

SEQ ID NO: 5356 - DNA, 201 bp, Homo sapiens; identical to SEQ ID NO: 5304

SEQ ID NO: 5357 - DNA, 201 bp, Homo sapiens; identical to SEQ ID NO: 5310

SEQ ID NO: 5358 - DNA, 201 bp, Homo sapiens; identical to SEQ ID NO: 5342

SEQ ID NO: 5359 - DNA, 201 bp, Homo sapiens; identical to SEQ ID NO: 5344

SEQ ID NO: 5360 - DNA, 201 bp, Homo sapiens; identical to SEQ ID NO: 5317

SEQ ID NO: 5361 - DNA, 201 bp, Homo sapiens; identical to SEQ ID NO: 5319

SEQ ID NO: 5362 - DNA, 201 bp, Homo sapiens; identical to SEQ ID NO: 5318

SEQ ID NO: 5363 - DNA, 201 bp, Homo sapiens; identical to SEQ ID NO: 5290

SEQ ID NO: 5364 - DNA, 201 bp, Homo sapiens; identical to SEQ ID NO: 5291

SEQ ID NO: 5365 - DNA, 201 bp, Homo sapiens; identical to SEQ ID NO: 5292

SEQ ID NO: 5366 - DNA, 201 bp, Homo sapiens; identical to SEQ ID NO: 5293

SEQ ID NO: 5367 - DNA, 201 bp, Homo sapiens; identical to SEQ ID NO: 5294

SEQ ID NO: 5368 - DNA, 201 bp, Homo sapiens; identical to SEQ ID NO: 5295

SEQ ID NO: 5369 - DNA, 201 bp, Homo sapiens; identical to SEQ ID NO: 5296

SEQ ID NO: 5370 - DNA, 201 bp, Homo sapiens; identical to SEQ ID NO: 5297

SEQ ID NO: 5371 - DNA, 201 bp, Homo sapiens; identical to SEQ ID NO: 5298

SEQ ID NO: 5372 - DNA, 201 bp, Homo sapiens; identical to SEQ ID NO: 5299

SEQ ID NO: 5373 - DNA, 201 bp, Homo sapiens; identical to SEQ ID NO: 5300

SEQ ID NO: 5374 - DNA, 201 bp, Homo sapiens; identical to SEQ ID NO: 5301

SEQ ID NO: 5375 - DNA, 201 bp, Homo sapiens; identical to SEQ ID NO: 5302

SEQ ID NO: 5376 - DNA, 201 bp, Homo sapiens; identical to SEQ ID NO: 5303

SEQ ID NO: 5377 - DNA, 201 bp, Homo sapiens; identical to SEQ ID NO: 5304

SEQ ID NO: 5378 - DNA, 201 bp, Homo sapiens; identical to SEQ ID NO: 5305

SEQ ID NO: 5379 - DNA, 201 bp, Homo sapiens; identical to SEQ ID NO: 5306

SEQ ID NO: 5380 - DNA, 201 bp, Homo sapiens; identical to SEQ ID NO: 5307

SEQ ID NO: 5381 - DNA, 201 bp, Homo sapiens; identical to SEQ ID NO: 5308

SEQ ID NO: 5382 - DNA, 201 bp, Homo sapiens; identical to SEQ ID NO: 5309

SEQ ID NO: 5383 - DNA, 201 bp, Homo sapiens; identical to SEQ ID NO: 5310

SEQ ID NO: 5384 - DNA, 201 bp, Homo sapiens; identical to SEQ ID NO: 5311

SEQ ID NO: 5385 - DNA, 201 bp, Homo sapiens; identical to SEQ ID NO: 5312

SEQ ID NO: 5386 - DNA, 201 bp, Homo sapiens
gtgagcaagcaaaaatacaaagaagactatgaaaataaaatcaaaggcaaatggagtgagacaccttgctttgaagttgcaaatgccagaatgaatgctgrtaacattagcacaaggaaataccaggaagattttgaaaacatgaaagaccagatctacttcatgcagaccgaaacaccagagtataaaatgaataaaaaa

SEQ ID NO: 5387 - DNA, 201 bp, Homo sapiens; identical to SEQ ID NO: 5314

SEQ ID NO: 5388 - DNA, 201 bp, Homo sapiens; identical to SEQ ID NO: 5315

SEQ ID NO: 5389 - DNA, 201 bp, Homo sapiens; identical to SEQ ID NO: 5316

SEQ ID NO: 5390 - DNA, 201 bp, Homo sapiens; identical to SEQ ID NO: 5317

SEQ ID NO: 5391 - DNA, 201 bp, Homo sapiens; identical to SEQ ID NO: 5318

SEQ ID NO: 5392 - DNA, 201 bp, Homo sapiens; identical to SEQ ID NO: 5319

SEQ ID NO: 5393 - DNA, 201 bp, Homo sapiens; identical to SEQ ID NO: 5320

SEQ ID NO: 5394 - DNA, 201 bp, Homo sapiens; identical to SEQ ID NO: 5321

SEQ ID NO: 5395 - DNA, 201 bp, Homo sapiens; identical to SEQ ID NO: 5322

SEQ ID NO: 5396 - DNA, 201 bp, Homo sapiens; identical to SEQ ID NO: 5323

SEQ ID NO: 5397 - DNA, 201 bp, Homo sapiens; identical to SEQ ID NO: 5324

SEQ ID NO: 5398 - DNA, 201 bp, Homo sapiens; identical to SEQ ID NO: 5325

SEQ ID NO: 5399 - DNA, 201 bp, Homo sapiens; identical to SEQ ID NO: 5326

SEQ ID NO: 5400 - DNA, 201 bp, Homo sapiens; identical to SEQ ID NO: 5327

SEQ ID NO: 5401 - DNA, 201 bp, Homo sapiens; identical to SEQ ID NO: 5328

SEQ ID NO: 5402 - DNA, 201 bp, Homo sapiens; identical to SEQ ID NO: 5329

SEQ ID NO: 5403 - DNA, 201 bp, Homo sapiens; identical to SEQ ID NO: 5330

SEQ ID NO: 5404 - DNA, 201 bp, Homo sapiens; identical to SEQ ID NO: 5331

SEQ ID NO: 5405 - DNA, 201 bp, Homo sapiens; identical to SEQ ID NO: 5332

SEQ ID NO: 5406 - DNA, 201 bp, Homo sapiens; identical to SEQ ID NO: 5333

SEQ ID NO: 5407 - DNA, 201 bp, Homo sapiens; identical to SEQ ID NO: 5334

SEQ ID NO: 5408 - DNA, 201 bp, Homo sapiens; identical to SEQ ID NO: 5335

SEQ ID NO: 5409 - DNA, 201 bp, Homo sapiens; identical to SEQ ID NO: 5336

SEQ ID NO: 5410 - DNA, 201 bp, Homo sapiens; identical to SEQ ID NO: 5337

SEQ ID NO: 5411 - DNA, 201 bp, Homo sapiens; identical to SEQ ID NO: 5338

SEQ ID NO: 5412 - DNA, 201 bp, Homo sapiens; identical to SEQ ID NO: 5339

SEQ ID NO: 5413 - DNA, 201 bp, Homo sapiens; identical to SEQ ID NO: 5340

SEQ ID NO: 5414 - DNA, 201 bp, Homo sapiens; identical to SEQ ID NO: 5341

SEQ ID NO: 5415 - DNA, 201 bp, Homo sapiens; identical to SEQ ID NO: 5342

SEQ ID NO: 5416 - DNA, 201 bp, Homo sapiens; identical to SEQ ID NO: 5343

SEQ ID NO: 5417 - DNA, 201 bp, Homo sapiens; identical to SEQ ID NO: 5344

SEQ ID NO: 5418 - DNA, 201 bp, Homo sapiens; identical to SEQ ID NO: 5345

SEQ ID NO: 5419 - DNA, 201 bp, Homo sapiens; identical to SEQ ID NO: 5346

SEQ ID NO: 5420 - DNA, 201 bp, Homo sapiens; identical to SEQ ID NO: 5290

SEQ ID NO: 5421 - DNA, 201 bp, Homo sapiens; identical to SEQ ID NO: 5291

SEQ ID NO: 5422 - DNA, 201 bp, Homo sapiens; identical to SEQ ID NO: 5292

SEQ ID NO: 5423 - DNA, 201 bp, Homo sapiens; identical to SEQ ID NO: 5293

SEQ ID NO: 5424 - DNA, 201 bp, Homo sapiens; identical to SEQ ID NO: 5294

SEQ ID NO: 5425 - DNA, 201 bp, Homo sapiens; identical to SEQ ID NO: 5295

SEQ ID NO: 5426 - DNA, 201 bp, Homo sapiens; identical to SEQ ID NO: 5296

SEQ ID NO: 5427 - DNA, 201 bp, Homo sapiens
cagcttacaaacatgcaaaaaccacagagctcccacaacaacgatcatcttcagttgctacccaacagacaacggtatcttccatcccatctcatccatckactgctggaagacagggtctcactctatcacccaggctgcagtgtggtggcatgatcacagctcgctgcagtctcgacttcatggactcaagcaatcctc

SEQ ID NO: 5428 - DNA, 201 bp, Homo sapiens; identical to SEQ ID NO: 5299

SEQ ID NO: 5429 - DNA, 201 bp, Homo sapiens; identical to SEQ ID NO: 5301

SEQ ID NO: 5430 - DNA, 201 bp, Homo sapiens; identical to SEQ ID NO: 5302

SEQ ID NO: 5431 - DNA, 201 bp, Homo sapiens; identical to SEQ ID NO: 5303

SEQ ID NO: 5432 - DNA, 201 bp, Homo sapiens; identical to SEQ ID NO: 5304

SEQ ID NO: 5433 - DNA, 201 bp, Homo sapiens; identical to SEQ ID NO: 5305

SEQ ID NO: 5434 - DNA, 201 bp, Homo sapiens; identical to SEQ ID NO: 5306

SEQ ID NO: 5435 - DNA, 201 bp, Homo sapiens; identical to SEQ ID NO: 5307

SEQ ID NO: 5436 - DNA, 201 bp, Homo sapiens; identical to SEQ ID NO: 5308

SEQ ID NO: 5437 - DNA, 201 bp, Homo sapiens; identical to SEQ ID NO: 5310

SEQ ID NO: 5438 - DNA, 201 bp, Homo sapiens; identical to SEQ ID NO: 5309

SEQ ID NO: 5439 - DNA, 201 bp, Homo sapiens; identical to SEQ ID NO: 5311

SEQ ID NO: 5440 - DNA, 177 bp, Homo sapiens
gactatgaaaataaaatcaaaggcaaatggagtgagacaccttgctttgaagttgcaaatgccagaatgaatgctgrtaacattagcacagttaagaaataccaggaagattttgaaaacatgaaagaccagatctacttcatgcagaccgaaacaccagagtataaaatgaataaa

SEQ ID NO: 5441 - DNA, 201 bp, Homo sapiens; identical to SEQ ID NO: 5314

SEQ ID NO: 5442 - DNA, 201 bp, Homo sapiens; identical to SEQ ID NO: 5315

SEQ ID NO: 5443 - DNA, 201 bp, Homo sapiens; identical to SEQ ID NO: 5316

SEQ ID NO: 5444 - DNA, 201 bp, Homo sapiens; identical to SEQ ID NO: 5317

SEQ ID NO: 5445 - DNA, 201 bp, Homo sapiens; identical to SEQ ID NO: 5318

SEQ ID NO: 5446 - DNA, 201 bp, Homo sapiens; identical to SEQ ID NO: 5319

SEQ ID NO: 5447 - DNA, 201 bp, Homo sapiens; identical to SEQ ID NO: 5320

SEQ ID NO: 5448 - DNA, 201 bp, Homo sapiens; identical to SEQ ID NO: 5322

SEQ ID NO: 5449 - DNA, 201 bp, Homo sapiens; identical to SEQ ID NO: 5321

SEQ ID NO: 5450 - DNA, 201 bp, Homo sapiens; identical to SEQ ID NO: 5323

SEQ ID NO: 5451 - DNA, 201 bp, Homo sapiens; identical to SEQ ID NO: 5324

SEQ ID NO: 5452 - DNA, 201 bp, Homo sapiens; identical to SEQ ID NO: 5325

SEQ ID NO: 5453 - DNA, 201 bp, Homo sapiens; identical to SEQ ID NO: 5326

SEQ ID NO: 5454 - DNA, 201 bp, Homo sapiens; identical to SEQ ID NO: 5327

SEQ ID NO: 5455 - DNA, 201 bp, Homo sapiens
ccctctacctgtcactcctgagatggagagagtcaaacacaatcaagaaaatattagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcac

SEQ ID NO: 5456 - DNA, 201 bp, Homo sapiens; identical to SEQ ID NO: 5328

SEQ ID NO: 5457 - DNA, 201 bp, Homo sapiens; identical to SEQ ID NO: 5329

SEQ ID NO: 5458 - DNA, 201 bp, Homo sapiens; identical to SEQ ID NO: 5330

SEQ ID NO: 5459 - DNA, 201 bp, Homo sapiens; identical to SEQ ID NO: 5331

SEQ ID NO: 5460 - DNA, 201 bp, Homo sapiens; identical to SEQ ID NO: 5333

SEQ ID NO: 5461 - DNA, 201 bp, Homo sapiens; identical to SEQ ID NO: 5332

SEQ ID NO: 5462 - DNA, 201 bp, Homo sapiens; identical to SEQ ID NO: 5334

SEQ ID NO: 5463 - DNA, 201 bp, Homo sapiens; identical to SEQ ID NO: 5335

SEQ ID NO: 5464 - DNA, 201 bp, Homo sapiens; identical to SEQ ID NO: 5336

SEQ ID NO: 5465 - DNA, 201 bp, Homo sapiens; identical to SEQ ID NO: 5337

SEQ ID NO: 5466 - DNA, 201 bp, Homo sapiens; identical to SEQ ID NO: 5338

SEQ ID NO: 5467 - DNA, 201 bp, Homo sapiens; identical to SEQ ID NO: 5339

SEQ ID NO: 5468 - DNA, 201 bp, Homo sapiens; identical to SEQ ID NO: 5340

SEQ ID NO: 5469 - DNA, 201 bp, Homo sapiens; identical to SEQ ID NO: 5341

SEQ ID NO: 5470 - DNA, 201 bp, Homo sapiens; identical to SEQ ID NO: 5342

SEQ ID NO: 5471 - DNA, 201 bp, Homo sapiens; identical to SEQ ID NO: 5343

SEQ ID NO: 5472 - DNA, 201 bp, Homo sapiens; identical to SEQ ID NO: 5344

SEQ ID NO: 5473 - DNA, 201 bp, Homo sapiens; identical to SEQ ID NO: 5345

SEQ ID NO: 5474 - DNA, 201 bp, Homo sapiens; identical to SEQ ID NO: 5346

SEQ ID NO: 5475 - DNA, 201 bp, Homo sapiens; identical to SEQ ID NO: 5290

SEQ ID NO: 5476 - DNA, 201 bp, Homo sapiens; identical to SEQ ID NO: 5291

SEQ ID NO: 5477 - DNA, 201 bp, Homo sapiens; identical to SEQ ID NO: 5292

SEQ ID NO: 5478 - DNA, 201 bp, Homo sapiens; identical to SEQ ID NO: 5293

SEQ ID NO: 5479 - DNA, 201 bp, Homo sapiens; identical to SEQ ID NO: 5294

SEQ ID NO: 5480 - DNA, 201 bp, Homo sapiens; identical to SEQ ID NO: 5295

SEQ ID NO: 5481 - DNA, 201 bp, Homo sapiens; identical to SEQ ID NO: 5296

SEQ ID NO: 5482 - DNA, 201 bp, Homo sapiens; identical to SEQ ID NO: 5427

SEQ ID NO: 5483 - DNA, 201 bp, Homo sapiens; identical to SEQ ID NO: 5298

SEQ ID NO: 5484 - DNA, 201 bp, Homo sapiens; identical to SEQ ID NO: 5299

SEQ ID NO: 5485 - DNA, 201 bp, Homo sapiens; identical to SEQ ID NO: 5300

SEQ ID NO: 5486 - DNA, 201 bp, Homo sapiens; identical to SEQ ID NO: 5301

SEQ ID NO: 5487 - DNA, 201 bp, Homo sapiens; identical to SEQ ID NO: 5302

SEQ ID NO: 5488 - DNA, 201 bp, Homo sapiens; identical to SEQ ID NO: 5303

SEQ ID NO: 5489 - DNA, 201 bp, Homo sapiens; identical to SEQ ID NO: 5304

SEQ ID NO: 5490 - DNA, 201 bp, Homo sapiens; identical to SEQ ID NO: 5305

SEQ ID NO: 5491 - DNA, 201 bp, Homo sapiens; identical to SEQ ID NO: 5306

SEQ ID NO: 5492 - DNA, 201 bp, Homo sapiens; identical to SEQ ID NO: 5307

SEQ ID NO: 5493 - DNA, 201 bp, Homo sapiens; identical to SEQ ID NO: 5308

SEQ ID NO: 5494 - DNA, 201 bp, Homo sapiens; identical to SEQ ID NO: 5310

SEQ ID NO: 5495 - DNA, 201 bp, Homo sapiens; identical to SEQ ID NO: 5309

SEQ ID NO: 5496 - DNA, 201 bp, Homo sapiens; identical to SEQ ID NO: 5311

SEQ ID NO: 5497 - DNA, 201 bp, Homo sapiens; identical to SEQ ID NO: 5312

SEQ ID NO: 5498 - DNA, 201 bp, Homo sapiens; identical to SEQ ID NO: 5386

SEQ ID NO: 5499 - DNA, 201 bp, Homo sapiens; identical to SEQ ID NO: 5314

SEQ ID NO: 5500 - DNA, 201 bp, Homo sapiens; identical to SEQ ID NO: 5315

SEQ ID NO: 5501 - DNA, 201 bp, Homo sapiens; identical to SEQ ID NO: 5316

SEQ ID NO: 5502 - DNA, 201 bp, Homo sapiens; identical to SEQ ID NO: 5317

SEQ ID NO: 5503 - DNA, 201 bp, Homo sapiens; identical to SEQ ID NO: 5318

SEQ ID NO: 5504 - DNA, 201 bp, Homo sapiens; identical to SEQ ID NO: 5319

SEQ ID NO: 5505 - DNA, 201 bp, Homo sapiens; identical to SEQ ID NO: 5320

SEQ ID NO: 5506 - DNA, 201 bp, Homo sapiens; identical to SEQ ID NO: 5321

SEQ ID NO: 5507 - DNA, 201 bp, Homo sapiens; identical to SEQ ID NO: 5322

SEQ ID NO: 5508 - DNA, 201 bp, Homo sapiens; identical to SEQ ID NO: 5323

SEQ ID NO: 5509 - DNA, 201 bp, Homo sapiens; identical to SEQ ID NO: 5324

SEQ ID NO: 5510 - DNA, 201 bp, Homo sapiens; identical to SEQ ID NO: 5325

SEQ ID NO: 5511 - DNA, 201 bp, Homo sapiens; identical to SEQ ID NO: 5326

SEQ ID NO: 5512 - DNA, 201 bp, Homo sapiens; identical to SEQ ID NO: 5327

SEQ ID NO: 5513 - DNA, 201 bp, Homo sapiens; identical to SEQ ID NO: 5455

SEQ ID NO: 5514 - DNA, 201 bp, Homo sapiens; identical to SEQ ID NO: 5328

SEQ ID NO: 5515 - DNA, 201 bp, Homo sapiens; identical to SEQ ID NO: 5329

SEQ ID NO: 5516 - DNA, 201 bp, Homo sapiens
gtggttgatactccagagatcattcatgcccaacaagtcaagaatctttcaagccagctccaataccagtgtgaccttaaaaacagtaaaggaaaaattayagttgttcaagacacgccagaaatactgcgtgtaaaagaaaatcagaagaatttcagctcggttttatataaagaggatgtctcaccaggaacggctatc

SEQ ID NO: 5517 - DNA, 201 bp, Homo sapiens
agatcattcatgcccaacaagtcaagaatctttcaagccagctccaataccagtgtgaccttaaaaacagtaaaggaaaaattacagttgttcaagacacrccagaaatactgcgtgtaaaagaaaatcagaagaatttcagctcggttttatataaagaggatgtctcaccaggaacggctatcggaaagacacctgaga

SEQ ID NO: 5518 - DNA, 201 bp, Homo sapiens; identical to SEQ ID NO: 5332

SEQ ID NO: 5519 - DNA, 201 bp, Homo sapiens; identical to SEQ ID NO: 5333

SEQ ID NO: 5520 - DNA, 201 bp, Homo sapiens; identical to SEQ ID NO: 5334

SEQ ID NO: 5521 - DNA, 201 bp, Homo sapiens; identical to SEQ ID NO: 5335

SEQ ID NO: 5522 - DNA, 201 bp, Homo sapiens; identical to SEQ ID NO: 5336

SEQ ID NO: 5523 - DNA, 201 bp, Homo sapiens; identical to SEQ ID NO: 5337

SEQ ID NO: 5524 - DNA, 201 bp, Homo sapiens; identical to SEQ ID NO: 5338

SEQ ID NO: 5525 - DNA, 201 bp, Homo sapiens; identical to SEQ ID NO: 5339

SEQ ID NO: 5526 - DNA, 201 bp, Homo sapiens; identical to SEQ ID NO: 5340

SEQ ID NO: 5527 - DNA, 201 bp, Homo sapiens; identical to SEQ ID NO: 5341

SEQ ID NO: 5528 - DNA, 201 bp, Homo sapiens; identical to SEQ ID NO: 5342

SEQ ID NO: 5529 - DNA, 201 bp, Homo sapiens; identical to SEQ ID NO: 5343

SEQ ID NO: 5530 - DNA, 201 bp, Homo sapiens; identical to SEQ ID NO: 5344

SEQ ID NO: 5531 - DNA, 201 bp, Homo sapiens; identical to SEQ ID NO: 5345

SEQ ID NO: 5532 - DNA, 201 bp, Homo sapiens; identical to SEQ ID NO: 5346

SEQ ID NO: 5533 - DNA, 201 bp, Homo sapiens; identical to SEQ ID NO: 5293

SEQ ID NO: 5534 - DNA, 201 bp, Homo sapiens; identical to SEQ ID NO: 5294

SEQ ID NO: 5535 - DNA, 201 bp, Homo sapiens; identical to SEQ ID NO: 5295

SEQ ID NO: 5536 - DNA, 201 bp, Homo sapiens; identical to SEQ ID NO: 5296

SEQ ID NO: 5537 - DNA, 201 bp, Homo sapiens; identical to SEQ ID NO: 5297

SEQ ID NO: 5538 - DNA, 201 bp, Homo sapiens
tgggatccagcatgccaaggcttccagggatattgccagtgactatctgtacaaaactgcttatgagaaacagaaaggccattacattggctgtcgcagcrccaaggaagaccctaaactggtttgggcagcaaatgtgttgaagatgcagaatgacaggctgtacaaaaaggcctacaacgaccacaaagccaagatctc

SEQ ID NO: 5539 - DNA, 201 bp, Homo sapiens
gtcgcagcgccaaggaagaccctaaactggtttgggcagcaaatgtgttgaagatgcagaatgacaggctgtacaaaaaggcctacaacgaccacaaagcsaagatctccatccctgtggacatggtgtccatcagcgctgccaaagaaggtcaggcactggcaagtgatgtggactatcgccattacctgcaccactggt

SEQ ID NO: 5540 - DNA, 201 bp, Homo sapiens
aaagccaagatctccatccctgtggacatggtgtccatcagcgctgccaaagaaggtcaggcactggcaagtgatgtggactatcgccattacctgcaccrctggtcttgctttcccgaccagaatgatgtgatccaagccaggaaagcctacgacctacagagcgacgccctctacaaggctgacttggagtggttgcgt

SEQ ID NO: 5541 - DNA, 201 bp, Homo sapiens; identical to SEQ ID NO: 5304

SEQ ID NO: 5542 - DNA, 201 bp, Homo sapiens; identical to SEQ ID NO: 5305

SEQ ID NO: 5543 - DNA, 201 bp, Homo sapiens; identical to SEQ ID NO: 5310

SEQ ID NO: 5544 - DNA, 201 bp, Homo sapiens; identical to SEQ ID NO: 5311

SEQ ID NO: 5545 - DNA, 201 bp, Homo sapiens
caagtgatgtggactatcgccattacctgcaccactggtcttgctttcccgaccagaatgatgtgatccaagccaggaaagcctacgacctacagagcgaygccctctacaaggctgacttggagtggttgcgtggcattggctggatgccccaagggtctcctgaagtgttgagagtcaaaaacgcccagaatatctttt

SEQ ID NO: 5546 - DNA, 201 bp, Homo sapiens; identical to SEQ ID NO: 5317

SEQ ID NO: 5547 - DNA, 201 bp, Homo sapiens; identical to SEQ ID NO: 5318

SEQ ID NO: 5548 - DNA, 201 bp, Homo sapiens; identical to SEQ ID NO: 5319

SEQ ID NO: 5549 - DNA, 201 bp, Homo sapiens; identical to SEQ ID NO: 5320

SEQ ID NO: 5550 - DNA, 201 bp, Homo sapiens; identical to SEQ ID NO: 5321

SEQ ID NO: 5551 - DNA, 201 bp, Homo sapiens; identical to SEQ ID NO: 5323

SEQ ID NO: 5552 - DNA, 201 bp, Homo sapiens; identical to SEQ ID NO: 5326

SEQ ID NO: 5553 - DNA, 201 bp, Homo sapiens; identical to SEQ ID NO: 5330

SEQ ID NO: 5554 - DNA, 201 bp, Homo sapiens; identical to SEQ ID NO: 5331

SEQ ID NO: 5555 - DNA, 201 bp, Homo sapiens
ttgggatccagcatgccaaggcttccagggatattgccagtgactatctgtacaaaactgcttatgagaaacagaaaggccattacattggctgtcgcagygccaaggaagaccctaaactggtttgggcagcaaatgtgttgaagatgcagaatgacaggctgtacaaaaaggcctacaacgaccacaaagccaagatct

SEQ ID NO: 5556 - DNA, 201 bp, Homo sapiens; identical to SEQ ID NO: 5332

SEQ ID NO: 5557 - DNA, 201 bp, Homo sapiens; identical to SEQ ID NO: 5334

SEQ ID NO: 5558 - DNA, 201 bp, Homo sapiens
tgatgtgatccaagccaggaaagcctacgacctacagagcgacgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacac

SEQ ID NO: 5559 - DNA, 201 bp, Homo sapiens; identical to SEQ ID NO: 5338

SEQ ID NO: 5560 - DNA, 201 bp, Homo sapiens; identical to SEQ ID NO: 5339

SEQ ID NO: 5561 - DNA, 201 bp, Homo sapiens; identical to SEQ ID NO: 5340

SEQ ID NO: 5562 - DNA, 201 bp, Homo sapiens; identical to SEQ ID NO: 5341

SEQ ID NO: 5563 - DNA, 201 bp, Homo sapiens; identical to SEQ ID NO: 5342

SEQ ID NO: 5564 - DNA, 201 bp, Homo sapiens; identical to SEQ ID NO: 5344

SEQ ID NO: 5565 - DNA, 201 bp, Homo sapiens; identical to SEQ ID NO: 5343

SEQ ID NO: 5566 - DNA, 201 bp, Homo sapiens; identical to SEQ ID NO: 5290

SEQ ID NO: 5567 - DNA, 201 bp, Homo sapiens; identical to SEQ ID NO: 5291

SEQ ID NO: 5568 - DNA, 201 bp, Homo sapiens; identical to SEQ ID NO: 5292

SEQ ID NO: 5569 - DNA, 201 bp, Homo sapiens; identical to SEQ ID NO: 5293

SEQ ID NO: 5570 - DNA, 201 bp, Homo sapiens; identical to SEQ ID NO: 5294

SEQ ID NO: 5571 - DNA, 201 bp, Homo sapiens; identical to SEQ ID NO: 5295

SEQ ID NO: 5572 - DNA, 201 bp, Homo sapiens; identical to SEQ ID NO: 5296

SEQ ID NO: 5573 - DNA, 201 bp, Homo sapiens; identical to SEQ ID NO: 5297

SEQ ID NO: 5574 - DNA, 201 bp, Homo sapiens; identical to SEQ ID NO: 5298

SEQ ID NO: 5575 - DNA, 201 bp, Homo sapiens; identical to SEQ ID NO: 5299

SEQ ID NO: 5576 - DNA, 201 bp, Homo sapiens; identical to SEQ ID NO: 5300

SEQ ID NO: 5577 - DNA, 201 bp, Homo sapiens; identical to SEQ ID NO: 5301

SEQ ID NO: 5578 - DNA, 201 bp, Homo sapiens; identical to SEQ ID NO: 5302

SEQ ID NO: 5579 - DNA, 201 bp, Homo sapiens; identical to SEQ ID NO: 5303

SEQ ID NO: 5580 - DNA, 201 bp, Homo sapiens; identical to SEQ ID NO: 5304

SEQ ID NO: 5581 - DNA, 201 bp, Homo sapiens; identical to SEQ ID NO: 5305

SEQ ID NO: 5582 - DNA, 201 bp, Homo sapiens; identical to SEQ ID NO: 5306

SEQ ID NO: 5583 - DNA, 201 bp, Homo sapiens; identical to SEQ ID NO: 5307

SEQ ID NO: 5584 - DNA, 201 bp, Homo sapiens; identical to SEQ ID NO: 5308

SEQ ID NO: 5585 - DNA, 201 bp, Homo sapiens; identical to SEQ ID NO: 5309

SEQ ID NO: 5586 - DNA, 201 bp, Homo sapiens; identical to SEQ ID NO: 5310

SEQ ID NO: 5587 - DNA, 201 bp, Homo sapiens; identical to SEQ ID NO: 5311

SEQ ID NO: 5588 - DNA, 201 bp, Homo sapiens; identical to SEQ ID NO: 5312

SEQ ID NO: 5589 - DNA, 201 bp, Homo sapiens; identical to SEQ ID NO: 5386

SEQ ID NO: 5590 - DNA, 201 bp, Homo sapiens; identical to SEQ ID NO: 5314

SEQ ID NO: 5591 - DNA, 201 bp, Homo sapiens; identical to SEQ ID NO: 5315

SEQ ID NO: 5592 - DNA, 201 bp, Homo sapiens; identical to SEQ ID NO: 5316

SEQ ID NO: 5593 - DNA, 201 bp, Homo sapiens; identical to SEQ ID NO: 5317

SEQ ID NO: 5594 - DNA, 201 bp, Homo sapiens; identical to SEQ ID NO: 5318

SEQ ID NO: 5595 - DNA, 201 bp, Homo sapiens; identical to SEQ ID NO: 5319

SEQ ID NO: 5596 - DNA, 201 bp, Homo sapiens; identical to SEQ ID NO: 5320

SEQ ID NO: 5597 - DNA, 201 bp, Homo sapiens; identical to SEQ ID NO: 5321

SEQ ID NO: 5598 - DNA, 201 bp, Homo sapiens; identical to SEQ ID NO: 5322

SEQ ID NO: 5599 - DNA, 201 bp, Homo sapiens; identical to SEQ ID NO: 5323

SEQ ID NO: 5600 - DNA, 201 bp, Homo sapiens; identical to SEQ ID NO: 5324

SEQ ID NO: 5601 - DNA, 201 bp, Homo sapiens; identical to SEQ ID NO: 5325

SEQ ID NO: 5602 - DNA, 201 bp, Homo sapiens; identical to SEQ ID NO: 5326

SEQ ID NO: 5603 - DNA, 201 bp, Homo sapiens; identical to SEQ ID NO: 5327

SEQ ID NO: 5604 - DNA, 201 bp, Homo sapiens; identical to SEQ ID NO: 5353

SEQ ID NO: 5605 - DNA, 201 bp, Homo sapiens; identical to SEQ ID NO: 5328

SEQ ID NO: 5606 - DNA, 201 bp, Homo sapiens; identical to SEQ ID NO: 5329

SEQ ID NO: 5607 - DNA, 201 bp, Homo sapiens; identical to SEQ ID NO: 5330

SEQ ID NO: 5608 - DNA, 201 bp, Homo sapiens; identical to SEQ ID NO: 5331

SEQ ID NO: 5609 - DNA, 201 bp, Homo sapiens; identical to SEQ ID NO: 5332

SEQ ID NO: 5610 - DNA, 201 bp, Homo sapiens; identical to SEQ ID NO: 5333

SEQ ID NO: 5611 - DNA, 201 bp, Homo sapiens; identical to SEQ ID NO: 5334

SEQ ID NO: 5612 - DNA, 201 bp, Homo sapiens; identical to SEQ ID NO: 5335

SEQ ID NO: 5613 - DNA, 201 bp, Homo sapiens; identical to SEQ ID NO: 5336

SEQ ID NO: 5614 - DNA, 201 bp, Homo sapiens; identical to SEQ ID NO: 5337

SEQ ID NO: 5615 - DNA, 201 bp, Homo sapiens; identical to SEQ ID NO: 5338

SEQ ID NO: 5616 - DNA, 201 bp, Homo sapiens; identical to SEQ ID NO: 5339

SEQ ID NO: 5617 - DNA, 201 bp, Homo sapiens; identical to SEQ ID NO: 5340

SEQ ID NO: 5618 - DNA, 201 bp, Homo sapiens; identical to SEQ ID NO: 5341

SEQ ID NO: 5619 - DNA, 201 bp, Homo sapiens; identical to SEQ ID NO: 5342

SEQ ID NO: 5620 - DNA, 201 bp, Homo sapiens; identical to SEQ ID NO: 5343

SEQ ID NO: 5621 - DNA, 201 bp, Homo sapiens; identical to SEQ ID NO: 5344

SEQ ID NO: 5622 - DNA, 201 bp, Homo sapiens; identical to SEQ ID NO: 5345

SEQ ID NO: 5623 - DNA, 201 bp, Homo sapiens; identical to SEQ ID NO: 5346

SEQ ID NO: 5624 - DNA, 201 bp, Homo sapiens; identical to SEQ ID NO: 5290

SEQ ID NO: 5625 - DNA, 201 bp, Homo sapiens; identical to SEQ ID NO: 5291

SEQ ID NO: 5626 - DNA, 201 bp, Homo sapiens; identical to SEQ ID NO: 5292

SEQ ID NO: 5627 - DNA, 201 bp, Homo sapiens; identical to SEQ ID NO: 5293

SEQ ID NO: 5628 - DNA, 201 bp, Homo sapiens; identical to SEQ ID NO: 5294

SEQ ID NO: 5629 - DNA, 201 bp, Homo sapiens; identical to SEQ ID NO: 5295

SEQ ID NO: 5630 - DNA, 201 bp, Homo sapiens; identical to SEQ ID NO: 5296

SEQ ID NO: 5631 - DNA, 201 bp, Homo sapiens; identical to SEQ ID NO: 5297

SEQ ID NO: 5632 - DNA, 201 bp, Homo sapiens; identical to SEQ ID NO: 5298

SEQ ID NO: 5633 - DNA, 201 bp, Homo sapiens; identical to SEQ ID NO: 5299

SEQ ID NO: 5634 - DNA, 201 bp, Homo sapiens; identical to SEQ ID NO: 5300

SEQ ID NO: 5635 - DNA, 201 bp, Homo sapiens; identical to SEQ ID NO: 5301

SEQ ID NO: 5636 - DNA, 201 bp, Homo sapiens; identical to SEQ ID NO: 5302

SEQ ID NO: 5637 - DNA, 201 bp, Homo sapiens; identical to SEQ ID NO: 5303

SEQ ID NO: 5638 - DNA, 201 bp, Homo sapiens; identical to SEQ ID NO: 5304

SEQ ID NO: 5639 - DNA, 201 bp, Homo sapiens; identical to SEQ ID NO: 5305

SEQ ID NO: 5640 - DNA, 201 bp, Homo sapiens; identical to SEQ ID NO: 5306

SEQ ID NO: 5641 - DNA, 201 bp, Homo sapiens; identical to SEQ ID NO: 5307

SEQ ID NO: 5642 - DNA, 201 bp, Homo sapiens; identical to SEQ ID NO: 5308

SEQ ID NO: 5643 - DNA, 201 bp, Homo sapiens; identical to SEQ ID NO: 5309

SEQ ID NO: 5644 - DNA, 201 bp, Homo sapiens; identical to SEQ ID NO: 5310

SEQ ID NO: 5645 - DNA, 201 bp, Homo sapiens; identical to SEQ ID NO: 5311

SEQ ID NO: 5646 - DNA, 201 bp, Homo sapiens; identical to SEQ ID NO: 5312

SEQ ID NO: 5647 - DNA, 201 bp, Homo sapiens; identical to SEQ ID NO: 5386

SEQ ID NO: 5648 - DNA, 201 bp, Homo sapiens; identical to SEQ ID NO: 5314

SEQ ID NO: 5649 - DNA, 201 bp, Homo sapiens; identical to SEQ ID NO: 5315

SEQ ID NO: 5650 - DNA, 201 bp, Homo sapiens; identical to SEQ ID NO: 5316

SEQ ID NO: 5651 - DNA, 201 bp, Homo sapiens; identical to SEQ ID NO: 5317

SEQ ID NO: 5652 - DNA, 201 bp, Homo sapiens; identical to SEQ ID NO: 5318

SEQ ID NO: 5653 - DNA, 201 bp, Homo sapiens; identical to SEQ ID NO: 5319

SEQ ID NO: 5654 - DNA, 201 bp, Homo sapiens; identical to SEQ ID NO: 5320

SEQ ID NO: 5655 - DNA, 201 bp, Homo sapiens; identical to SEQ ID NO: 5321

SEQ ID NO: 5656 - DNA, 201 bp, Homo sapiens; identical to SEQ ID NO: 5322

SEQ ID NO: 5657 - DNA, 201 bp, Homo sapiens; identical to SEQ ID NO: 5323

SEQ ID NO: 5658 - DNA, 201 bp, Homo sapiens; identical to SEQ ID NO: 5324

SEQ ID NO: 5659 - DNA, 201 bp, Homo sapiens; identical to SEQ ID NO: 5325

SEQ ID NO: 5660 - DNA, 201 bp, Homo sapiens; identical to SEQ ID NO: 5326

SEQ ID NO: 5661 - DNA, 201 bp, Homo sapiens; identical to SEQ ID NO: 5327

SEQ ID NO: 5662 - DNA, 201 bp, Homo sapiens; identical to SEQ ID NO: 5455

SEQ ID NO: 5663 - DNA, 201 bp, Homo sapiens; identical to SEQ ID NO: 5328

SEQ ID NO: 5664 - DNA, 201 bp, Homo sapiens; identical to SEQ ID NO: 5329

SEQ ID NO: 5665 - DNA, 201 bp, Homo sapiens; identical to SEQ ID NO: 5330

SEQ ID NO: 5666 - DNA, 201 bp, Homo sapiens; identical to SEQ ID NO: 5331

SEQ ID NO: 5667 - DNA, 201 bp, Homo sapiens; identical to SEQ ID NO: 5332

SEQ ID NO: 5668 - DNA, 201 bp, Homo sapiens; identical to SEQ ID NO: 5333

SEQ ID NO: 5669 - DNA, 201 bp, Homo sapiens; identical to SEQ ID NO: 5334

SEQ ID NO: 5670 - DNA, 201 bp, Homo sapiens; identical to SEQ ID NO: 5335

SEQ ID NO: 5671 - DNA, 201 bp, Homo sapiens; identical to SEQ ID NO: 5336

SEQ ID NO: 5672 - DNA, 201 bp, Homo sapiens; identical to SEQ ID NO: 5337

SEQ ID NO: 5673 - DNA, 201 bp, Homo sapiens; identical to SEQ ID NO: 5338

SEQ ID NO: 5674 - DNA, 201 bp, Homo sapiens; identical to SEQ ID NO: 5339

SEQ ID NO: 5675 - DNA, 201 bp, Homo sapiens; identical to SEQ ID NO: 5340

SEQ ID NO: 5676 - DNA, 201 bp, Homo sapiens; identical to SEQ ID NO: 5341

SEQ ID NO: 5677 - DNA, 201 bp, Homo sapiens; identical to SEQ ID NO: 5342

SEQ ID NO: 5678 - DNA, 201 bp, Homo sapiens; identical to SEQ ID NO: 5343

SEQ ID NO: 5679 - DNA, 201 bp, Homo sapiens; identical to SEQ ID NO: 5344

SEQ ID NO: 5680 - DNA, 201 bp, Homo sapiens; identical to SEQ ID NO: 5345

SEQ ID NO: 5681 - DNA, 201 bp, Homo sapiens; identical to SEQ ID NO: 5346

SEQ ID NO: 5682 - DNA, 201 bp, Homo sapiens
ataaaacaattgtagcatattcttttaaattgatatatactcttacagttcagcagatgttccataatttaccaaagtattcatctctcattgtaattccytttttttgtaaattacaaaagttgtggttaatattaagacagatttgcctagatagcttttagaattgctgtgtcaaagaaaacgaaaaaattaaattgg

SEQ ID NO: 5683 - DNA, 201 bp, Homo sapiens
aaaaatctggaaacattgcaaagtaggatgatcgcattctaataatttcatattcttaagtgccccactgtcatcttcctttacttctggaaggaaacatrtagatattaacacagttgcaccttcacctcctcatccccttccccactggcagtggttttaatagcaagccccatgtgggtattagcatttaatggagca

SEQ ID NO: 5684 - DNA, 201 bp, Homo sapiens
aagaaggaggttgctggccttggatatcataatttctggggacaactttaagtggacactaatatttctgactaggaaaacttcaaaaacttcatggcaartgcagaagagacaaagacgtatagtccatgttatccactattttctgagcacagaagaaaatgatcaagacccaggaatcactgaccctggaggatgtgg

SEQ ID NO: 5685 - DNA, 201 bp, Homo sapiens
catgatacatttgacttgtacagaaaaaatttgaaatcaagtttaagtttaatcaaccagaagagaagacatggaataaataaccctgttgagtttattgraggtgagaaaacacttctacatggtaagcatgaacgtacgcatactaaaactagattttctgaaaatgcaaaatgtatccatactaaattccaagtcttc

SEQ ID NO: 5686 - DNA, 201 bp, Homo sapiens
cgtgaagagcaatctcattgtacatcagcgctcccacacaggagaaaaatcttacatatgcagcgaatgtggaaaaggcttcactgtcaaacgcactctcrttatacatcagcgaactcatacaggagagaaatcttacatatgcaatgaatgtggtaaaggcttcaccacaaagcgcactcttattatacatcagcgaac

SEQ ID NO: 5687 - DNA, 201 bp, Homo sapiens
ttctcccacctcctggaaggggaggggtgctggagattagattagacaatgagattaagagaactccaaatagcccaagagggtggtgcacccccaacttyataggggtagaggctcctgagattaggagaaccctttttaggctttactctatgtacctcttcatttgagtgttcatttgcgtcctttataaccagtaaa

SEQ ID NO: 5688 - DNA, 201 bp, Homo sapiens
taatttagactgcactaactaacttgcactgcactaacttggactgcactaacttgtggagtctgcactaacttggagaagttagtgtcagaattgaattrtagaacacccagttgttcagaattgaattgtagaacacccaattggtgtgggagaattagagaatttatttgtgtcagaaaatactccagaacaaccacc

SEQ ID NO: 5689 - DNA, 201 bp, Homo sapiens
ttccaagtcttcaagcatcagaggactcagaaaattgagaaaccccatgcatgcattgaatgtgagcaaaccttccttaggaagtctcagctcatttaccrtgagaacatttgtatacaagagaatcctggaagtggtcaatgtgagaaattatccagaagtgtcctgttcactaagcatctgaaaactaatacaacagac

SEQ ID NO: 5690 - DNA, 201 bp, Homo sapiens
aagcaatgaaggaagaagaaggaggttgctggccttggatatcataatttctggggacaactttaagtggacactaatatttctgactaggaaaacttcaraaacttcatggcaaatgcagaagagacaaagacgtatagtccatgttatccactattttctgagcacagaagaaaatgatcaagacccaggaatcactga

SEQ ID NO: 5691 - DNA, 201 bp, Homo sapiens
agtgattcccacagccattatggccgctcctgtcagaaacgctgcgatgggcgcagccctgtgacctcatagagcggcgcccgcagtctgaactcgcgatyccgggcaggctccgtggtcctcgcctcgcttcacggtctttaccgctcagcttcccggagtccgcgcaggagcgcgtctgaataggaagcgttttcggac

SEQ ID NO: 5692 - DNA, 173 bp, Homo sapiens
caaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatatttttc

SEQ ID NO: 5693 - DNA, 201 bp, Homo sapiens
gagtgtcccttgcaacgaagagagaaaggcactgaggtgactaagagtgattcccacagccattatggccgctcctgtcagaaacgctgcgatgggcgcarccctgtgacctcatagagcggcgcccgcagtctgaactcgcgatcccgggcaggctccgtggtcctcgcctcgcttcacggtctttaccgctcagcttcc

SEQ ID NO: 5694 - DNA, 201 bp, Homo sapiens
aatatgttaaatatattaacaacatatttggacttgcttaactaagattatagagatgatcagtttataaaaccaccttcaacttaaataaatttgaactygaaattgcaaaagcagtctagaggctttgctagtatccttcaaccaatttctagtaaaaatatcctatataaccataattatcaaaaccagaaaaacaac

SEQ ID NO: 5695 - DNA, 172 bp, Homo sapiens
caaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatattttt

SEQ ID NO: 5696 - DNA, 171 bp, Homo sapiens
caaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatatttt

SEQ ID NO: 5697 - DNA, 201 bp, Homo sapiens
aagtggacactaatatttctgactaggaaaacttcaaaaacttcatggcaaatgcagaagagacaaagacgtatagtccatgttatccactattttctgakcacagaagaaaatgatcaagacccaggaatcactgaccctggaggatgtggctgtggaattcagctgggaggagtggcagctcctggacactgctcagaa

SEQ ID NO: 5698 - DNA, 201 bp, Homo sapiens
ccatattatgattagctcttttcctttctttggctctgagcttaattgtacattaagcaaacttaagtagaaaagaaactgaatatgttaaatatattaahaacatatttggacttgcttaactaagattatagagatgatcagtttataaaaccaccttcaacttaaataaatttgaactcgaaattgcaaaagcagtct

SEQ ID NO: 5699 - DNA, 201 bp, Homo sapiens
gatgtgatggtggagaactataaccacctagtatcactggggtatcaaactagcaaaccagatgtactctccaagttggcacatggacaagaaccatggayaacagatgctaaaattcagaataaaaattgtccaggaatcgggaaagttgacagtcatctgcaagagcactctccaaaccaaagacttctgaagagcgtg

SEQ ID NO: 5700 - DNA, 201 bp, Homo sapiens
atcagagaaatcatacagtagagaagtcatatctatgtagtgaatgtggaaaaggttttactgtgaaaagcatgctcatcatacatcagcgaactcatacmggagagaagccctacacatgcagtgaatgtgggaaaggcttccccttgaagagtcggctgattgtacatcagcgaactcatactggagagaaaccttaca

SEQ ID NO: 5701 - DNA, 138 bp, Homo sapiens
tctctggaggtttagagggggagggagttgggcgaggrgcccagaagtggaagaagtttagggaagtaagttcagcttttaagaggtcgcggcgattccaaggagagtcagtccacaggtcctggctaccctgggaag

SEQ ID NO: 5702 - DNA, 201 bp, Homo sapiens
cagcctgaccaacatggtgaagcccccctctctactaaaaatacaaaattagccgagcatggtggctcacgcttgtaatcccagctactctggaggctaarctggagaatcacttgaacctgggaggcagaggtttcagtgagccaagattgcgccattgcattccagcctgggcaacaagagcgaaactctgcctcaaaa

SEQ ID NO: 5703 - DNA, 200 bp, Homo sapiens
tctctggaggtttagagggggagggagttgggcgaggggcccagaagtggaagaagtttagggaagtaagttcagcttttaagaggtcgcggcgattccmaggagagtcagtccacaggtcctggctaccctgggaagagacaagaagtaaatgaagaaagaggaagattccaggacctagatatgatttctgtggacac

SEQ ID NO: 5704 - DNA, 201 bp, Homo sapiens
ggtggatcacttgaggtcgggagttcgagaccagcctgaccaacatggtgaagcccccctctctactaaaaatacaaaattagccgagcatggtggctcaygcttgtaatcccagctactctggaggctaagctggagaatcacttgaacctgggaggcagaggtttcagtgagccaagattgcgccattgcattccagcc

SEQ ID NO: 5705 - DNA, 201 bp, Homo sapiens
tggctaccctgggaagagacaagaagtaaatgaagaaagaggaagattccaggacctagatatgatttctgtggacacccttcactggtgactgaagtttstaaatagaaatttaaggcagatccagaggagacaaagacagagtatcccaggtgctggccatttcccacaacagaagaaaatgatcaatgcccaggaatt

SEQ ID NO: 5706 - DNA, 201 bp, Homo sapiens
gaactcatgaaatagaaaaaaaccacgtatgcagtgaatgtgggaaagcgtttgtcaagaagtctcagctcactgatcatgagagagttcatacaggagaraaaccttatggatgtactttgtgtgcaaaagtgttctccagaaagtccaggctaaatgaacatcaaagaattcataaaagagagaaatcttttatatgca

SEQ ID NO: 5707 - DNA, 201 bp, Homo sapiens
ccaatagcactaaatcccaagtcagtaagcatcagagaactcatgaaatagaaaaaaaccacgtatgcagtgaatgtgggaaagcgtttgtcaagaagtckcagctcactgatcatgagagagttcatacaggagaaaaaccttatggatgtactttgtgtgcaaaagtgttctccagaaagtccaggctaaatgaacatc

SEQ ID NO: 5708 - DNA, 201 bp, Homo sapiens
atgtggaaaaggcttcactgggaagagcatgcttattatacatcagcgaactcatacaggagagaagccctacatctgtagtgaatgtgggaaaggcttcmccacaaaacactatgtcatcatacatcaacgaaatcatacaggagagaaaccatatatatgcaatgaatgtgggaaaggcttcaccatgaagagccgtat

SEQ ID NO: 5709 - DNA, 201 bp, Homo sapiens
aaactttgaaatcaaatttaagtttagtcaaccagaacaaaagctgtgaaattaacaactctactaaatttagtggagatgggaaatcatttcttcatggyaactatgaagaactttattctgcagctaaattctctgtaagtacaaaagccaatagcactaaatcccaagtcagtaagcatcagagaactcatgaaatag

SEQ ID NO: 5710 - DNA, 201 bp, Homo sapiens
tgaacctgggaggcagaggtttcagtgagccaagattgcgccattgcattccagcctgggcaacaagagcgaaactctgcctcaaaaaaaaaaaaaaaaaaccatatttgaggactgtcacaaatctaaactcatgatacacttgatatctattctgtgacagcataccttgcatcatattatcaatgattccataattgt

SEQ ID NO: 5711 - DNA, 201 bp, Homo sapiens
atctggtgttatttattagttcttacatattataggccccaaatttatttttttcaatttactgataaatgtaattcagtatatttggatgtgtttatccmagttactaggtaccattatgtagtttacaaaaatgccttaaatgttatttttctaaaatttgttttgaaataattctagattcacaagagattacaaaat

SEQ ID NO: 5712 - DNA, 201 bp, Homo sapiens; identical to SEQ ID NO: 5700

SEQ ID NO: 5713 - DNA, 138 bp, Homo sapiens; identical to SEQ ID NO: 5701

SEQ ID NO: 5714 - DNA, 201 bp, Homo sapiens; identical to SEQ ID NO: 5702

SEQ ID NO: 5715 - DNA, 200 bp, Homo sapiens; identical to SEQ ID NO: 5703

SEQ ID NO: 5716 - DNA, 201 bp, Homo sapiens; identical to SEQ ID NO: 5704

SEQ ID NO: 5717 - DNA, 201 bp, Homo sapiens; identical to SEQ ID NO: 5705

SEQ ID NO: 5718 - DNA, 201 bp, Homo sapiens; identical to SEQ ID NO: 5706

SEQ ID NO: 5719 - DNA, 201 bp, Homo sapiens; identical to SEQ ID NO: 5707

SEQ ID NO: 5720 - DNA, 201 bp, Homo sapiens; identical to SEQ ID NO: 5708

SEQ ID NO: 5721 - DNA, 201 bp, Homo sapiens; identical to SEQ ID NO: 5709

SEQ ID NO: 5722 - DNA, 201 bp, Homo sapiens; identical to SEQ ID NO: 5710

SEQ ID NO: 5723 - DNA, 201 bp, Homo sapiens; identical to SEQ ID NO: 5711

SEQ ID NO: 5724 - DNA, 201 bp, Homo sapiens; identical to SEQ ID NO: 5700

SEQ ID NO: 5725 - DNA, 201 bp, Homo sapiens; identical to SEQ ID NO: 5702

SEQ ID NO: 5726 - DNA, 201 bp, Homo sapiens; identical to SEQ ID NO: 5704

SEQ ID NO: 5727 - DNA, 201 bp, Homo sapiens; identical to SEQ ID NO: 5705

SEQ ID NO: 5728 - DNA, 201 bp, Homo sapiens; identical to SEQ ID NO: 5706

SEQ ID NO: 5729 - DNA, 201 bp, Homo sapiens; identical to SEQ ID NO: 5707

SEQ ID NO: 5730 - DNA, 201 bp, Homo sapiens; identical to SEQ ID NO: 5708

SEQ ID NO: 5731 - DNA, 201 bp, Homo sapiens; identical to SEQ ID NO: 5709

SEQ ID NO: 5732 - DNA, 201 bp, Homo sapiens; identical to SEQ ID NO: 5710

SEQ ID NO: 5733 - DNA, 201 bp, Homo sapiens; identical to SEQ ID NO: 5711

SEQ ID NO: 5734 - DNA, 201 bp, Homo sapiens; identical to SEQ ID NO: 5700

SEQ ID NO: 5735 - DNA, 201 bp, Homo sapiens
ccataccaatgtgatgtatgtggcaggatcttcagacaaaattcagatcttgtaaatcaccggagaagtcacactggagacaaaccctacatatgtaatgmatgtggcaagtcctttagtaaaagttcccaccttgcagttcatcagagaattcatactggagagaaaccttacaaatgtaatcgatgtgggaagtgcttt

SEQ ID NO: 5736 - DNA, 201 bp, Homo sapiens
cagggctccacactcaatagacatcagagaattcataccggagagaaaccttacaaatgcaatcagtgtgggaattcctttagtcagcgtgtccatcttaracttcatcagactgttcatactggagacagaccttacaaatgtaatgagtgtggcaaaacctttaaacggagctcaaacctcactgcacatcagataatt

SEQ ID NO: 5737 - DNA, 201 bp, Homo sapiens
ttgtacaaggatgtgatgttggagaactataggaacctggtcttcctaggtatctctcctaaatgtgtgatcaaggaattaccaccaacagagaacagtartacaggagaaaggttccaaacagtggcactggaaagacatcaaagctatgatattgaaaatttatacttcagggaaatacagaaacatctacatgacctt

SEQ ID NO: 5738 - DNA, 201 bp, Homo sapiens
gtggcaaagcctttagagtacgttcaattctgcttaatcatcagatgatgcatactggagagaaaccttataaatgtaatgaatgtggtaaagcttttatygaaaggtcaaacttggtttaccatcagagaaaccatactggagagaagccatacaaatgtatggaatgtggcaaggcgtttgggcggcggtcttgcctca

SEQ ID NO: 5739 - DNA, 201 bp, Homo sapiens
acaaatgcaaagaatgtggcaaggtcttcagtcaatgttcacgtcttacagtgcatcggagaattcatagtggagagaaaccttacaaatgcaatgaatgyggcaaggtctacagtcagtattcacatcttgtagggcatcgaagagttcatactggagagaaaccatacaaatgtcatgaatgtggcaaagcctttaatc

SEQ ID NO: 5740 - DNA, 201 bp, Homo sapiens
gcttttgcaaggcatcggagaattcatactggagagaagccttacaaatgcaaagaatgtggcaaggtcttcagtcaatgttcacgtcttacagtgcatckgagaattcatagtggagagaaaccttacaaatgcaatgaatgcggcaaggtctacagtcagtattcacatcttgtagggcatcgaagagttcatactgga

SEQ ID NO: 5741 - DNA, 201 bp, Homo sapiens
ttcagtaaacgttcaagtcttgcagtgcatcagagaattcatactggacagaaaacttacaaatgcaataaatgtggcaaggtgtacagtaagcattcacrtcttgcagtgcattggagaattcataccggcgagaaagcttataaatgcaatgaatgtggcaaagttttcagcatacattcacgacttgcagctcatcag

SEQ ID NO: 5742 - DNA, 201 bp, Homo sapiens
catacaaatgtcatgaatgtggcaaagcctttaatcagggctccacactcaatagacatcagagaattcataccggagagaaaccttacaaatgcaatcartgtgggaattcctttagtcagcgtgtccatcttagacttcatcagactgttcatactggagacagaccttacaaatgtaatgagtgtggcaaaaccttta

SEQ ID NO: 5743 - DNA, 201 bp, Homo sapiens; identical to SEQ ID NO: 5708

SEQ ID NO: 5744 - DNA, 201 bp, Homo sapiens
ctctcaggaggagtggaaatgcctggagcctgtgcagaaagctttgtacaaggatgtgatgttggagaactataggaacctggtcttcctaggtatctctyctaaatgtgtgatcaaggaattaccaccaacagagaacagtaatacaggagaaaggttccaaacagtggcactggaaagacatcaaagctatgatattga

SEQ ID NO: 5745 - DNA, 201 bp, Homo sapiens; identical to SEQ ID NO: 5686

SEQ ID NO: 5746 - DNA, 201 bp, Homo sapiens
attgtctccagcaatgaatcagacaaaagtgctccaccaaccaggcccttgaatcaccttccttgtcccgtgaatcagcacagcctgccacggcaaagttktatcagcccactcctggaaatgatcagtgaaggtcccatcatgggctgctcatagtcctgtggaccaggtgctaaacttacctaccagagattaacattc

SEQ ID NO: 5747 - DNA, 201 bp, Homo sapiens; identical to SEQ ID NO: 5697

SEQ ID NO: 5748 - DNA, 201 bp, Homo sapiens; identical to SEQ ID NO: 5684

SEQ ID NO: 5749 - DNA, 201 bp, Homo sapiens; identical to SEQ ID NO: 5690

SEQ ID NO: 5750 - DNA, 201 bp, Homo sapiens
catgatacatttgacttgtacagaaaaaatttgaaatcaagtttaagtttaatcaaccagaagagaagacatggaataaataaccctgttgagtttattgragagacagggtctcttgagaggccgaggcaggcggatcacttgaggtcagaagttcaagaccagcctggccaacgtggcgaaaccctgtgtctactaaaa

SEQ ID NO: 5751 - DNA, 201 bp, Homo sapiens; identical to SEQ ID NO: 5699

SEQ ID NO: 5752 - DNA, 201 bp, Homo sapiens; identical to SEQ ID NO: 5694

SEQ ID NO: 5753 - DNA, 201 bp, Homo sapiens; identical to SEQ ID NO: 5687

SEQ ID NO: 5754 - DNA, 201 bp, Homo sapiens; identical to SEQ ID NO: 5686

SEQ ID NO: 5755 - DNA, 201 bp, Homo sapiens; identical to SEQ ID NO: 5689

SEQ ID NO: 5756 - DNA, 201 bp, Homo sapiens; identical to SEQ ID NO: 5698

SEQ ID NO: 5757 - DNA, 201 bp, Homo sapiens; identical to SEQ ID NO: 5688

SEQ ID NO: 5758 - DNA, 201 bp, Homo sapiens; identical to SEQ ID NO: 5685

SEQ ID NO: 5759 - DNA, 201 bp, Homo sapiens
atgtgaatttccacaccaaacagagcatgaggaaccagttgacatgctgggttgtgactggcagctttagcagcctcggtactgaagccacaccagtgtcmggatggaagtctgcatctgaggttgctcagtgtcccggtcattcatttacacattttaacttgcattaaagagctgttcttttctgtggcctagactctt

SEQ ID NO: 5760 - DNA, 201 bp, Homo sapiens
ttgcttcctcagtgtcagggcacatgtgaatttccacaccaaacagagcatgaggaaccagttgacatgctgggttgtgactggcagctttagcagcctcrgtactgaagccacaccagtgtccggatggaagtctgcatctgaggttgctcagtgtcccggtcattcatttacacattttaacttgcattaaagagctgt

SEQ ID NO: 5761 - DNA, 201 bp, Homo sapiens
tcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaactt

SEQ ID NO: 5762 - DNA, 201 bp, Homo sapiens
tggaaagttcaatccacacgtccacgtagaatatgagtggaatcttcgacaggaggagatagatgagagcgatgatgatctggatgacaaaccaagccctrtcaagaaagagcgctcacccagacctcagagcttctgccactcctccagcatctccccccaggacaagctggcactgccaggattcagcactccaaggga

SEQ ID NO: 5763 - DNA, 201 bp, Homo sapiens
gaaggacagcctgaaaggaagggggtctttccagtgtcctttgttcatatcctgtctgactagcaaaacgcagaaccttaagattgtccacatccttcatscaagactgctgccttcatgtaaccctgggcacagtgtgtatatagctgctgttacagagtaagaaactcatggaagggccacctcaggagggggatataa

SEQ ID NO: 5764 - DNA, 201 bp, Homo sapiens
aaggacagcctgaaaggaagggggtctttccagtgtcctttgttcatatcctgtctgactagcaaaacgcagaaccttaagattgtccacatccttcatgmaagactgctgccttcatgtaaccctgggcacagtgtgtatatagctgctgttacagagtaagaaactcatggaagggccacctcaggagggggatataat

SEQ ID NO: 5765 - DNA, 201 bp, Homo sapiens
ctggagaaactgccctagacatagcaaagagactaaaagctacccagtgtgaagatctgctttcccaggctaaatctggaaagttcaatccacacgtccaygtagaatatgagtggaatcttcgacaggaggagatagatgagagcgatgatgatctggatgacaaaccaagccctatcaagaaagagcgctcacccagac

SEQ ID NO: 5766 - DNA, 201 bp, Homo sapiens
attctggtcaagatcatgtacaaaatgaagaaaactatgcacaagttcttgataagtttgggagtaattttttaagtcgagacaaccccgaccttggcacygcgtttgtcaagttttctactcttacaaaggaactgtccacactgctgaaaaatctgctccagggtttgagccacaatgtgatcttcaccttggattctt

SEQ ID NO: 5767 - DNA, 201 bp, Homo sapiens
tgaaaggaagggggtctttccagtgtcctttgttcatatcctgtctgactagcaaaacgcagaaccttaagattgtccacatccttcatgcaagactgctkccttcatgtaaccctgggcacagtgtgtatatagctgctgttacagagtaagaaactcatggaagggccacctcaggagggggatataatgtgtgttgta

SEQ ID NO: 5768 - DNA, 201 bp, Homo sapiens
atccttcatgcaagactgctgccttcatgtaaccctgggcacagtgtgtatatagctgctgttacagagtaagaaactcatggaagggccacctcaggagsgggatataatgtgtgttgtaaatatcctgtggttttctgccttcaccagtatgagggtagcctcggacccggcgcgccttactggtttgccaaagccatc

SEQ ID NO: 5769 - DNA, 201 bp, Homo sapiens
gtggtggattggccacatcgaaggacagcctgaaaggaagggggtctttccagtgtcctttgttcatatcctgtctgactagcaaaacgcagaaccttaakattgtccacatccttcatgcaagactgctgccttcatgtaaccctgggcacagtgtgtatatagctgctgttacagagtaagaaactcatggaagggcca

SEQ ID NO: 5770 - DNA, 201 bp, Homo sapiens; identical to SEQ ID NO: 5759

SEQ ID NO: 5771 - DNA, 201 bp, Homo sapiens; identical to SEQ ID NO: 5760

SEQ ID NO: 5772 - DNA, 201 bp, Homo sapiens; identical to SEQ ID NO: 5761

SEQ ID NO: 5773 - DNA, 201 bp, Homo sapiens; identical to SEQ ID NO: 5762

SEQ ID NO: 5774 - DNA, 201 bp, Homo sapiens; identical to SEQ ID NO: 5763

SEQ ID NO: 5775 - DNA, 201 bp, Homo sapiens; identical to SEQ ID NO: 5764

SEQ ID NO: 5776 - DNA, 201 bp, Homo sapiens; identical to SEQ ID NO: 5765

SEQ ID NO: 5777 - DNA, 201 bp, Homo sapiens; identical to SEQ ID NO: 5766

SEQ ID NO: 5778 - DNA, 201 bp, Homo sapiens; identical to SEQ ID NO: 5767

SEQ ID NO: 5779 - DNA, 201 bp, Homo sapiens; identical to SEQ ID NO: 5768

SEQ ID NO: 5780 - DNA, 201 bp, Homo sapiens; identical to SEQ ID NO: 5769

SEQ ID NO: 5781 - DNA, 194 bp, Homo sapiens
ctcctaggaggcgggtgggcaaacggagacctacgcctcggggtctcccggtgccccggctgggtcccgcccgccggcggaggggcgcgtcctyactcaccggttccggtggcgccgctctcccggggcgcccagcacagcgcgagcagcagccagagcgcccagagcgcggacgtgcccatggtgcccgcctg

SEQ ID NO: 5782 - DNA, 147 bp, Homo sapiens
ggcgcccagcacagcgcgagcagcagccagagcgcccagagcgcggacgtgcccatggtgcccgcctggatggtgccgccgccgccgccgccgccgccgtycgctccgcacgacaagttaccagtccttccgaaaggaggaagaagg

SEQ ID NO: 5783 - DNA, 201 bp, Homo sapiens
ctgagaaatgagcccgccctggggataactgcccaatgtcctcccttccagttcatgagcggcccagttctgtaccaggagaagctgctgaagccggcagrtttgctgctggagaagggtgccgaccaggaggaagacgaggccctgcgggtgctgtccctgcgcgccctcggcaacatggccctgggcgcccccaagaag

SEQ ID NO: 5784 - DNA, 201 bp, Homo sapiens
attttcacagaactgcacgtccaggtgtgcaacaaggccccggcccagcatcagtacagcagccagaatctgatggagatggtgcactgcttcgtagcccytgctcgctcctaccccaaggagctgatgaagttcttcttcagccagatggagacaaacaaggaggccgtccgcgtggggactctgaatctgattagggct

SEQ ID NO: 5785 - DNA, 201 bp, Homo sapiens
agatgaccgttttccagacaaccatgtgctccatcctgactcggaaaaagccggctgttctctaccgcttcttgctagaaacaatggcctatgttaaaaaraacttgtcaagaatcagaatcgctgcttgcaacttggcaggaattattatgaagcagatgtctacacattatctgaaaaagctggacttcccagcattac

SEQ ID NO: 5786 - DNA, 201 bp, Homo sapiens
tgcagcacgtggagggccacaggcagaggctggccgagctggtgctcaggggcatggactcagaagtcctgagctgccgcatcagcagcacagcggtctgrgtggaattcatgagcggcccagttctgtaccaggagaagctgctgaagccggcagctttgctgctggagaagggtgccgaccaggaggaagacgaggccc

SEQ ID NO: 5787 - DNA, 201 bp, Homo sapiens
gtttagctgcgatgaggtggtctcgctcatccagaagctctgcgagaacactggggccatgaacctgcagcatgacaaggcctctgtcacctggatagccytcttcctccagatgcgggccaaggagctggaggacaaggtggccgagatcctgagtgccatcctggtgcacctgccggtggtggaccacccagaggtgcg

SEQ ID NO: 5788 - DNA, 201 bp, Homo sapiens
gagcttgagaaatgtaagggggacctccagagcacagatgtggagaagatcttctgtgcatcctccagaatcgccaaggtggtctgcatggagtttagctycgatgaggtggtctcgctcatccagaagctctgcgagaacactggggccatgaacctgcagcatgacaaggcctctgtcacctggatagccttcttcctc

SEQ ID NO: 5789 - DNA, 201 bp, Homo sapiens
ccaaggggctgcaggagatggtgcagctcctggaaaagtggatcttgtcggagaaagaatgggagcgggaaaaggccgtgagcctccatctctatctcatycggatttatgtccacagcactgctgtctgtatccacctaaagctggggcagtttggcacaatggtcggactcattgccccgtgcacctgtgatgcccatc

SEQ ID NO: 5790 - DNA, 201 bp, Homo sapiens
gcggcccagttctgtaccaggagaagctgctgaagccggcagctttgctgctggagaagggtgccgaccaggaggaagacgaggccctgcgggtgctgtcmctgcgcgccctcggcaacatggccctgggcgcccccaagaaggtgaagcagtaccggaaggtcttgctggagaagtgcctgggccccctgagggagcccg

SEQ ID NO: 5791 - DNA, 201 bp, Homo sapiens
gtgatgcccatcaaagaacccgcatggcctcaatgaatgtcctgtccagcctgctagatcttcacgcaagccagacctgctccttgtggggcccttccaascagaaggagcttgagaaatgtaagggggacctccagagcacagatgtggagaagatcttctgtgcatcctccagaatcgccaaggtggtctgcatggagt

SEQ ID NO: 5792 - DNA, 201 bp, Homo sapiens
gctggacccggatcccggggtcaggagggcagccctggagacgctcacagtcttggatagctgtagtcagcatgggtttctggcttcaccccaaggaatgycctaggtggtccaaacataagacgtaaactgtcttcttagtgccaaatgcaagccctttttaatttagtttgtaagaagtttagtttgtaggaaaaacac

SEQ ID NO: 5793 - DNA, 201 bp, Homo sapiens
agcacctggaggagagcgtgtaccccgtgatgactgaggaggagtttgccctgaaggtgttccccatgtatcgctacttcgtgacagtgtggctgaggcaycacaaccccgaggtgaagctgggggtgatcaagtccctgaagcccatgctcggcctccttctgcccaacgatgacctgcgggagcaggtctacgactaca

SEQ ID NO: 5794 - DNA, 201 bp, Homo sapiens
gagttcacttgggatcagaaagcctgggaagacaagctgattcagtttctgcgaaactccctcaagaagacccgggggtctagctggagcctgcgcttgaytaaagagctgaacaaccagattgcgagctttgacagcccctctctggagaagggctttctgtaccgggccttgggcttcaccttggccacaggcctggag

SEQ ID NO: 5795 - DNA, 201 bp, Homo sapiens
acgtggagggccacaggcagaggctggccgagctggtgctcaggggcatggactcagaagtcctgagctgccgcatcagcagcacagcggtctgcgtggarttcatgagcggcccagttctgtaccaggagaagctgctgaagccggcagctttgctgctggagaagggtgccgaccaggaggaagacgaggccctgcggg

SEQ ID NO: 5796 - DNA, 201 bp, Homo sapiens
tggcgcaccaccaccaggagaccatcctcacatcgctcctgaggcagccactgcccatggagagccacctggcagaggtgtggctggcagtgtcggagaargtgcccttcgcccggaccatgctccacagcctgatgggccggctgcagtcacggctcagccccagaatcagtgccacctccaaggctgacatctggcgcc

SEQ ID NO: 5797 - DNA, 110 bp, Homo sapiens
atttagtttgtaagaagtttagtttgtaggaaaaacactattgtaaaataactagtatccttttgtttccttccgttgaaataaacctccactgtcgttgwagtagactt

SEQ ID NO: 5798 - DNA, 201 bp, Homo sapiens
gcaggtctacgactacatccccctgctgctggcggagtaccagggcaaaggtcacctgccaccatttgccaatccactgcaggtcttgaggcagatcctgrgactgtcagtcaccaccaacacccctgtcccccaaatgcagctacacaccattttcacagaactgcacgtccaggtgtgcaacaaggccccggcccagca

SEQ ID NO: 5799 - DNA, 201 bp, Homo sapiens
atgctgcactcccaggacccctgctccaatgcagcccaagcctgtatggctaccatgtttcagtgtgtgcacttctggggctggaagtccctggagcatcrctcagggccaagtgataccgctactgatgacaagatgaccgttttccagacaaccatgtgctccatcctgactcggaaaaagccggctgttctctaccgc

SEQ ID NO: 5800 - DNA, 201 bp, Homo sapiens
gtgataccgctactgatgacaagatgaccgttttccagacaaccatgtgctccatcctgactcggaaaaagccggctgttctctaccgcttcttgctagaracaatggcctatgttaaaaataacttgtcaagaatcagaatcgctgcttgcaacttggcaggaattattatgaagcagatgtctacacattatctgaaaa

SEQ ID NO: 5801 - DNA, 201 bp, Homo sapiens
agagctttttcttgtggttaatatctgtttaatccagaagaagaccctaaggaaagagcttgaggaagagatgactgaagccattacagaagcagcagtamactcaagtgaggaggtgtcagaggaaagagacgacctggggcctcttgaattacatgacagtggtacctttcaacaagtcgtgaaccttctggacatcat

SEQ ID NO: 5802 - DNA, 201 bp, Homo sapiens
agggctatagtgagcgcagatgagcccaggatgagtatcagggccatctacctggctatccgggtagtcaagaacaccatctctgatacccggtccaaggrgaggatggctattctccacatcattgggcagttggctctctgtggctaccaggagagaatcaaaggctggggcctgaagtacctgtctgtgcagctgacc

SEQ ID NO: 5803 - DNA, 165 bp, Homo sapiens
atgaattaattcctcccactgtcagctagaagccatccctggctgagccctgcactggccagagrcaactgagtgtgagccagtccagggtcagatcctgggctgatgccacctgagggcggggtgggggcgtggcctccgtgcacatgggagactccaggtgca

SEQ ID NO: 5804 - DNA, 201 bp, Homo sapiens
cctgagggcggggtgggggcgtggcctccgtgcacatgggagactccaggtgcaggagagggggaggtggacttcctcttggtcttcccaagccatgaaayttcctggcttggtggtaacagaagagtctcctccaggacggactagccagtcctaacacaggactagcgttgctctaccacgtccaagcctcctctgaga

SEQ ID NO: 5805 - DNA, 201 bp, Homo sapiens
gagactccaggtgcaggagagggggaggtggacttcctcttggtcttcccaagccatgaaacttcctggcttggtggtaacagaagagtctcctccaggayggactagccagtcctaacacaggactagcgttgctctaccacgtccaagcctcctctgagattcttcctccatgcaaccacttcccctggggcgtggcca

SEQ ID NO: 5806 - DNA, 128 bp, Homo sapiens
atgaattaattcctcccactgtcagctrgaagccatccctggctgagccctgcactggccagaggcaactgagtgtgagccagtccagggtcagatcctgggctgatgccacctgagggcggggtggg

SEQ ID NO: 5807 - DNA, 201 bp, Homo sapiens
ccttacgtctgatcttgatgggggcactggcctggagcctgggcccacctgcttctggggggttggggagcaggccagatggaggtggtggtgccaggaaraaatggagcgatgactgactgtggggtgggcccaggatttccacatcttggtgaagttgcccctgggaagggcagctgggggcagtggcgccagttccct

SEQ ID NO: 5808 - DNA, 201 bp, Homo sapiens
gctgttggtttttcaagtgcaacaaagattccatacagctccaaggaaggagccaagaaaaacattctgtgccaaagtgagatcctggaagtgaaaccccrgaataaagctgaaaaacgggctccagttgggtgccaggaaatgcaggactggaatgtgacttgacttccggcagcgcgcaggtgctcccgggtcacctgc

SEQ ID NO: 5809 - DNA, 201 bp, Homo sapiens
gagcaggccagatggaggtggtggtgccaggaagaaatggagcgatgactgactgtggggtgggcccaggatttccacatcttggtgaagttgcccctggraagggcagctgggggcagtggcgccagttcccttccatggtctcccggctggcaatgtggtgaagctgagtttctgtccaatgagcaggaagattctgag

SEQ ID NO: 5810 - DNA, 201 bp, Homo sapiens
cccacctgcttctggggggttggggagcaggccagatggaggtggtggtgccaggaagaaatggagcgatgactgactgtggggtgggcccaggatttccrcatcttggtgaagttgcccctgggaagggcagctgggggcagtggcgccagttcccttccatggtctcccggctggcaatgtggtgaagctgagtttctg

SEQ ID NO: 5811 - DNA, 201 bp, Homo sapiens
cccaagagctactgcagagaagcgacgaggagggccaggctctacggggggatgcagctgtggctctgaacaaggggcccgcgaggcaggccaaatgctgygcccactaggtgcagccactcctgggggctgtggggaagacaccccctgcctgggccatggccagctctaggtggattctgattcactgtcaatgctggg

SEQ ID NO: 5812 - DNA, 145 bp, Homo sapiens
tcagttgcctctggccagtgcagggctcagccagggatggcttcyagctgacagtgggaggaattaattcatctgaccggaatattcttttctcttctgggctgttggtttttcaagtgcaacaaagattccatacagctccaag

SEQ ID NO: 5813 - DNA, 201 bp, Homo sapiens
gtgaaaccccggaataaagctgaaaaacgggctccagttgggtgccaggaaatgcaggactggaatgtgacttgacttccggcagcgcgcaggtgctcccrggtcacctgctttgaggtccagcctcctgccctgcctcaggtgaccacatgaccactgtggactttgccctgaaaccttctgggaggagaagaggcctga

SEQ ID NO: 5814 - DNA, 201 bp, Homo sapiens
aggctcttcagctccctgcaagtgaccgggcctggggaacagggcatggcacaggcacacaggaccccccagcccagggctgcccccagccagccccgtgygttcaagctggttctcctgggaagtggctccgtgggtaagtccagcttggctcttcggtacgtgaagaacgacttcaagagtatcctgcctacggtgggc

SEQ ID NO: 5815 - DNA, 108 bp, Homo sapiens
tcagttgyctctggccagtgcagggctcagccagggatggcttctagctgacagtgggaggaattaattcatctgaccggaatattcttttctcttctgggctgttgg

SEQ ID NO: 5816 - DNA, 201 bp, Homo sapiens
tgccgacagccagaagttgctgttcatggaaacttcggccaaactgaaccaccaggtgtcggaggtgttcaatacagtggcccaagagctactgcagagargcgacgaggagggccaggctctacggggggatgcagctgtggctctgaacaaggggcccgcgaggcaggccaaatgctgcgcccactaggtgcagccact

SEQ ID NO: 5817 - DNA, 201 bp, Homo sapiens
ggaccccccagcccagggctgcccccagccagccccgtgtgttcaagctggttctcctgggaagtggctccgtgggtaagtccagcttggctcttcggtaygtgaagaacgacttcaagagtatcctgcctacggtgggctgtgcgttcttcacaaaggtggtggatgtgggtgccacctctctgaagcttgagatctggg

SEQ ID NO: 5818 - DNA, 201 bp, Homo sapiens
tgggtaagtccagcttggctcttcggtacgtgaagaacgacttcaagagtatcctgcctacggtgggctgtgcgttcttcacaaaggtggtggatgtgggygccacctctctgaagcttgagatctgggacacagctggccaggagaagtaccacagcgtctgccacctctacttcaggggtgccaacgctgcgcttctgg

SEQ ID NO: 5819 - DNA, 201 bp, Homo sapiens
cctgccctgcctcaggtgaccacatgaccactgtggactttgccctgaaaccttctgggaggagaagaggcctgaccttggcgctggggtccagtgggcaytgctctggtccgaggctgctgctcttgacctctgctctgcggctgttttccattggagtagaggctcctcctgtcctgtcctgcctgtggagggaagcaa

SEQ ID NO: 5820 - DNA, 201 bp, Homo sapiens
atctgattccccgatgcctgtgcctgttccacctggacggtggccccctcagcctggcagcctctggacagagaggaaggaaggattggaaaagtccccgsagcacagcgacggtgggaagatgccttacgtctgatcttgatgggggcactggcctggagcctgggcccacctgcttctggggggttggggagcaggcca

SEQ ID NO: 5821 - DNA, 201 bp, Homo sapiens
tcctgccctgcctcaggtgaccacatgaccactgtggactttgccctgaaaccttctgggaggagaagaggcctgaccttggcgctggggtccagtgggcrttgctctggtccgaggctgctgctcttgacctctgctctgcggctgttttccattggagtagaggctcctcctgtcctgtcctgcctgtggagggaagca

SEQ ID NO: 5822 - DNA, 180 bp, Homo sapiens
ctgggaagggcagctgggggcagtggcgccagttcccttccatggtctcccggctggcaatgtggtgaagctgagtttctgtccaatgagcaggaagattytgagacatttcgcctgagatataagttgtactgcgtatgcagtttttcctccaaaaattaaattgcttttgacaatctg

SEQ ID NO: 5823 - DNA, 201 bp, Homo sapiens
agaagcgacgaggagggccaggctctacggggggatgcagctgtggctctgaacaaggggcccgcgaggcaggccaaatgctgcgcccactaggtgcagcyactcctgggggctgtggggaagacaccccctgcctgggccatggccagctctaggtggattctgattcactgtcaatgctgggttgctcccgagccctag

SEQ ID NO: 5824 - DNA, 201 bp, Homo sapiens
ctgggttgctcccgagccctagatgttcctggaagttggccccctttatgaaaaccacttcccacagccagtgggaactgccagaggaagatctggcgtcrcatggctcccaggaaagtgctgtgccctatccccactgataccatctgattccccgatgcctgtgcctgttccacctggacggtggccccctcagcctgg

SEQ ID NO: 5825 - DNA, 201 bp, Homo sapiens
ttcatggaaacttcggccaaactgaaccaccaggtgtcggaggtgttcaatacagtggcccaagagctactgcagagaagcgacgaggagggccaggctcyacggggggatgcagctgtggctctgaacaaggggcccgcgaggcaggccaaatgctgcgcccactaggtgcagccactcctgggggctgtggggaagaca

SEQ ID NO: 5826 - DNA, 201 bp, Homo sapiens; identical to SEQ ID NO: 5808

SEQ ID NO: 5827 - DNA, 201 bp, Homo sapiens
tgaaaaccacttcccacagccagtgggaactgccagaggaagatctggcgtcacatggctcccaggaaagatttccacatcttggtgaagttgcccctggraagggcagctgggggcagtggcgccagttcccttccatggtctcccggctggcaatgtggtgaagctgagtttctgtccaatgagcaggaagattctgag

SEQ ID NO: 5828 - DNA, 201 bp, Homo sapiens
gttcctggaagttggccccctttatgaaaaccacttcccacagccagtgggaactgccagaggaagatctggcgtcacatggctcccaggaaagatttccrcatcttggtgaagttgcccctgggaagggcagctgggggcagtggcgccagttcccttccatggtctcccggctggcaatgtggtgaagctgagtttctg

SEQ ID NO: 5829 - DNA, 201 bp, Homo sapiens; identical to SEQ ID NO: 5811

SEQ ID NO: 5830 - DNA, 145 bp, Homo sapiens; identical to SEQ ID NO: 5812

SEQ ID NO: 5831 - DNA, 201 bp, Homo sapiens; identical to SEQ ID NO: 5813

SEQ ID NO: 5832 - DNA, 201 bp, Homo sapiens; identical to SEQ ID NO: 5814

SEQ ID NO: 5833 - DNA, 108 bp, Homo sapiens; identical to SEQ ID NO: 5815

SEQ ID NO: 5834 - DNA, 201 bp, Homo sapiens; identical to SEQ ID NO: 5816

SEQ ID NO: 5835 - DNA, 201 bp, Homo sapiens; identical to SEQ ID NO: 5817

SEQ ID NO: 5836 - DNA, 201 bp, Homo sapiens; identical to SEQ ID NO: 5818

SEQ ID NO: 5837 - DNA, 201 bp, Homo sapiens; identical to SEQ ID NO: 5819

SEQ ID NO: 5838 - DNA, 201 bp, Homo sapiens; identical to SEQ ID NO: 5821

SEQ ID NO: 5839 - DNA, 174 bp, Homo sapiens
ctgggaagggcagctgggggcagtggcgccagttcccttccatggtctcccggctggcaatgtggtgaagctgagtttctgtccaatgagcaggaagattytgagacatttcgcctgagatataagttgtactgcgtatgcagtttttcctccaaaaattaaattgcttttgac

SEQ ID NO: 5840 - DNA, 201 bp, Homo sapiens; identical to SEQ ID NO: 5823

SEQ ID NO: 5841 - DNA, 201 bp, Homo sapiens
ctgggttgctcccgagccctagatgttcctggaagttggccccctttatgaaaaccacttcccacagccagtgggaactgccagaggaagatctggcgtcrcatggctcccaggaaagatttccacatcttggtgaagttgcccctgggaagggcagctgggggcagtggcgccagttcccttccatggtctcccggctgg

SEQ ID NO: 5842 - DNA, 201 bp, Homo sapiens; identical to SEQ ID NO: 5825

SEQ ID NO: 5843 - DNA, 201 bp, Homo sapiens
tgggctgccaggtacaagtaagggaatctttgctgtgcccactgtcctccagtagagaacccaacaggcaagggccccactcaggtatcagctcacctccygcacctccccttagcaggaactccttccactggcaaaggactgccactgccatctgactcaactgtggcgatgtggacggagtcaccgagctgcttttct

SEQ ID NO: 5844 - DNA, 201 bp, Homo sapiens
ttgtggaccaggccttagatgagtttctcaggctcagcactgacattctgggccggatcatcctctcttgtgggaccatcctgtgcactgcaggatgtttyacagcacccctggcctctacccactagaatcctacaatctaccagatcctaggatctagttgatcctagaatgctaccaaggagacttgaattttggtcc

SEQ ID NO: 5845 - DNA, 201 bp, Homo sapiens
tctctatctcctggaacccgcccaatggtccagccgccaggcagatgcttgatggctacgcggtcacctacgtctcctccgacggctcctaccgccgcacrgactttgtggacaggacccgctcctcgcaccagctccaggccctggcggccggcagggcctacaacatctccgtcttctcagtgaagcgaaacagtaaca

SEQ ID NO: 5846 - DNA, 201 bp, Homo sapiens
acatctgcttcccaccatgcttctaagcagctgtcttccccctgctaatgttacaaccaaagcagccaccccacctcctctcgtgttgagcctcacgaccrctgacccagctggaaagccagcgccctgccgcgtcaccctgactctgctcagagccagcattccagccacaaagagggcctccttcctttcctctttcat

SEQ ID NO: 5847 - DNA, 201 bp, Homo sapiens
gaagaatgaaccccatcttccaactgtcacggaattatcaccaacatattcaaaagagaaaaaaataaaaccaattgttgatatattgagtccccttgatktgaatagctcaacataagtatcttattcaggatgggacagggccctccccacagacacgtgacaacagatcaaacatgcatttcctgtttcctgtttggt

SEQ ID NO: 5848 - DNA, 201 bp, Homo sapiens
agaaggaaatacatagtgattcctgaaccggaagaatgaaccccatcttccaactgtcacggaattatcaccaacatattcaaaagagaaaaaaataaaamcaattgttgatatattgagtccccttgatgtgaatagctcaacataagtatcttattcaggatgggacagggccctccccacagacacgtgacaacagat

SEQ ID NO: 5849 - DNA, 201 bp, Homo sapiens
gccagtgcccggctggctttgggggacccacctgtgagacagcccaatccccctgtgacaccaaagagtgtcaacatggtggccagtgccaggtggagaayggctctgcggtgtgtgtgtgccaggccggatacaccggagcagcctgcgagatggatgtggacgactgcagccctgacccctgcctgaatggaggctctt

SEQ ID NO: 5850 - DNA, 201 bp, Homo sapiens
cccagctggaaagccagcgccctgccgcgtcaccctgactctgctcagagccagcattccagccacaaagagggcctccttcctttcctctttcataaaartgttttttgaagagttagagtatattttaggctttttatctttattaaaatttcatgtgcatgtgtctgtgtattctgcaatttgtcattttcagaaaga

SEQ ID NO: 5851 - DNA, 201 bp, Homo sapiens
tctgccactgccaagcagggtacatgggacgccggtgccaggcagaaatcgatgagtgccggtctcagccgtgcctgcatgggggctcttgtcaggaccgygttgctgggtacctgtgcctctgcagcacaggctatgagggcgcccactgtgagctggagagggatgagtgccgagctcacccgtgcagaaatggagggt

SEQ ID NO: 5852 - DNA, 201 bp, Homo sapiens
ccttctttggaggcagttcctcatcccctgtcaacacattccagactgtgctcatcacagacggcaagctctccttcaccatcttcaactatgagtccatygtgtggaccacaggcacacacgccagcagcgggggcaacgccactggcctcgggggcatcgcagcccaggctggcttcaacgcaggcgatgggcagcgtt

SEQ ID NO: 5853 - DNA, 201 bp, Homo sapiens
agagtatattttaggctttttatctttattaaaatttcatgtgcatgtgtctgtgtattctgcaatttgtcattttcagaaagaaggaacaggcaattcgmgaagtttcacctgtactcccgagctgttccccaggctccagacccacttgagagcagaaggtggagctcaatgaagggtctcgagctcagcgaagggtca

SEQ ID NO: 5854 - DNA, 201 bp, Homo sapiens
ccccactcaggtatcagctcacctcctgcacctccccttagcaggaactccttccactggcaaaggactgccactgccatctgactcaactgtggcgatgwggacggagtcaccgagctgcttttcttttgcaaaacaaaagtctttttctttgcagtcacgctgtaagacgaggctgctggagaaaacaaaagcacctag

SEQ ID NO: 5855 - DNA, 201 bp, Homo sapiens
acgttcacaaacgcgtactgcggacttcctgccgccctgggacctgtcactgtttgtccatgtaagctacagcattactagcagatgctaagatcgagtgrtatcactggaaaagtaggtgaatcctactaggaaactttctactccctactaggacctcaagcccctcagccacacagcaaatgctaatatgctccagtg

SEQ ID NO: 5856 - DNA, 201 bp, Homo sapiens
gcaattcgcgaagtttcacctgtactcccgagctgttccccaggctccagacccacttgagagcagaaggtggagctcaatgaagggtctcgagctcagcraagggtcactgggtgaactgagagaaaccacgttcacaaacgcgtactgcggacttcctgccgccctgggacctgtcactgtttgtccatgtaagctaca

SEQ ID NO: 5857 - DNA, 201 bp, Homo sapiens
gaaaatgaaaacactggcacagtgaaatgtctcatttccaaacagttttgcctatggccaagcaaggcaataaagacaaactctcccttttccccattgcrtgtgggctgccaggtacaagtaagggaatctttgctgtgcccactgtcctccagtagagaacccaacaggcaagggccccactcaggtatcagctcacct

SEQ ID NO: 5858 - DNA, 201 bp, Homo sapiens
cctcaacggcggcaagtgcatcgacgactgcgtcacgggcaacccctcctacacctgctcctgcctctcgggcttcacggggcggaggtgccacctggacrtgaacgaatgtgcctcccagccctgtcagaatggtgggacctgtactcacggcatcaacagtttccgctgccagtgcccggctggctttgggggacccac

SEQ ID NO: 5859 - DNA, 201 bp, Homo sapiens
ccacagctgtgactgcgggccagggttcaaaggcagacgctgcgagctcgcctgtataaaggtgtcccgcccctgcacaaggctgttctccgagacaaagkcctttccagtctgggagggaggcgtctgtcaccacgtgtataaaagagtctaccgagttcaccaagacatctgcttcaaagagagctgtgaaagcacaag

SEQ ID NO: 5860 - DNA, 201 bp, Homo sapiens
tagatgtagctccagtgttagcatctgcagagaagctgtccttgactactctaccctcatctatgcacctctcctttgactcctacaccactcacctgtcstgctcaccccagccatcacttctctgaacaccacagtaacaatacttgtcctgatttatatgtgttggttttattttcccaatgagatgtaagctctgaa

SEQ ID NO: 5861 - DNA, 201 bp, Homo sapiens
gtaacaatacttgtcctgatttatatgtgttggttttattttcccaatgagatgtaagctctgaagggcaggaacatgttttatgtatgtctttatcatcwcagttccaaaacggagtatgactgctcaaattgtcgatggattgaaagacggcaaagaggtctaaactaggagctgggactctagggtctgagtctcatc

SEQ ID NO: 5862 - DNA, 201 bp, Homo sapiens
ctgcagagaagctgtccttgactactctaccctcatctatgcacctctcctttgactcctacaccactcacctgtcctgctcaccccagccatcacttctstgaacaccacagtaacaatacttgtcctgatttatatgtgttggttttattttcccaatgagatgtaagctctgaagggcaggaacatgttttatgtatg

SEQ ID NO: 5863 - DNA, 201 bp, Homo sapiens
cccagccatcacttctctgaacaccacagtaacaatacttgtcctgatttatatgtgttggttttattttcccaatgagatgtaagctctgaagggcaggmacatgttttatgtatgtctttatcatctcagttccaaaacggagtatgactgctcaaattgtcgatggattgaaagacggcaaagaggtctaaactagga

SEQ ID NO: 5864 - DNA, 201 bp, Homo sapiens
tcctgctcaccccagccatcacttctctgaacaccacagtaacaatacttgtcctgatttatatgtgttggttttattttcccaatgagatgtaagctctraagggcaggaacatgttttatgtatgtctttatcatctcagttccaaaacggagtatgactgctcaaattgtcgatggattgaaagacggcaaagaggtc

SEQ ID NO: 5865 - DNA, 201 bp, Homo sapiens
aacacatcactcctcagttcaaaaattcctcctgggcttctagatgtagctccagtgttagcatctgcagagaagctgtccttgactactctaccctcatmtatgcacctctcctttgactcctacaccactcacctgtcctgctcaccccagccatcacttctctgaacaccacagtaacaatacttgtcctgatttata

SEQ ID NO: 5866 - DNA, 123 bp, Homo sapiens
tttagcagtctgttagtccacacaggtttcactccagtttggactgatcttctgaatttattttttaaatctttgatttgatttacaaatgaataaaatamaatgatttgggcttctaaaccc

SEQ ID NO: 5867 - DNA, 201 bp, Homo sapiens
gggcagcctgggatcctgcactcaagccataattctgccacttagcctgactgccggcctgaggacccttgggttaacccacactcaccaggaaagagccractccatcactcatggattcagcagaccggcctgcactctctccaccacgctgtgggtactcgtaggtctcacaggaagaagctgacagaggaaggagga

SEQ ID NO: 5868 - DNA, 201 bp, Homo sapiens
gcttctagatgtagctccagtgttagcatctgcagagaagctgtccttgactactctaccctcatctatgcacctctcctttgactcctacaccactcacstgtcctgctcaccccagccatcacttctctgaacaccacagtaacaatacttgtcctgatttatatgtgttggttttattttcccaatgagatgtaagct

SEQ ID NO: 5869 - DNA, 201 bp, Homo sapiens
atgtatgtctttatcatctcagttccaaaacggagtatgactgctcaaattgtcgatggattgaaagacggcaaagaggtctaaactaggagctgggactmtagggtctgagtctcatctctggcacaatgactctgcaactctatttaagtctcttaactgtcattggcctcatgtgagatggagacaaggaggttttgt

SEQ ID NO: 5870 - DNA, 201 bp, Homo sapiens
gatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccct

SEQ ID NO: 5871 - DNA, 201 bp, Homo sapiens
gcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaac

SEQ ID NO: 5872 - DNA, 201 bp, Homo sapiens
agtgtgggtggacagtcctaatggggatctccagctccttcctgtgggctgccacagacagctacccccagaagggtcaatgttgggagtggttgtggctytgagctgctctacagagcttcagtgtgagaggatcgagccattgaaagctcattaccagtaggacataatttttggctctccctattcacaaccagtgca

SEQ ID NO: 5873 - DNA, 201 bp, Homo sapiens
ttacaggagttggcctgggccctgccctggagttttgtattgctgtcaaccccagcatccttcccactgctttcatgggcacggcaatgatctttacctgyttcaccctcagtgcactctatgccaggcgccgtagctacctctttctgggaggtatcttgatgtcagccctgagcttgttgcttttgtcttccctgggga

SEQ ID NO: 5874 - DNA, 201 bp, Homo sapiens
gggataatggagtttttctttagaaacagtgccaagaatgacaagatattaaaaaaaaaaaagaaagaaaaaaaaaaaaacacctacttttaaagaaaatrcctaacagatttttaatatagttatctctaccactttcttttctagtttcttgattttcagctcaggctgcattctaactcatactgtgaagacaaaggt

SEQ ID NO: 5875 - DNA, 201 bp, Homo sapiens
tcctctattttgaattttttgatcaaaaaactgattagcagaatatagtttggagtttggcttcatcttcctggggttcccctcactcccttttttgtcarccccatctgtagcctcttcctctactcaggcagtcgacccgccacgatgagaagtgggaccagcagagggcgccaacttcaggagtccgctttcccacca

SEQ ID NO: 5876 - DNA, 201 bp, Homo sapiens
ggaagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 5877 - DNA, 201 bp, Homo sapiens
aatatagtttggagtttggcttcatcttcctggggttcccctcactcccttttttgtcaaccccatctgtagcctcttcctctactcaggcagtcgacccrccacgatgagaagtgggaccagcagagggcgccaacttcaggagtccgctttcccaccaggcttcattcacccagtggacctgaactgtttggtagagcc

SEQ ID NO: 5878 - DNA, 201 bp, Homo sapiens
ttgctggatttgcattccttacaggagttggcctgggccctgccctggagttttgtattgctgtcaaccccagcatccttcccactgctttcatgggcacrgcaatgatctttacctgcttcaccctcagtgcactctatgccaggcgccgtagctacctctttctgggaggtatcttgatgtcagccctgagcttgttgc

SEQ ID NO: 5879 - DNA, 201 bp, Homo sapiens
gccacccggcccttccttcctcattgttgtttggtatgcgcacagttcctgtgggactgggccgtgagttttccattggaaagaagttcagtggtcccatkgttaactcagcctcaaatctcaactgtcaggccctacaaagaaaatggagagcctcttctggtggatgctttgctccctctgagctgcccatgctggtct

SEQ ID NO: 5880 - DNA, 201 bp, Homo sapiens
ttgaagccaaactccaccttctgtgctttttgcttgggataatggagtttttctttagaaacagtgccaagaatgacaagatattaaaaaaaaaaaagaargaaaaaaaaaaaaacacctacttttaaagaaaatacctaacagatttttaatatagttatctctaccactttcttttctagtttcttgattttcagctca

SEQ ID NO: 5881 - DNA, 201 bp, Homo sapiens
ctcttgaagccaaactccaccttctgtgctttttgcttgggataatggagtttttctttagaaacagtgccaagaatgacaagatattaaaaaaaaaaaaraaagaaaaaaaaaaaaacacctacttttaaagaaaatacctaacagatttttaatatagttatctctaccactttcttttctagtttcttgattttcagc

SEQ ID NO: 5882 - DNA, 201 bp, Homo sapiens; identical to SEQ ID NO: 5870

SEQ ID NO: 5883 - DNA, 201 bp, Homo sapiens; identical to SEQ ID NO: 5871

SEQ ID NO: 5884 - DNA, 201 bp, Homo sapiens; identical to SEQ ID NO: 5872

SEQ ID NO: 5885 - DNA, 201 bp, Homo sapiens; identical to SEQ ID NO: 5873

SEQ ID NO: 5886 - DNA, 201 bp, Homo sapiens; identical to SEQ ID NO: 5874

SEQ ID NO: 5887 - DNA, 201 bp, Homo sapiens; identical to SEQ ID NO: 5875

SEQ ID NO: 5888 - DNA, 201 bp, Homo sapiens
ctgagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 5889 - DNA, 201 bp, Homo sapiens; identical to SEQ ID NO: 5877

SEQ ID NO: 5890 - DNA, 201 bp, Homo sapiens; identical to SEQ ID NO: 5878

SEQ ID NO: 5891 - DNA, 201 bp, Homo sapiens; identical to SEQ ID NO: 5879

SEQ ID NO: 5892 - DNA, 201 bp, Homo sapiens; identical to SEQ ID NO: 5880

SEQ ID NO: 5893 - DNA, 201 bp, Homo sapiens; identical to SEQ ID NO: 5881

SEQ ID NO: 5894 - DNA, 201 bp, Homo sapiens; identical to SEQ ID NO: 5870

SEQ ID NO: 5895 - DNA, 201 bp, Homo sapiens; identical to SEQ ID NO: 5871

SEQ ID NO: 5896 - DNA, 201 bp, Homo sapiens; identical to SEQ ID NO: 5872

SEQ ID NO: 5897 - DNA, 201 bp, Homo sapiens; identical to SEQ ID NO: 5873

SEQ ID NO: 5898 - DNA, 201 bp, Homo sapiens
tggtgtgttctgtgataatgaaaagcatcagaaaagcttttgtactttgtggtttcctctattttgaattttttggttcccctcactcccttttttgtcarccccatctgtagcctcttcctctactcaggcagtcgacccgccacgatgagaagtgggaccagcagagggcgccaacttcaggagtccgctttcccacca

SEQ ID NO: 5899 - DNA, 201 bp, Homo sapiens
aacctagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 5900 - DNA, 201 bp, Homo sapiens
gtactttgtggtttcctctattttgaattttttggttcccctcactcccttttttgtcaaccccatctgtagcctcttcctctactcaggcagtcgacccrccacgatgagaagtgggaccagcagagggcgccaacttcaggagtccgctttcccaccaggcttcattcacccagtggacctgaactgtttggtagagcc

SEQ ID NO: 5901 - DNA, 201 bp, Homo sapiens; identical to SEQ ID NO: 5878

SEQ ID NO: 5902 - DNA, 201 bp, Homo sapiens; identical to SEQ ID NO: 5879

SEQ ID NO: 5903 - DNA, 201 bp, Homo sapiens
ttgaagccaaactccaccttctgtgctttttgcttgggataatggagtttttctttagaaacagtgccaagaatgacaagatattaaaaaaaaaaaagaargaaaaaaaaaaaaacacctacttttaaatttcttgattttcagctcaggctgcattctaactcatactgtgaagacaaaggtgtttttgattcagaaata

SEQ ID NO: 5904 - DNA, 201 bp, Homo sapiens
ctcttgaagccaaactccaccttctgtgctttttgcttgggataatggagtttttctttagaaacagtgccaagaatgacaagatattaaaaaaaaaaaaraaagaaaaaaaaaaaaacacctacttttaaatttcttgattttcagctcaggctgcattctaactcatactgtgaagacaaaggtgtttttgattcagaa

SEQ ID NO: 5905 - DNA, 201 bp, Homo sapiens; identical to SEQ ID NO: 5888

SEQ ID NO: 5906 - DNA, 129 bp, Homo sapiens
ctgatggcaacacctcatagccatgaaactgaacagaaaagactgggacttcttgctggatttgcattccttacagatttcattactgtcttcagaaaacycatgatgatcctggccatgaatgaaaag

SEQ ID NO: 5907 - DNA, 201 bp, Homo sapiens; identical to SEQ ID NO: 5870

SEQ ID NO: 5908 - DNA, 201 bp, Homo sapiens; identical to SEQ ID NO: 5871

SEQ ID NO: 5909 - DNA, 201 bp, Homo sapiens; identical to SEQ ID NO: 5872

SEQ ID NO: 5910 - DNA, 201 bp, Homo sapiens; identical to SEQ ID NO: 5873

SEQ ID NO: 5911 - DNA, 201 bp, Homo sapiens; identical to SEQ ID NO: 5898

SEQ ID NO: 5912 - DNA, 201 bp, Homo sapiens; identical to SEQ ID NO: 5888

SEQ ID NO: 5913 - DNA, 201 bp, Homo sapiens; identical to SEQ ID NO: 5900

SEQ ID NO: 5914 - DNA, 201 bp, Homo sapiens; identical to SEQ ID NO: 5878

SEQ ID NO: 5915 - DNA, 201 bp, Homo sapiens; identical to SEQ ID NO: 5879

SEQ ID NO: 5916 - DNA, 201 bp, Homo sapiens; identical to SEQ ID NO: 5903

SEQ ID NO: 5917 - DNA, 201 bp, Homo sapiens; identical to SEQ ID NO: 5904

SEQ ID NO: 5918 - DNA, 201 bp, Homo sapiens; identical to SEQ ID NO: 5870

SEQ ID NO: 5919 - DNA, 201 bp, Homo sapiens; identical to SEQ ID NO: 5871

SEQ ID NO: 5920 - DNA, 201 bp, Homo sapiens; identical to SEQ ID NO: 5872

SEQ ID NO: 5921 - DNA, 201 bp, Homo sapiens; identical to SEQ ID NO: 5873

SEQ ID NO: 5922 - DNA, 201 bp, Homo sapiens; identical to SEQ ID NO: 5874

SEQ ID NO: 5923 - DNA, 201 bp, Homo sapiens; identical to SEQ ID NO: 5875

SEQ ID NO: 5924 - DNA, 196 bp, Homo sapiens
agtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 5925 - DNA, 201 bp, Homo sapiens; identical to SEQ ID NO: 5877

SEQ ID NO: 5926 - DNA, 201 bp, Homo sapiens; identical to SEQ ID NO: 5878

SEQ ID NO: 5927 - DNA, 201 bp, Homo sapiens; identical to SEQ ID NO: 5879

SEQ ID NO: 5928 - DNA, 201 bp, Homo sapiens; identical to SEQ ID NO: 5880

SEQ ID NO: 5929 - DNA, 201 bp, Homo sapiens; identical to SEQ ID NO: 5881

SEQ ID NO: 5930 - DNA, 201 bp, Homo sapiens; identical to SEQ ID NO: 5870

SEQ ID NO: 5931 - DNA, 201 bp, Homo sapiens; identical to SEQ ID NO: 5871

SEQ ID NO: 5932 - DNA, 201 bp, Homo sapiens; identical to SEQ ID NO: 5872

SEQ ID NO: 5933 - DNA, 201 bp, Homo sapiens; identical to SEQ ID NO: 5873

SEQ ID NO: 5934 - DNA, 201 bp, Homo sapiens; identical to SEQ ID NO: 5874

SEQ ID NO: 5935 - DNA, 201 bp, Homo sapiens; identical to SEQ ID NO: 5875

SEQ ID NO: 5936 - DNA, 201 bp, Homo sapiens; identical to SEQ ID NO: 5899

SEQ ID NO: 5937 - DNA, 201 bp, Homo sapiens; identical to SEQ ID NO: 5877

SEQ ID NO: 5938 - DNA, 201 bp, Homo sapiens; identical to SEQ ID NO: 5878

SEQ ID NO: 5939 - DNA, 201 bp, Homo sapiens; identical to SEQ ID NO: 5879

SEQ ID NO: 5940 - DNA, 201 bp, Homo sapiens; identical to SEQ ID NO: 5880

SEQ ID NO: 5941 - DNA, 201 bp, Homo sapiens; identical to SEQ ID NO: 5881

SEQ ID NO: 5942 - DNA, 201 bp, Homo sapiens
gtgggacgagtaaggaaggggggttgggagaggggcgattgggcaacccggctgcacaaacacgggaggtcaaagattgcgcccagcccgcccaggccggkaatggaataaagggacgcggggcgccggaggctgcacagaagcgagtccgactgtgctcgctgctcagcgccgcacccggaggatgaggctcgccgtggg

SEQ ID NO: 5943 - DNA, 201 bp, Homo sapiens
atctacgggaaggcacatgcccagaagccccaacagatgaatgcaagcctgtgaagtggtgtgcgctgagccaccacgagaggctcaagtgtgatgagtgsagtgttaacagtgtagggaaaatagagtgtgtatcagcagagaccaccgaagactgcatcgccaagatcatgaatggagaagctgatgccatgagcttgg

SEQ ID NO: 5944 - DNA, 201 bp, Homo sapiens
agggtattttgctgtagcagtggtgaagaaatcagcttctgacctcacctgggacaatctgaaaggcaagaagtcctgccatacggcagttggcagaaccsctggctggaacatccccatgggcctgctctacaataagatcaaccactgcagatttgatgaatttttcagtgaaggttgtgcccctgggtctaagaaaga

SEQ ID NO: 5945 - DNA, 112 bp, Homo sapiens
accactgcagatttgatgaatttttcagtgaaggttgtgcccctgggtctaagaaagactccagtctctgtaagctgtgtatgggctcaggcctaaacctstgtgaacccaa

SEQ ID NO: 5946 - DNA, 121 bp, Homo sapiens
ataagatcaaccactgcagatttgatgaatttttcagtgaaggttgtgcccctgggtctaagaaagactccagtctctgtaagctgtgtatgggctcaggcctaaacctgtgtgaacccaa

SEQ ID NO: 5947 - DNA, 201 bp, Homo sapiens
ccagcccgcccaggccgggaatggaataaagggacgcggggcgccggaggctgcacagaagcgagtccgactgtgctcgctgctcagcgccgcacccggargatgaggctcgccgtgggagccctgctggtctgcgccgtcctggggctgtgtctggctgtccctgataaaactgtgagatggtgtgcagtgtcggagcat

SEQ ID NO: 5948 - DNA, 201 bp, Homo sapiens
tgtctacatagcgggcaagtgtggtctggtgcctgtcttggcagaaaactacaataagagcgataattgtgaggatacaccagaggcagggtattttgctrtagcagtggtgaagaaatcagcttctgacctcacctgggacaatctgaaaggcaagaagtcctgccatacggcagttggcagaaccgctggctggaacat

SEQ ID NO: 5949 - DNA, 201 bp, Homo sapiens; identical to SEQ ID NO: 5942

SEQ ID NO: 5950 - DNA, 201 bp, Homo sapiens
taaggaagcttgcgtccacaagatattacgtcaacagcagcacctatttggaagcaacgtaactgactgctcgggcaacttttgtttgttccggtcggaamccaaggaccttctgttcagagatgacacagtatgtttggccaaacttcatgacagaaacacatatgaaaaatacttaggagaagaatatgtcaaggctgt

SEQ ID NO: 5951 - DNA, 201 bp, Homo sapiens
gaaaatgctccacctcatcactcctggaagcctgcactttccgtagaccttaaaatctcagaggtagggctgccaccaaggtgaagatgggaacgcagatkatccatgagtttgccctggtttcactggcccaagtggtttgtgctaaccacgtctgtcttcacagctctgtgttgccatgtgtgctgaacaaaaaataaa

SEQ ID NO: 5952 - DNA, 201 bp, Homo sapiens; identical to SEQ ID NO: 5947

SEQ ID NO: 5953 - DNA, 201 bp, Homo sapiens
cacgtaaacctcttgagaaagcagtggccaatttcttctcgggcagctgtgccccttgtgcggatgggacggacttcccccagctgtgtcaactgtgtccrgggtgtggctgctccacccttaaccaatacttcggctactcgggagccttcaagtgtctgaaggatggtgctggggatgtggcctttgtcaagcactcga

SEQ ID NO: 5954 - DNA, 201 bp, Homo sapiens; identical to SEQ ID NO: 5943

SEQ ID NO: 5955 - DNA, 201 bp, Homo sapiens; identical to SEQ ID NO: 5944

SEQ ID NO: 5956 - DNA, 201 bp, Homo sapiens; identical to SEQ ID NO: 5942

SEQ ID NO: 5957 - DNA, 201 bp, Homo sapiens
gcagctgtgccccttgtgcggatgggacggacttcccccagctgtgtcaactgtgtccagggtgtggctgctccacccttaaccaatacttcggctactcrggagccttcaagtgtctgaaggatggtgctggggatgtggcctttgtcaagcactcgactatatttgagaacttggcaaacaaggctgacagggaccagt

SEQ ID NO: 5958 - DNA, 201 bp, Homo sapiens
gctgctttgcctggacaacacccggaagccggtagatgaatacaaggactgccacttggcccaggtcccttctcataccgtcgtggcccgaagtatgggcrgcaaggaggacttgatctgggagcttctcaaccaggcccaggaacattttggcaaagacaaatcaaaagaattccaactattcagctctcctcatgggaa

SEQ ID NO: 5959 - DNA, 201 bp, Homo sapiens
tgaaggatggtgctggggatgtggcctttgtcaagcactcgactatatttgagaacttggcaaacaaggctgacagggaccagtatgagctgctttgcctrgacaacacccggaagccggtagatgaatacaaggactgccacttggcccaggtcccttctcataccgtcgtggcccgaagtatgggcggcaaggaggact

SEQ ID NO: 5960 - DNA, 201 bp, Homo sapiens
accactgcagatttgatgaatttttcagtgaaggttgtgcccctgggtctaagaaagactccagtctctgtaagctgtgtatgggctcaggcctaaacctstgtgaacccaacaacaaagagggatactacggctacacaggcgctttcaggtgtctggttgagaagggagatgtggcctttgtgaaacaccagactgtcc

SEQ ID NO: 5961 - DNA, 201 bp, Homo sapiens
ggatccacagactttctattatgctgttgctgtggtgaagaaggatagtggcttccagatgaaccagcttcgaggcaagaagtcctgccacacgggtctargcaggtccgctgggtggaacatccccataggcttactttactgtgacttacctgagccacgtaaacctcttgagaaagcagtggccaatttcttctcggg

SEQ ID NO: 5962 - DNA, 201 bp, Homo sapiens; identical to SEQ ID NO: 5951

SEQ ID NO: 5963 - DNA, 201 bp, Homo sapiens
gactgtcccacagaacactgggggaaaaaaccctgatccatgggctaagaatctgaatgaaaaagactatgagttgctgtgccttgatggtaccaggaaayctgtggaggagtatgcgaactgccacctggccagagccccgaatcacgctgtggtcacacggaaagataaggaagcttgcgtccacaagatattacgtca

SEQ ID NO: 5964 - DNA, 201 bp, Homo sapiens; identical to SEQ ID NO: 5950

SEQ ID NO: 5965 - DNA, 201 bp, Homo sapiens
gcccaggtcccttctcataccgtcgtggcccgaagtatgggcggcaaggaggacttgatctgggagcttctcaaccaggcccaggaacattttggcaaagrcaaatcaaaagaattccaactattcagctctcctcatgggaaggacctgctgtttaaggactctgcccacgggtttttaaaagtcccccccaggatggat

SEQ ID NO: 5966 - DNA, 201 bp, Homo sapiens
tctgaaggatggtgctggggatgtggcctttgtcaagcactcgactatatttgagaacttggcaaacaaggctgacagggaccagtatgagctgctttgcytggacaacacccggaagccggtagatgaatacaaggactgccacttggcccaggtcccttctcataccgtcgtggcccgaagtatgggcggcaaggagga

SEQ ID NO: 5967 - DNA, 201 bp, Homo sapiens; identical to SEQ ID NO: 5947

SEQ ID NO: 5968 - DNA, 201 bp, Homo sapiens; identical to SEQ ID NO: 5948

SEQ ID NO: 5969 - DNA, 201 bp, Homo sapiens
aaggttgtgcccctgggtctaagaaagactccagtctctgtaagctgtgtatgggctcaggcctaaacctgtgtgaacccaacaacaaagagggatactayggctacacaggcgctttcaggtgtctggttgagaagggagatgtggcctttgtgaaacaccagactgtcccacagaacactgggggaaaaaaccctgatc

SEQ ID NO: 5970 - DNA, 201 bp, Homo sapiens; identical to SEQ ID NO: 5942

SEQ ID NO: 5971 - DNA, 201 bp, Homo sapiens; identical to SEQ ID NO: 5953

SEQ ID NO: 5972 - DNA, 201 bp, Homo sapiens; identical to SEQ ID NO: 5957

SEQ ID NO: 5973 - DNA, 117 bp, Homo sapiens
gctgctttgcctggacaacacccggaagccggtagatgaatacaaggactgccacttggcccaggtcccttctcataccgtcgtggcccgaagtatgggcrgcaaggaggacttgat

SEQ ID NO: 5974 - DNA, 201 bp, Homo sapiens; identical to SEQ ID NO: 5959

SEQ ID NO: 5975 - DNA, 201 bp, Homo sapiens
gtcattccatccgatggtcccagctgttgctgtggtgaagaaggatagtggcttccagatgaaccagcttcgaggcaagaagtcctgccacacgggtctargcaggtccgctgggtggaacatccccataggcttactttactgtgacttacctgagccacgtaaacctcttgagaaagcagtggccaatttcttctcggg

SEQ ID NO: 5976 - DNA, 201 bp, Homo sapiens; identical to SEQ ID NO: 5966

SEQ ID NO: 5977 - DNA, 201 bp, Homo sapiens; identical to SEQ ID NO: 5947

SEQ ID NO: 5978 - DNA, 201 bp, Homo sapiens; identical to SEQ ID NO: 5953

SEQ ID NO: 5979 - DNA, 201 bp, Homo sapiens; identical to SEQ ID NO: 5943

SEQ ID NO: 5980 - DNA, 201 bp, Homo sapiens; identical to SEQ ID NO: 5944

SEQ ID NO: 5981 - DNA, 201 bp, Homo sapiens; identical to SEQ ID NO: 5957

SEQ ID NO: 5982 - DNA, 201 bp, Homo sapiens; identical to SEQ ID NO: 5958

SEQ ID NO: 5983 - DNA, 201 bp, Homo sapiens; identical to SEQ ID NO: 5959

SEQ ID NO: 5984 - DNA, 201 bp, Homo sapiens; identical to SEQ ID NO: 5960

SEQ ID NO: 5985 - DNA, 201 bp, Homo sapiens; identical to SEQ ID NO: 5961

SEQ ID NO: 5986 - DNA, 201 bp, Homo sapiens; identical to SEQ ID NO: 5951

SEQ ID NO: 5987 - DNA, 201 bp, Homo sapiens; identical to SEQ ID NO: 5963

SEQ ID NO: 5988 - DNA, 201 bp, Homo sapiens; identical to SEQ ID NO: 5950

SEQ ID NO: 5989 - DNA, 201 bp, Homo sapiens; identical to SEQ ID NO: 5965

SEQ ID NO: 5990 - DNA, 201 bp, Homo sapiens; identical to SEQ ID NO: 5966

SEQ ID NO: 5991 - DNA, 134 bp, Homo sapiens
cgactgtgctcgctgctcagcgccgcacccggargatgaggctcgccgtgggagccctgctggtctgcgccgtcctgggcaaacgaagcggatgctgtgacactggatgcaggtttggtgtatgatgcttacct

SEQ ID NO: 5992 - DNA, 201 bp, Homo sapiens; identical to SEQ ID NO: 5948

SEQ ID NO: 5993 - DNA, 201 bp, Homo sapiens; identical to SEQ ID NO: 5969

SEQ ID NO: 5994 - DNA, 201 bp, Homo sapiens; identical to SEQ ID NO: 5943

SEQ ID NO: 5995 - DNA, 201 bp, Homo sapiens; identical to SEQ ID NO: 5944

SEQ ID NO: 5996 - DNA, 171 bp, Homo sapiens
tgaggcaagaagtcctgccacactgcagttggcacttctgcaagctggaacatccccatgaagtatgggcrgcaaggaggacttgatctgggagcttctcaaccaggcccaggaacattttggcaaagacaaatcaaaagaattccaactattcagctctcctcatgggaa

SEQ ID NO: 5997 - DNA, 201 bp, Homo sapiens; identical to SEQ ID NO: 5960

SEQ ID NO: 5998 - DNA, 201 bp, Homo sapiens; identical to SEQ ID NO: 5951

SEQ ID NO: 5999 - DNA, 201 bp, Homo sapiens; identical to SEQ ID NO: 5963

SEQ ID NO: 6000 - DNA, 201 bp, Homo sapiens; identical to SEQ ID NO: 5950

SEQ ID NO: 6001 - DNA, 201 bp, Homo sapiens
ttggcacttctgcaagctggaacatccccatgaagtatgggcggcaaggaggacttgatctgggagcttctcaaccaggcccaggaacattttggcaaagrcaaatcaaaagaattccaactattcagctctcctcatgggaaggacctgctgtttaaggactctgcccacgggtttttaaaagtcccccccaggatggat

SEQ ID NO: 6002 - DNA, 201 bp, Homo sapiens; identical to SEQ ID NO: 5948

SEQ ID NO: 6003 - DNA, 201 bp, Homo sapiens; identical to SEQ ID NO: 5969

SEQ ID NO: 6004 - DNA, 201 bp, Homo sapiens
cacagcggctacagcagctacagcctcagccgcgcgccggacggcgccgccctggccaccgcgcgcgcctcgccccggcaggaaaaggatgcgcctccacktagcaaggctgggcaggatgtggttctgcatctgcccacagacggggtggttctagacggccgcgagagcacagatgaccacgccatcgtccagtatgag

SEQ ID NO: 6005 - DNA, 109 bp, Homo sapiens
ggggcgggrctcaccaaggctccaccccgccgcggccactgttcgcacacacctggtgctgatcaacgccgaggccgactcgtcgccacccagcgcgccgcaggccggg

SEQ ID NO: 6006 - DNA, 201 bp, Homo sapiens
cgcctcgccccggcaggaaaaggatgcgcctccacttagcaaggctgggcaggatgtggttctgcatctgcccacagacggggtggttctagacggccgcsagagcacagatgaccacgccatcgtccagtatgagtgggcactgctgcagggggacccgtcagtggacatgaaggtgcctcaatcaggaaccctgaagct

SEQ ID NO: 6007 - DNA, 124 bp, Homo sapiens
ggggcggggctcaccaaggctccwccccgccgcggccactgttcgcacacacctggtgctgatcaacgccgaggccgactcgtcgccacccagcgcgccgcaggccggggcggagaggcgcagg

SEQ ID NO: 6008 - DNA, 201 bp, Homo sapiens
catttgctgcatctgttccaagagggaagctaaggagtttagtgaaaccagttgaactcgtggaagcagagagtggaatggcggttactggaggctgtgcrggggacggactgggaaaggagagacgctggtcaaagggtacaaagtgtcactgagaccggaggaacaggttctggtgatctgttgcacagcatggtgact

SEQ ID NO: 6009 - DNA, 201 bp, Homo sapiens
ggttattgctgaatgagagagtctttgctaaaaacacaataacaaaagcaggctctcttctgttttgggcttagccgatgctactgggttggggtggaggragcactccaggggatgagaagagatgctcccgcttctcttgactcgacttcatcaaagacaattgcttggctattctgggagaggactttgtttacagat

SEQ ID NO: 6010 - DNA, 201 bp, Homo sapiens; identical to SEQ ID NO: 6004

SEQ ID NO: 6011 - DNA, 109 bp, Homo sapiens; identical to SEQ ID NO: 6005

SEQ ID NO: 6012 - DNA, 201 bp, Homo sapiens; identical to SEQ ID NO: 6006

SEQ ID NO: 6013 - DNA, 124 bp, Homo sapiens; identical to SEQ ID NO: 6007

SEQ ID NO: 6014 - DNA, 201 bp, Homo sapiens
gatggtcatgcagtgagataggaaatcaagatggaagcagagaatctggcatgccaaaaactaacagaaacttagttgaaggcaaagagagcaaggagaamgtttaatacttcattacatcaaatcaacactgctccatggtgagagcacagcaactcatttatatatatatatataggctttgttgatgaaaaacgacaa

SEQ ID NO: 6015 - DNA, 201 bp, Homo sapiens
atctattaagttctggatatttacagcttcttttgtttttaattgggccagaagattctgcaaatcccaaatctttctttattatttattgtaaaaaaagkttccttagaagtcataaaatattttgaaatttagagaggaattcatgattaaagattcctaaaaatataattctgatttatgtaagctgtccctgaaaat

SEQ ID NO: 6016 - DNA, 201 bp, Homo sapiens
cctgcgcctctccgccccggcctgcggcgcgctgggtggcgacgagtcggcctcggcgttgatcagcaccaggtgtgtgcgaacagtggccgcggcggggwggagccttggatgaaccgttgtccacattctgttttctgagtcaaagaggaggaagatctgtccatcgaaactgagctgccaagatccactgccgtgtcc

SEQ ID NO: 6017 - DNA, 201 bp, Homo sapiens
aggggagatcccacagctgcagcacggggacaggccgcttccccacatccgctcatgccactgtaagcagccctagctcttgggtccaggacctcaccagstcctcgtcagactcctgtgctcttccaggggctgctcagccccacctgaagagcccagagaggctgtcttcctacccagcaggtctcatgcaggcccagg

SEQ ID NO: 6018 - DNA, 201 bp, Homo sapiens
cagtgtaaatgaccatgtataaactgtaaagtgcaatagaaaactgtgtgtgtgaggaaagtaaggcctagagggggtgatgtgtggcacatgacaggggwgatcccacagctgcagcacggggacaggccgcttccccacatccgctcatgccactgtaagcagccctagctcttgggtccaggacctcaccaggtcctc

SEQ ID NO: 6019 - DNA, 201 bp, Homo sapiens
caaggtggacagtgaggccgctgctcctccagctgcctctgtctcatcacaggccagaagtggaaagggtttcaaatccaagcccccgggttcctgtgtgygttctacgcagcaaggcttcaaagtttcaaactggtttggaactcaaccaggtcctccaaaggaaaccaaggcaggcacaggatgggggcaggctggctt

SEQ ID NO: 6020 - DNA, 201 bp, Homo sapiens
accctctactccccggctgccacccacactggacagagaccaccactacctgggtcttgacgcaggtggcaccacttcttgcccaaatgccgtggcctggscccaggccccccaagcactgggtccccggcatgtggacaaggccactcaccacatctgtggctggctggaggctgccctgggcccttcctgtgaccctca

SEQ ID NO: 6021 - DNA, 201 bp, Homo sapiens
ctggcgccgtttagagctgggagcccgtggactcccggcctgtttctaccttctattcaaccactctgacgtggggagacaagaagaaatagaactttttkatagtgtggtaaaaacattgatttgaactattttagtaaaaggagtaacaaacaagattgtgatagtgtctactttgagctagataaataaaggcctctt

SEQ ID NO: 6022 - DNA, 201 bp, Homo sapiens
gccgccctgtccctctccctagctggcggctctattctgagcagttcttgctgcccgtttgctctcaggggaaaggctcacgccccccatcttagccccargggggtaagtgggtgctggtgatgggatggtgtggcgctcctgccgtgggtgttgccaggaggctctttgggaaggagtgtcgcccggtcaggtggtgcg

SEQ ID NO: 6023 - DNA, 201 bp, Homo sapiens
ttcagtgtaaatgaccatgtataaactgtaaagtgcaatagaaaactgtgtgtgtgaggaaagtaaggcctagagggggtgatgtgtggcacatgacaggwgagatcccacagctgcagcacggggacaggccgcttccccacatccgctcatgccactgtaagcagccctagctcttgggtccaggacctcaccaggtcc

SEQ ID NO: 6024 - DNA, 201 bp, Homo sapiens
tcagtgtaaatgaccatgtataaactgtaaagtgcaatagaaaactgtgtgtgtgaggaaagtaaggcctagagggggtgatgtgtggcacatgacagggdagatcccacagctgcagcacggggacaggccgcttccccacatccgctcatgccactgtaagcagccctagctcttgggtccaggacctcaccaggtcct

SEQ ID NO: 6025 - DNA, 201 bp, Homo sapiens
attgagtttccaggaaaaataggcactgatttctagaaggaaattaactccttaccgaagctatttattgagccaatatggctggttaacgtcctcactaktataaagtaacccagtgcaggactctcagacattagctgaaccaagtgtacacagtcagactgcaagggcactgatgaggctactctgaaagctggttgt

SEQ ID NO: 6026 - DNA, 201 bp, Homo sapiens
ctgctcagccccacctgaagagcccagagaggctgtcttcctacccagcaggtctcatgcaggcccagggctggggatgcaggcaagaggagggagatggycgccctgtccctctccctagctggcggctctattctgagcagttcttgctgcccgtttgctctcaggggaaaggctcacgccccccatcttagccccagg

SEQ ID NO: 6027 - DNA, 201 bp, Homo sapiens
ggctgcaggctgcttctgagatccagcctgggaactgtccaggctcctctgtcctgcctgggatggaggggccactcatcaaaccctctactccccggctrccacccacactggacagagaccaccactacctgggtcttgacgcaggtggcaccacttcttgcccaaatgccgtggcctgggcccaggccccccaagcac

SEQ ID NO: 6028 - DNA, 201 bp, Homo sapiens
tctgtggacgtggactggccctgctgggggtccccagggggagtttcaggccccagacacgggcaggacctccagcccagcccctgtcttcttcctctgtrgtgaactgtacataggacgctgcccgccctggcccagctgccatgggtccgatgcactggcccaagccgccatctcccgcctcatacaccagcaacctgg

SEQ ID NO: 6029 - DNA, 201 bp, Homo sapiens
catcttagccccaggggggtaagtgggtgctggtgatgggatggtgtggcgctcctgccgtgggtgttgccaggaggctctttgggaaggagtgtcgcccrgtcaggtggtgcgctcccggtcactaggggtgtacacgtgaagttgggtgaacacctgctgctcatggtacccagtgattcttgcccgagtgggcagctg

SEQ ID NO: 6030 - DNA, 201 bp, Homo sapiens
agccagcagcagcgacgccatgtacctgagtacaggtggcagttgcagagccgtgggctgtagaaggtcagatggggcttcccacaggggaaatctgggcrtgctgtagctcagggtgactcccagctccgtcactagcagggcgacccccttccttctggagccttagctctgaaagcccccagtgggggtgccctttca

SEQ ID NO: 6031 - DNA, 201 bp, Homo sapiens; identical to SEQ ID NO: 6017

SEQ ID NO: 6032 - DNA, 201 bp, Homo sapiens; identical to SEQ ID NO: 6018

SEQ ID NO: 6033 - DNA, 201 bp, Homo sapiens; identical to SEQ ID NO: 6019

SEQ ID NO: 6034 - DNA, 201 bp, Homo sapiens; identical to SEQ ID NO: 6020

SEQ ID NO: 6035 - DNA, 201 bp, Homo sapiens; identical to SEQ ID NO: 6021

SEQ ID NO: 6036 - DNA, 201 bp, Homo sapiens; identical to SEQ ID NO: 6022

SEQ ID NO: 6037 - DNA, 201 bp, Homo sapiens; identical to SEQ ID NO: 6023

SEQ ID NO: 6038 - DNA, 201 bp, Homo sapiens; identical to SEQ ID NO: 6024

SEQ ID NO: 6039 - DNA, 201 bp, Homo sapiens; identical to SEQ ID NO: 6025

SEQ ID NO: 6040 - DNA, 201 bp, Homo sapiens; identical to SEQ ID NO: 6026

SEQ ID NO: 6041 - DNA, 201 bp, Homo sapiens; identical to SEQ ID NO: 6027

SEQ ID NO: 6042 - DNA, 201 bp, Homo sapiens; identical to SEQ ID NO: 6028

SEQ ID NO: 6043 - DNA, 201 bp, Homo sapiens; identical to SEQ ID NO: 6029

SEQ ID NO: 6044 - DNA, 201 bp, Homo sapiens; identical to SEQ ID NO: 6030

SEQ ID NO: 6045 - DNA, 201 bp, Homo sapiens
tccgatcccatgagctcaatgcattttcattcttgccgaaatagtagcagctttgaggacagcagctgacagcattcggcgtatacctaaggagagttttytccccgaactgacagcaacgattccaaccacggcaagctggcttccaactataacattttactctcaaaggtctccttaaattgggcttgtttttacttg

SEQ ID NO: 6046 - DNA, 201 bp, Homo sapiens
gtggcagattttggagaatcaagatttctacagtctctggatgaagacaacatgacaaaacaacctgggaacctccgttggatggctcctgaggtgttcaygcagtgcactcggtacaccatcaaagcagatgtcttcagctatgctctgtgtctgtgggaaattctcactggcgaaattccattcgctcatctcaagcca

SEQ ID NO: 6047 - DNA, 135 bp, Homo sapiens
acttgaacttggaatcttataacttgaagaactgycctggagaaaggaagaaacttataataaatgggaaattataaatctagaccaacccaaacttgtactgatgaatggaagaaaaaagtcagtgaatcatat

SEQ ID NO: 6048 - DNA, 201 bp, Homo sapiens
ccgatcccatgagctcaatgcattttcattcttgccgaaatagtagcagctttgaggacagcagctgacagcattcggcgtatacctaaggagagtttttyccccgaactgacagcaacgattccaaccacggcaagctggcttccaactataacattttactctcaaaggtctccttaaattgggcttgtttttacttgt

SEQ ID NO: 6049 - DNA, 201 bp, Homo sapiens
ctgtgtctgtgggaaattctcactggcgaaattccattcgctcatctcaagccagcggctgcggcagcagacatggcttaccaccacatcagacctcccaytggctattccattcccaagcccatatcatctctgctgatacgagggtggaacgcatgtcctgaaggaagacccgaattttctgaagttgtcatgaagtta

SEQ ID NO: 6050 - DNA, 201 bp, Homo sapiens
attcaaccatggactttataagccagtgttgcctaagtattaaaacattggattatcctgaggtgtaccaggaaaggattttataatgcttagaaaaaaaraaaaaaaaaaaacaaaaaatacctttgatgcattgaatgttctttcatagctgtcgttgttgaatataatatacatagatagcgatgtgcagggattttt

SEQ ID NO: 6051 - DNA, 201 bp, Homo sapiens
agaagcccagcggtgctacggaaccgattactgtgaagtttgccaacaaccccagccagaagtccagccaggccctgctctcccagctctaccagtccccyaaccggcgctacccaggtccacttcaccaccaggctcagaggttcaggctggacaatttgcttaatatggcctatggcgtaaagaggttctccccaatta

SEQ ID NO: 6052 - DNA, 201 bp, Homo sapiens; identical to SEQ ID NO: 6050

SEQ ID NO: 6053 - DNA, 201 bp, Homo sapiens; identical to SEQ ID NO: 6051

SEQ ID NO: 6054 - DNA, 201 bp, Homo sapiens; identical to SEQ ID NO: 6050

SEQ ID NO: 6055 - DNA, 201 bp, Homo sapiens
agaagcccagcggtgctacggaaccgattactgtgaagtttgccaacaaccccagccagaagtccagccaggccctgctctcccagctctaccagtccccyaaccggcgctacccaggtccacttcaccaccaggctcagaggttcaggctggacaatttgcttaatatggcctatggcgtaaagagactgatgtctggac

SEQ ID NO: 6056 - DNA, 201 bp, Homo sapiens
acttcaccaccaggctcagaggttcaggctggacaatttgcttaatatggcctatggcgtaaagagactgatgtctggaccagtccccccttctgcttgtycccccaggttctccccaattaccattgatggaatgacaagccttgtgggaatgaacatccctggtcacacaggaactgggtggtgcatctttgtctacaa

SEQ ID NO: 6057 - DNA, 201 bp, Homo sapiens; identical to SEQ ID NO: 6050

SEQ ID NO: 6058 - DNA, 201 bp, Homo sapiens; identical to SEQ ID NO: 6051

SEQ ID NO: 6059 - DNA, 201 bp, Homo sapiens; identical to SEQ ID NO: 6050

SEQ ID NO: 6060 - DNA, 201 bp, Homo sapiens; identical to SEQ ID NO: 6055

SEQ ID NO: 6061 - DNA, 201 bp, Homo sapiens; identical to SEQ ID NO: 6056

SEQ ID NO: 6062 - DNA, 201 bp, Homo sapiens
agaagcccagcggtgctacggaaccgattactgtgaagtttgccaacaaccccagccagaagtccagccaggccctgctctcccagctctaccagtccccyaaccggcgctacccaggtccacttcaccaccaggctcagaggttcaggttctccccaattaccattgatggaatgacaagccttgtgggaatgaacatcc

SEQ ID NO: 6063 - DNA, 201 bp, Homo sapiens; identical to SEQ ID NO: 6050

SEQ ID NO: 6064 - DNA, 201 bp, Homo sapiens; identical to SEQ ID NO: 6055

SEQ ID NO: 6065 - DNA, 201 bp, Homo sapiens; identical to SEQ ID NO: 6056

SEQ ID NO: 6066 - DNA, 201 bp, Homo sapiens
tgaagggctgtgtctatggacaggaggcagtgcgtctctccgtgggccccatggcccgggacgtggagagcctggcactgtgcctgcgagccctgctgtgygaggacatgttccgcttggaccccactgtgcctcccttgcccttcagagaagaggtctacaccagctctcagcccctgcgtgtggggtactatgagactg

SEQ ID NO: 6067 - DNA, 201 bp, Homo sapiens
cgtgctcttcacctatgtgggaaaggcctgggaagtgaacaaagggaccaactgtgtgacctcctatctggctgactgtgagactcagctgtctcaggccmcaaggcagggcctgctctatggcgtccctgtgagcctcaaggagtgcttcacctacaagggccaggactccacgctgggcttgagcctgaatgaaggggt

SEQ ID NO: 6068 - DNA, 201 bp, Homo sapiens
agctgcagggtgccgtgcccttcgtgcacaccaatgttccacagtccatgttcagctatgactgcagtaaccccctctttggccagaccgtgaacccatgraagtcctccaaaagcccagggggctcctcagggggtgaaggggccctcatcgggtctggaggctcccccctgggcttaggcactgatatcggaggcagca

SEQ ID NO: 6069 - DNA, 201 bp, Homo sapiens
gcgaccaccctgtccatactgccggcccaaaccctggcaaaaggctgccacagagcccaaattccctgctgttcgactggctttgcagaattttgacatgrcttacagtgtgcagtttggagatctttggccatcaatccgtgtcagtctcctctcagagcagaagtatggtgcactggtcaataactttgctgcctggga

SEQ ID NO: 6070 - DNA, 201 bp, Homo sapiens
caaagtgctgggattacaggcgtgagccaccacgcccggccaggtcccgaaacttaagcttcatttgtttcactgcaaatctgcttctgcctacaagcctrgtctcattttcctctacctaaggatcttcctccatgcaatttcggcctaggaggcccttcccgccccttttcgcctagctaactctttcggtactcaacc

SEQ ID NO: 6071 - DNA, 201 bp, Homo sapiens
aggaggcccttcccgccccttttcgcctagctaactctttcggtactcaaccaccaactcctaatcctccctggtcccccaagtgggctaggggcttcttkggagtccctcgcactgctctaagcatccaggcagagtcattattccgggtgccaggttgctctttttccagcagccttcaggggactcctggctgggcgg

SEQ ID NO: 6072 - DNA, 201 bp, Homo sapiens
ccaaggattttgtgaatgaagccatctcccactgggaactgcagtctgagggtggccaatctgcagccccatcccctgcctcctgggcctgcagtccgaamcttcgatgcttcacttttgacagaggggatatcagtcgcttccctcctgccagacctggcagcctgggtgtcatggagtactacctgatggatgctgcct

SEQ ID NO: 6073 - DNA, 201 bp, Homo sapiens
atacagcatccaggtacaggtggaagatctgactcacttccgaagggttttcatggacacattttgtttcttctcatcctgtcaggttggggagctggtartaccaaacctcatggccaattttggccccatgtacttctgcaaaatgcgtaggctgacatagtatcacccaatccctgaagcaagaatacaaagggtata

SEQ ID NO: 6074 - DNA, 201 bp, Homo sapiens
tgactcacttccgaagggttttcatggacacattttgtttcttctcatcctgtcaggttggggagctggtaataccaaacctcatggccaattttggcccyatgtacttctgcaaaatgcgtaggctgacatagtatcacccaatccctgaagcaagaatacaaagggtatactctgttggatgcaccagaaactggaaac

SEQ ID NO: 6075 - DNA, 201 bp, Homo sapiens
ctgttcgtgtctttctgcagttttcggcaataagaagtagaagatttgctgtcctgctgtccaattgtggagcatcagcaggtttccaactcactcattamcccctaccccatctccaggcctgtactaaagtttgctgcccgcttaggggcttagaaggagaagccagtgagcaggctcacactaagttgtaaacatagg

SEQ ID NO: 6076 - DNA, 201 bp, Homo sapiens
agatttgctgtcctgctgtccaattgtggagcatcagcaggtttccaactcactcattaacccctaccccatctccaggcctgtactaaagtttgctgccygcttaggggcttagaaggagaagccagtgagcaggctcacactaagttgtaaacataggagaagcatttggccaataaagttgttgaaactctatagacc

SEQ ID NO: 6077 - DNA, 201 bp, Homo sapiens
gtgtcagtctcctctcagagcagaagtatggtgcactggtcaataactttgctgcctgggatcatgtaagtgctaagctggagcagctgagtgccaaggaytttgtgaatgaagccatctcccactgggaactgcagtctgagggtggccaatctgcagccccatcccctgcctcctgggcctgcagtccgaaccttcgat

SEQ ID NO: 6078 - DNA, 201 bp, Homo sapiens
cttaggggcttagaaggagaagccagtgagcaggctcacactaagttgtaaacataggagaagcatttggccaataaagttgttgaaactctatagacctrgggctgcagttggggacttcatgtcagtgcaaatgccattagttccatttgtaccagccagttactgagcccctgtcacccttgaagtgagttccacctg

SEQ ID NO: 6079 - DNA, 201 bp, Homo sapiens; identical to SEQ ID NO: 6066

SEQ ID NO: 6080 - DNA, 201 bp, Homo sapiens; identical to SEQ ID NO: 6067

SEQ ID NO: 6081 - DNA, 201 bp, Homo sapiens; identical to SEQ ID NO: 6068

SEQ ID NO: 6082 - DNA, 201 bp, Homo sapiens; identical to SEQ ID NO: 6071

SEQ ID NO: 6083 - DNA, 201 bp, Homo sapiens; identical to SEQ ID NO: 6069

SEQ ID NO: 6084 - DNA, 201 bp, Homo sapiens; identical to SEQ ID NO: 6072

SEQ ID NO: 6085 - DNA, 201 bp, Homo sapiens; identical to SEQ ID NO: 6070

SEQ ID NO: 6086 - DNA, 201 bp, Homo sapiens; identical to SEQ ID NO: 6067

SEQ ID NO: 6087 - DNA, 201 bp, Homo sapiens
gagtgcgacagcgtagtggtgcatgtgctgaagctgcagggtgccgtgcccttcgtgcacaccaatgttccacagtccatgttcagaccgtgaacccatgraagtcctccaaaagcccagggggctcctcagggggtgaaggggccctcatcgggtctggaggctcccccctgggcttaggcactgatatcggaggcagca

SEQ ID NO: 6088 - DNA, 201 bp, Homo sapiens; identical to SEQ ID NO: 6077

SEQ ID NO: 6089 - DNA, 201 bp, Homo sapiens
cctcgcgacggtcccgcggagacatcgatataagaagaaatgggctgccacagagcccaaattccctgctgttcgactggctttgcagaattttgacatgrcttacagtgtgcagtttggagatctttggccatcaatccgtgtcagtctcctctcagagcagaagtatggtgcactggtcaataactttgctgcctggga

SEQ ID NO: 6090 - DNA, 115 bp, Homo sapiens
ctgcctacaagcctrgtctcattttcctctacctaaggatcttcctccatgcaatttcggcctaggaggcccttcccgccccttttcgcctagctaactctttcggtactcaacc

SEQ ID NO: 6091 - DNA, 201 bp, Homo sapiens; identical to SEQ ID NO: 6071

SEQ ID NO: 6092 - DNA, 201 bp, Homo sapiens; identical to SEQ ID NO: 6072

SEQ ID NO: 6093 - DNA, 201 bp, Homo sapiens; identical to SEQ ID NO: 6073

SEQ ID NO: 6094 - DNA, 201 bp, Homo sapiens; identical to SEQ ID NO: 6074

SEQ ID NO: 6095 - DNA, 201 bp, Homo sapiens; identical to SEQ ID NO: 6075

SEQ ID NO: 6096 - DNA, 201 bp, Homo sapiens; identical to SEQ ID NO: 6076

SEQ ID NO: 6097 - DNA, 201 bp, Homo sapiens; identical to SEQ ID NO: 6077

SEQ ID NO: 6098 - DNA, 201 bp, Homo sapiens; identical to SEQ ID NO: 6078

SEQ ID NO: 6099 - DNA, 138 bp, Homo sapiens
ggacctcgctgtccctccagctgggcacattgagcctggagatcccttgccagggtgccagcccgaggggaggctgggttgagtatctgtggcctacccctgatctgagcttgttgtgaggtaggaggtgggcaggag

SEQ ID NO: 6100 - DNA, 201 bp, Homo sapiens; identical to SEQ ID NO: 6066

SEQ ID NO: 6101 - DNA, 201 bp, Homo sapiens
caaggccagcccctccctgggaaaggcctgggaagtgaacaaagggaccaactgtgtgacctcctatctggctgactgtgagactcagctgtctcaggccmcaaggcagggcctgctctatggcgtccctgtgagcctcaaggagtgcttcacctacaagggccaggactccacgctgggcttgagcctgaatgaaggggt

SEQ ID NO: 6102 - DNA, 201 bp, Homo sapiens; identical to SEQ ID NO: 6068

SEQ ID NO: 6103 - DNA, 171 bp, Homo sapiens
tgaatccaacaaaggcctgagcactctgggcagggacctcgctgtccctccagctgggcacattgagcctggagatcccttgccagggtgccagcccgagkggaggctgggttgagtatctgtggcctacccctgatctgagcttgttgtgaggtaggaggtgggcaggag

SEQ ID NO: 6104 - DNA, 201 bp, Homo sapiens; identical to SEQ ID NO: 6071

SEQ ID NO: 6105 - DNA, 201 bp, Homo sapiens; identical to SEQ ID NO: 6070

SEQ ID NO: 6106 - DNA, 201 bp, Homo sapiens; identical to SEQ ID NO: 6066

SEQ ID NO: 6107 - DNA, 201 bp, Homo sapiens; identical to SEQ ID NO: 6101

SEQ ID NO: 6108 - DNA, 201 bp, Homo sapiens; identical to SEQ ID NO: 6068

SEQ ID NO: 6109 - DNA, 201 bp, Homo sapiens; identical to SEQ ID NO: 6066

SEQ ID NO: 6110 - DNA, 201 bp, Homo sapiens; identical to SEQ ID NO: 6067

SEQ ID NO: 6111 - DNA, 201 bp, Homo sapiens; identical to SEQ ID NO: 6068

SEQ ID NO: 6112 - DNA, 201 bp, Homo sapiens
aacattcggtattttattctactagacagtttacctctggatacactacttgtggatgttgaacctaaggtgaaatctaagaaaagggaagctgttgcagraagaggcagaggcagaggaagaggaagaggacgtggccgtggcagaggaagagggggtcctaggcgataatgtctctcaggattactgtttcaaagtcat

SEQ ID NO: 6113 - DNA, 201 bp, Homo sapiens
gagtcacagacctcagcctgggccaaatgagcattttagggagaaggacaatcccttatagcttagccctaggggagctctgggcagggttttacacattstttctgaaagtaaggtcatttggggacagggctgagagcagtttcttggctacacagatgggtctgtcagggttgaagccacatgggtgcctgctcatgt

SEQ ID NO: 6114 - DNA, 158 bp, Homo sapiens
acgccgctgggccggccctggcagctctgcagctgctgggcctggggcctatcaggcagcgtgtgtgtaggccaggtgggcagcgggacaccagagcctgkactggggccagggctcaggccactgtcctcctcctcctcctccttctcctagggtgg

SEQ ID NO: 6115 - DNA, 201 bp, Homo sapiens
cgtgggcgcatgcgtggcgcttgtctcggtgcgcgtctactacaagcagtgccgcgccaccgtgcggggcctggccacgttcccagccaccgcagccgagrgcgccttctccacactggtggaagtggccggaacgtgcgtggcgcactcggaaggggagcctggcagccccccacgcatgcactgcggcgccgacggcga

SEQ ID NO: 6116 - DNA, 110 bp, Homo sapiens
tggactccttgcacaaagcctctgtcccgctcacggctctgcagttggcctcgccgctgatttctcagggaaaaagaggtggaaagtcccttaatctcttmccttccctt

SEQ ID NO: 6117 - DNA, 201 bp, Homo sapiens
ctgaggccgacctgggccgtgggcgtccccgcctaggcggcagccggccccgcaaaatcgacacgatcgcggcggacgagagcttcacgcagggcgacctsggtgagcgcaagatgaagctgaacacagaggtgcgcgagatcggaccgctcagccggcggggtttccacctggcctttcaggacgtgggcgcatgcgtgg

SEQ ID NO: 6118 - DNA, 201 bp, Homo sapiens
gtgtgcgagagggactgaggatgcaggcgtccccttactactgggccagaggggaggcgcgcggttctgttgcgtctgcgggaagcacctgtgtgctcgcytttctcctggactccttgcacaaagcctctgtcccgctcacggctctgcagttggcctcgccgctgatttctcagggaaaaagaggtggaaagtccctta

SEQ ID NO: 6119 - DNA, 201 bp, Homo sapiens
ggtttccacctggcctttcaggacgtgggcgcatgcgtggcgcttgtctcggtgcgcgtctactacaagcagtgccgcgccaccgtgcggggcctggccamgttcccagccaccgcagccgagagcgccttctccacactggtggaagtggccggaacgtgcgtggcgcactcggaaggggagcctggcagccccccacgc

SEQ ID NO: 6120 - DNA, 201 bp, Homo sapiens
aactgaggccgacctgggccgtgggcgtccccgcctaggcggcagccggccccgcaaaatcgacacgatcgcggcggacgagagcttcacgcagggcgacmtgggtgagcgcaagatgaagctgaacacagaggtgcgcgagatcggaccgctcagccggcggggtttccacctggcctttcaggacgtgggcgcatgcgt

SEQ ID NO: 6121 - DNA, 201 bp, Homo sapiens
gcctggcagccccccacgcatgcactgcggcgccgacggcgagtggctggtgcctgtgggccgctgcagctgcagcgcgggattccaggagcgtggtgacwtctgcgaagggttttacaaggtgtccccgcggcggcccctctgctcaccgtgcccagagcacagccgggccctggaaaacgcctccaccttctgcgtgtg

SEQ ID NO: 6122 - DNA, 201 bp, Homo sapiens
gccccaagacagctcatggcagaggcctcaagaggcctggcaagaaagggtcaaataagagacctggaaaacgaacaagagagaagatgaagaacagaacmcactaaatagcatctttgaatacaaagaaccaagaaaaaggaatgaagactcgcaatttcacgacacactttgatcccttctgttggtgtcatgttgtaa

SEQ ID NO: 6123 - DNA, 201 bp, Homo sapiens
cccaagacagctcatggcagaggcctcaagaggcctggcaagaaagggtcaaataagagacctggaaaacgaacaagagagaagatgaagaacagaacacmctaaatagcatctttgaatacaaagaaccaagaaaaaggaatgaagactcgcaatttcacgacacactttgatcccttctgttggtgtcatgttgtaaac

SEQ ID NO: 6124 - DNA, 201 bp, Homo sapiens
atgaagactcgcaatttcacgacacactttgatcccttctgttggtgtcatgttgtaaacatttctttcaataaactaaagaaaaattattaaaggaacamatacctttggttaaatagtctagactaaaagattgagaagttactttccattgctatctattgataatttagacattgagttcaaattgccttcatttta

SEQ ID NO: 6125 - DNA, 201 bp, Homo sapiens
gacacactttgatcccttctgttggtgtcatgttgtaaacatttctttcaataaactaaagaaaaattattaaaggaacacatacctttggttaaatagtytagactaaaagattgagaagttactttccattgctatctattgataatttagacattgagttcaaattgccttcattttatgataaataatgatttaact

SEQ ID NO: 6126 - DNA, 201 bp, Homo sapiens
tgtccctcccctttcccctccccttgtccctcccctccccttcccctcccccggggtcctcctccgcgccaccccacccccgcggctcctttttctgcctyttcctttgtaccctcactgctaccagctccttctggcgacccccaggtaccccctcccacctttcgtttctctctgggtcagcagaccacgcatgtatcc

SEQ ID NO: 6127 - DNA, 201 bp, Homo sapiens
ggtgtatgtgtatagatacatacacacacacagctccgaccccgcccccggcccggactcgccctccccgccctttgctcctccccttgtctctccccttkctcctccccttgtccctcccctttcccctccccttgtccctcccctccccttcccctcccccggggtcctcctccgcgccaccccacccccgcggctcct

SEQ ID NO: 6128 - DNA, 201 bp, Homo sapiens
agtagctgtgagttgctggcgctggagcgattcggtggcacgtggagccacggcgtgggagtagggggctgaaggcaggcagcagcggccagggccgcccyctgctagccgcttgggtctcgggataccccgtttcttcctgtaggtgtgggacgtgcgtgcggcgagatggacactcccccgctctcggattcggagtcg

SEQ ID NO: 6129 - DNA, 201 bp, Homo sapiens
agcggttcctatagcaacgacaaaccggaagtatggtttgccgccggaagcggaagtcccaatcaaaagttgagcagtagctgtgagttgctggcgctggrgcgattcggtggcacgtggagccacggcgtgggagtagggggctgaaggcaggcagcagcggccagggccgccctctgctagccgcttgggtctcgggat

SEQ ID NO: 6130 - DNA, 201 bp, Homo sapiens
cccggcccggactcgccctccccgccctttgctcctccccttgtctctcccctttctcctccccttgtccctcccctttcccctccccttgtccctccccyccccttcccctcccccggggtcctcctccgcgccaccccacccccgcggctcctttttctgccttttcctttgtaccctcactgctaccagctccttctg

SEQ ID NO: 6131 - DNA, 201 bp, Homo sapiens
tgtatgtgtatagatacatacacacacacagctccgaccccgcccccggcccggactcgccctccccgccctttgctcctccccttgtctctcccctttcycctccccttgtccctcccctttcccctccccttgtccctcccctccccttcccctcccccggggtcctcctccgcgccaccccacccccgcggctccttt

SEQ ID NO: 6132 - DNA, 201 bp, Homo sapiens
atacatacacacacacagctccgaccccgcccccggcccggactcgccctccccgccctttgctcctccccttgtctctcccctttctcctccccttgtcyctcccctttcccctccccttgtccctcccctccccttcccctcccccggggtcctcctccgcgccaccccacccccgcggctcctttttctgccttttcc

SEQ ID NO: 6133 - DNA, 201 bp, Homo sapiens
cacacacagctccgaccccgcccccggcccggactcgccctccccgccctttgctcctccccttgtctctcccctttctcctccccttgtccctccccttkcccctccccttgtccctcccctccccttcccctcccccggggtcctcctccgcgccaccccacccccgcggctcctttttctgccttttcctttgtaccc

SEQ ID NO: 6134 - DNA, 201 bp, Homo sapiens
gtgtgtatatatggtgtgtattttatacgtatatatgtatatggtgtatgtgtatagatacatacacacacacagctccgaccccgcccccggcccggacwcgccctccccgccctttgctcctccccttgtctctcccctttctcctccccttgtccctcccctttcccctccccttgtccctcccctccccttcccctc

SEQ ID NO: 6135 - DNA, 201 bp, Homo sapiens
gaccccgcccccggcccggactcgccctccccgccctttgctcctccccttgtctctcccctttctcctccccttgtccctcccctttcccctccccttgyccctcccctccccttcccctcccccggggtcctcctccgcgccaccccacccccgcggctcctttttctgccttttcctttgtaccctcactgctaccag

SEQ ID NO: 6136 - DNA, 201 bp, Homo sapiens
ccaggcctcaatgtcgtgctagaggggccgaagaaggccccaagacagctcatggcagaggcctcaagaggcctggcaagaaagggtcaaataagagacckggaaaacgaacaagagagaagatgaagaacagaacacactaaatagcatctttgaatacaaagaaccaagaaaaaggaatgaagactcgcaatttcacga

SEQ ID NO: 6137 - DNA, 201 bp, Homo sapiens; identical to SEQ ID NO: 6125

SEQ ID NO: 6138 - DNA, 201 bp, Homo sapiens
atccagaagacgacttccagcgagagatgagtttctatcgccaagcccaggccgcagtgcttgcagtcttaccccgcctccatcagctcaaagtccctacsaagcgacccactgattattttgcggaaatggccaaatctgatctgcagatgcagaagattcgacagaagctgcagactaaacaggctgccatggagaggt

SEQ ID NO: 6139 - DNA, 201 bp, Homo sapiens
agtgatttcctgaaggaaatataatgatctgttcatcgaagtagaagatattgttggccacgtgggatcgaagaccaaaaacatgcagcgtctgagctacmacggctgacatgatctcccgccaaacagttctgctgaagaccaagaccacgcatgtatccagaggcgctacctgtagggatcctaagcaacccggacact

SEQ ID NO: 6140 - DNA, 201 bp, Homo sapiens
atctgttcatcgaagtagaagatattgttggccacgtgggatcgaagaccaaaaacatgcagcgtctgagctaccacggctgacatgatctcccgccaaasagttctgctgaagaccaagaccacgcatgtatccagaggcgctacctgtagggatcctaagcaacccggacactttcaaacgccgtagcggttcctatag

SEQ ID NO: 6141 - DNA, 201 bp, Homo sapiens
ctcccgagtagctgggactacagtgatttcctgaaggaaatataatgatctgttcatcgaagtagaagatattgttggccacgtgggatcgaagaccaaawacatgcagcgtctgagctaccacggctgacatgatctcccgccaaacagttctgctgaagaccaagaccacgcatgtatccagaggcgctacctgtaggg

SEQ ID NO: 6142 - DNA, 201 bp, Homo sapiens
caggagaaagcccatatgatgaatgctattaagaaatatcagaaaggcttctctgataaactggatttccttgagggagatcagaaacctctggcacagcrcaagaaggcaggagccaaaggccagcagatgaggaaggggcccagtgctaaacgacggtataaaaaccagaagtttggttttggtggaaagaagaaaggc

SEQ ID NO: 6143 - DNA, 201 bp, Homo sapiens
gggccaagacagctcatggcagaggcctcaagaggcctggcaagaaagggtcaaataagagacctggaaaacgaacaagagagaagatgaagaacagaacmcactaaatagcatctttgaatacaaagaaccaagaaaaaggaatgaagactcgcaatttcacgacacactttgatcccttctgttggtgtcatgttgtaa

SEQ ID NO: 6144 - DNA, 201 bp, Homo sapiens
gccaagacagctcatggcagaggcctcaagaggcctggcaagaaagggtcaaataagagacctggaaaacgaacaagagagaagatgaagaacagaacacmctaaatagcatctttgaatacaaagaaccaagaaaaaggaatgaagactcgcaatttcacgacacactttgatcccttctgttggtgtcatgttgtaaac

SEQ ID NO: 6145 - DNA, 201 bp, Homo sapiens
acactcgggagagctatgatgatgtatctagcttccgggccaagacagctcatggcagaggcctcaagaggcctggcaagaaagggtcaaataagagacckggaaaacgaacaagagagaagatgaagaacagaacacactaaatagcatctttgaatacaaagaaccaagaaaaaggaatgaagactcgcaatttcacga

SEQ ID NO: 6146 - DNA, 201 bp, Homo sapiens; identical to SEQ ID NO: 6124

SEQ ID NO: 6147 - DNA, 201 bp, Homo sapiens
tctgcactcagaataagcctaggagtagagagagcggcttcttttgactaagaatagctaggagattcttcctgtttgagagaagagctctttggtccacrgtcacgatccaaaatccactttatgggctaatttgaaatattcatgttaaaactttttgtgcatgcttcagttattaggaaaacaaacaaacaaacattg

SEQ ID NO: 6148 - DNA, 201 bp, Homo sapiens; identical to SEQ ID NO: 6127

SEQ ID NO: 6149 - DNA, 201 bp, Homo sapiens; identical to SEQ ID NO: 6126

SEQ ID NO: 6150 - DNA, 201 bp, Homo sapiens; identical to SEQ ID NO: 6128

SEQ ID NO: 6151 - DNA, 201 bp, Homo sapiens; identical to SEQ ID NO: 6131

SEQ ID NO: 6152 - DNA, 201 bp, Homo sapiens; identical to SEQ ID NO: 6132

SEQ ID NO: 6153 - DNA, 201 bp, Homo sapiens; identical to SEQ ID NO: 6130

SEQ ID NO: 6154 - DNA, 201 bp, Homo sapiens; identical to SEQ ID NO: 6129

SEQ ID NO: 6155 - DNA, 201 bp, Homo sapiens; identical to SEQ ID NO: 6133

SEQ ID NO: 6156 - DNA, 201 bp, Homo sapiens; identical to SEQ ID NO: 6134

SEQ ID NO: 6157 - DNA, 201 bp, Homo sapiens; identical to SEQ ID NO: 6135

SEQ ID NO: 6158 - DNA, 201 bp, Homo sapiens; identical to SEQ ID NO: 6138

SEQ ID NO: 6159 - DNA, 201 bp, Homo sapiens; identical to SEQ ID NO: 6128

SEQ ID NO: 6160 - DNA, 201 bp, Homo sapiens; identical to SEQ ID NO: 6126

SEQ ID NO: 6161 - DNA, 169 bp, Homo sapiens
gctccgaccccgcccccggcccggactcgccctccccgccctttgctcctccccttgtctctccccttkctcctccccttgtccctcccctttcccctccccttgtccctcccctccccttcccctcccccggggtcctcctccgcgccaccccacccccgcggctcct

SEQ ID NO: 6162 - DNA, 201 bp, Homo sapiens; identical to SEQ ID NO: 6129

SEQ ID NO: 6163 - DNA, 201 bp, Homo sapiens; identical to SEQ ID NO: 6130

SEQ ID NO: 6164 - DNA, 184 bp, Homo sapiens
gctccgaccccgcccccggcccggactcgccctccccgccctttgctcctccccttgtctctcccctttctcctccccttgtcyctcccctttcccctccccttgtccctcccctccccttcccctcccccggggtcctcctccgcgccaccccacccccgcggctcctttttctgccttttcc

SEQ ID NO: 6165 - DNA, 171 bp, Homo sapiens
gctccgaccccgcccccggcccggactcgccctccccgccctttgctcctccccttgtctctcccctttcycctccccttgtccctcccctttcccctccccttgtccctcccctccccttcccctcccccggggtcctcctccgcgccaccccacccccgcggctccttt

SEQ ID NO: 6166 - DNA, 193 bp, Homo sapiens
gctccgaccccgcccccggcccggactcgccctccccgccctttgctcctccccttgtctctcccctttctcctccccttgtccctccccttkcccctccccttgtccctcccctccccttcccctcccccggggtcctcctccgcgccaccccacccccgcggctcctttttctgccttttcctttgtaccc

SEQ ID NO: 6167 - DNA, 127 bp, Homo sapiens
gctccgaccccgcccccggcccggacwcgccctccccgccctttgctcctccccttgtctctcccctttctcctccccttgtccctcccctttcccctccccttgtccctcccctccccttcccctc

SEQ ID NO: 6168 - DNA, 201 bp, Homo sapiens; identical to SEQ ID NO: 6135

SEQ ID NO: 6169 - DNA, 201 bp, Homo sapiens; identical to SEQ ID NO: 6145

SEQ ID NO: 6170 - DNA, 201 bp, Homo sapiens; identical to SEQ ID NO: 6143

SEQ ID NO: 6171 - DNA, 201 bp, Homo sapiens; identical to SEQ ID NO: 6144

SEQ ID NO: 6172 - DNA, 201 bp, Homo sapiens; identical to SEQ ID NO: 6124

SEQ ID NO: 6173 - DNA, 201 bp, Homo sapiens; identical to SEQ ID NO: 6125

SEQ ID NO: 6174 - DNA, 201 bp, Homo sapiens; identical to SEQ ID NO: 6142

SEQ ID NO: 6175 - DNA, 201 bp, Homo sapiens; identical to SEQ ID NO: 6138

SEQ ID NO: 6176 - DNA, 201 bp, Homo sapiens; identical to SEQ ID NO: 6128

SEQ ID NO: 6177 - DNA, 201 bp, Homo sapiens; identical to SEQ ID NO: 6126

SEQ ID NO: 6178 - DNA, 201 bp, Homo sapiens; identical to SEQ ID NO: 6127

SEQ ID NO: 6179 - DNA, 201 bp, Homo sapiens; identical to SEQ ID NO: 6129

SEQ ID NO: 6180 - DNA, 201 bp, Homo sapiens; identical to SEQ ID NO: 6130

SEQ ID NO: 6181 - DNA, 201 bp, Homo sapiens; identical to SEQ ID NO: 6132

SEQ ID NO: 6182 - DNA, 201 bp, Homo sapiens; identical to SEQ ID NO: 6131

SEQ ID NO: 6183 - DNA, 201 bp, Homo sapiens; identical to SEQ ID NO: 6133

SEQ ID NO: 6184 - DNA, 201 bp, Homo sapiens; identical to SEQ ID NO: 6134

SEQ ID NO: 6185 - DNA, 201 bp, Homo sapiens; identical to SEQ ID NO: 6135

SEQ ID NO: 6186 - DNA, 201 bp, Homo sapiens; identical to SEQ ID NO: 6145

SEQ ID NO: 6187 - DNA, 201 bp, Homo sapiens; identical to SEQ ID NO: 6143

SEQ ID NO: 6188 - DNA, 201 bp, Homo sapiens; identical to SEQ ID NO: 6144

SEQ ID NO: 6189 - DNA, 201 bp, Homo sapiens; identical to SEQ ID NO: 6124

SEQ ID NO: 6190 - DNA, 201 bp, Homo sapiens; identical to SEQ ID NO: 6125

SEQ ID NO: 6191 - DNA, 201 bp, Homo sapiens; identical to SEQ ID NO: 6142

SEQ ID NO: 6192 - DNA, 201 bp, Homo sapiens
tggcaggcggcgcaccaggctgcccaggataacgagaactcagcgcccatcttgaacatgtcttcatcttctggaagctctggagtgcacacctcttggasccaaggcctaccaaccattcagcactttcctcacagcgcagagatgctggggtcccctttggtgtctgttgaggcgccggggcagaatgtgaatgaaggg

SEQ ID NO: 6193 - DNA, 201 bp, Homo sapiens
agatgacgattttcagtgggccccaactaatgcccgtaggagagcccaatattccaagggtagccaggcccttcggtgggaatctaaggatgccccccaargggctgccagtctcggcttccactggaatcccaataatgtcccacactgggaaccctccagtgccttaccctggcctctcgacagtaccttctgacgaaa

SEQ ID NO: 6194 - DNA, 201 bp, Homo sapiens
tctccccctcagcaagagatgacgattttcagtgggccccaactaatgcccgtaggagagcccaatattccaagggtagccaggcccttcggtgggaatcraaggatgccccccaatgggctgccagtctcggcttccactggaatcccaataatgtcccacactgggaaccctccagtgccttaccctggcctctcgaca

SEQ ID NO: 6195 - DNA, 201 bp, Homo sapiens
ctggaagctctggagtgcacacctcttggaaccaaggcctaccaaccattcagcactttcctcacagcgcagagatgctggggtcccctttggtgtctgtkgaggcgccggggcagaatgtgaatgaaggggggccacagttcagtatgccactgcctgagcgtggtatgagctactgcccccaagcgactctcactcctt

SEQ ID NO: 6196 - DNA, 201 bp, Homo sapiens
cacccagtcttcatgtacggccgaccgcaggctgagatggaacaggaggctggggagctgagccggtggcaggcggcgcaccaggctgcccaggataacgwgaactcagcgcccatcttgaacatgtcttcatcttctggaagctctggagtgcacacctcttggaaccaaggcctaccaaccattcagcactttcctcac

SEQ ID NO: 6197 - DNA, 201 bp, Homo sapiens
ctccagagtcaaatcttgtctactggctgtgggaaaaacagaaagtaatggccattgttagaatcgacactcagaacaaccctgtctaccaggtgagcttyagtccacaggataacactcaggtgtgtgtcactggaaatgggatgtttaagcttctccgttttgctgagggaaccctgaagcaaaccagctttcagaggg

SEQ ID NO: 6198 - DNA, 201 bp, Homo sapiens
tgacagagatcagcaagggggagcctgctcactttgagtatttgatgtatccattgcactcagcacccatcaccggtctagctacctgcatccgcaaaccycttatagccacctgttctctggatcgatccatccgcctttggaattatgaaacaaacaccctggaactatttaaggaataccaagaagaggcatattcca

SEQ ID NO: 6199 - DNA, 201 bp, Homo sapiens
cactcaggtgtgtgtcactggaaatgggatgtttaagcttctccgttttgctgagggaaccctgaagcaaaccagctttcagaggggagaaccccaaaacratctagctcacacctgggtggctgatgacaagattgtcgttggcactgacacaggcaaactcttcctctttgaatctggagatcagcgttgggagaccag

SEQ ID NO: 6200 - DNA, 112 bp, Homo sapiens
ggaaccgctackgcgtttgaaagtgtccgggttgcttaggatccctacaggtagcgcctctggatacatgcgtggtctgctgacccagagagaaacgaaagcagaactgttt

SEQ ID NO: 6201 - DNA, 133 bp, Homo sapiens
ggaaccgctacggcgtttgaaagtgtccgggtwgcttaggatccctacaggtagcgcctctggatacatgcgtggtctgctgacccagagagaaacgaaagcagaactgtttggcgggagatcatgtcagccg

SEQ ID NO: 6202 - DNA, 201 bp, Homo sapiens
ctggtggcacagatggtgctgtgtatgaatggaatctgtccacaggaaagagagagacagaatgcgtgctcaagtcttgcagctacaactgtgttactgtrtcccccgatgccaaaattatctttgctgttggatcagaccacaccctcaaggagattgcagattccttgatccttcgagagatatcggcgtttgatgtca

SEQ ID NO: 6203 - DNA, 201 bp, Homo sapiens
atggtggcggccagtagccatagccagatgtccatgccccaggtgtttgccattgcagcctattcaaagggatttgcctgttctgctgggccagggagagstctgctgtttgagaagatggaagaaaaggatttttaccgtgagagcagagaaatcaggattcctgtggacccgcagagcaatgatccaagtcagtctgac

SEQ ID NO: 6204 - DNA, 201 bp, Homo sapiens
gaaatttattagcatggctttttctccagactccaaatacctattggctcagacgtcacctccagagtcaaatcttgtctactggctgtgggaaaaacagkaagtaatggccattgttagaatcgacactcagaacaaccctgtctaccaggtgagcttcagtccacaggataacactcaggtgtgtgtcactggaaatgg

SEQ ID NO: 6205 - DNA, 201 bp, Homo sapiens
ccaagagtgcggagccaccccgttcaccactactcaagagggtgcagtcggctgagaaactggcagcagcacttgccgcctctgagaagaagctagccacytctcgcaagcacagccttgacctgccccactctgaactaaagaaggaactgccgcccagggaagtgagccctctggaggtagttggagccaggagtgtgc

SEQ ID NO: 6206 - DNA, 201 bp, Homo sapiens
gcacaggagctgagcttggcacctcacccagaagtgagccagagtgtggcccctaaaggagcaggagagagtggggaagaggatcctttcccgtccagagrccctaggagcctgggcccaatggtcccaagcctattgacagggatcacactggggcctcccagaatggaaagtcccagtggtccccacaggaggctcggg

SEQ ID NO: 6207 - DNA, 201 bp, Homo sapiens
attcagatggcctggcagggctcaaaggccgagaccggagctgggtgattggctcccctgagatattacggaagcggctgtcggtgtctgagtcatcccayacagagagtgactcaagccctccaatgacagtgcgacgccgctgctcaggcctcctggatgcgcctcggttcccggagggccctgaggaggccagcagca

SEQ ID NO: 6208 - DNA, 201 bp, Homo sapiens
tacacaactatggcatcgtgcaccgtgacctcaagcctgacaacctcctaattacatccatggggcacatcaagctcacggactttggactgtccaaaatkggcctcatgagtctgacaacgaacttgtatgagggtcatattgaaaaggatgcccgggaattcctggacaagcaggtatgcgggaccccagaatacattg

SEQ ID NO: 6209 - DNA, 201 bp, Homo sapiens
agtcccagtggtccccacaggaggctcgggagcccacaagccattgaggaggctgccagctcctcctcagcaggccccaacctaggtcagtctggagccayagaccccatccctcctgaaggttgctggaaggcccagcacctccacacccaggcactaacagcactttctcccagcacttcgggactcacccccaccagc

SEQ ID NO: 6210 - DNA, 201 bp, Homo sapiens
cctttccccccgatctcccactcaaggctaccgggtgacccccgatgctgtgcattcagtgggagggaattcatcacagagcagctcccccagctccagcrtgcccagttccccagccggctctgggcacacacggcccagctccctccacggtctggcacccaagctccaacgccagtaccgctctccacggcgcaagtc

SEQ ID NO: 6211 - DNA, 201 bp, Homo sapiens
tctgaactaaagaaggaactgccgcccagggaagtgagccctctggaggtagttggagccaggagtgtgctgtctggcaagggggccctgccagggaaggsggtgctgcagcctgctccctcacgggccctaggcaccctccggcaggaccgagccgaacgacgggagtcgctgcagaagcaagaagccattcgtgaggtg

SEQ ID NO: 6212 - DNA, 201 bp, Homo sapiens
attcagtgggagggaattcatcacagagcagctcccccagctccagcgtgcccagttccccagccggctctgggcacacacggcccagctccctccacggkctggcacccaagctccaacgccagtaccgctctccacggcgcaagtcagcaggcagcatcccactgtcaccactggcccacaccccttctcccccacccc

SEQ ID NO: 6213 - DNA, 201 bp, Homo sapiens
gtgaaagaggatccagccctgagcatcacccaagtgcctgatgcctcaggtgacagaaggcaggacgttccatgccgaggctgccccctcacccagaagtytgagcccagcctcaggaggggccaagaaccagggggccatcaaaagcatcgggatttggcattggttccagatgagcttttaaagcaaacatagcagttg

SEQ ID NO: 6214 - DNA, 201 bp, Homo sapiens
cctgtgcatggcctggtgcacacggaggtggtggagctgatcctgaagagtggaaacaaggtggccatttcaacaactcccctggagaacacatccattaragtggggccagctcggaagggcagctacaaggccaagatggcccgaaggagcaagaggagccgcggcaaggatgggcaagaaagcagaaaaaggagctcc

SEQ ID NO: 6215 - DNA, 201 bp, Homo sapiens
aggatggaggtccggccagtgaggcagggcttcgtcaaggtgacctcatcacccatgtcaatggggaacctgtgcatggcctggtgcacacggaggtggtrgagctgatcctgaagagtggaaacaaggtggccatttcaacaactcccctggagaacacatccattaaagtggggccagctcggaagggcagctacaagg

SEQ ID NO: 6216 - DNA, 201 bp, Homo sapiens
ccttgacctgccccactctgaactaaagaaggaactgccgcccagggaagtgagccctctggaggtagttggagccaggagtgtgctgtctggcaaggggrccctgccagggaagggggtgctgcagcctgctccctcacgggccctaggcaccctccggcaggaccgagccgaacgacgggagtcgctgcagaagcaaga

SEQ ID NO: 6217 - DNA, 201 bp, Homo sapiens
ccatccctcctgaaggttgctggaaggcccagcacctccacacccaggcactaacagcactttctcccagcacttcgggactcacccccaccagcagttgytctcctcccagctccacctctgggaagctgagcatgtggtcctggaaatcccttattgagggcccagacagggcatccccaagcagaaaggcaaccatgg

SEQ ID NO: 6218 - DNA, 201 bp, Homo sapiens
aggaccattcagatggcctggcagggctcaaaggccgagaccggagctgggtgattggctcccctgagatattacggaagcggctgtcggtgtctgagtcrtcccacacagagagtgactcaagccctccaatgacagtgcgacgccgctgctcaggcctcctggatgcgcctcggttcccggagggccctgaggaggcca

SEQ ID NO: 6219 - DNA, 201 bp, Homo sapiens
acacattaagtgacggggagcctctggagtgtgagcccaacttccagtggagccgggccctgcccagttgtgaagctctctgtggtggcttcattcaaggytccagtgggaccatcttgtcgccagggttccctgacttctaccccaacaacttgaactgcacctggattatcgaaacatctcatggcaagggtgtgttct

SEQ ID NO: 6220 - DNA, 201 bp, Homo sapiens
gttatactgtgggagcagtggtgcggtacagctgcatcggcaagcgtactctggtgggaaacagcacccgcatgtgtgggctggatggacactggactggstccctccctcactgctcaggaaccagcgtgggagtttgcggtgaccctgggatcccggctcatggcatccgtttgggggacagctttgatccaggcactg

SEQ ID NO: 6221 - DNA, 201 bp, Homo sapiens
agggtaaccagtttaacctcaacgatgtggtcaagtttgtttgcaaccctgggtatatggctgagggggctgctaggtcccaatgcctggccagcgggcartggagtgacatgctgcccacctgcagaatcatcaactgtacagatcctggacaccaagaaaatagtgttcgtcaggtccacgccagcggcccgcacaggt

SEQ ID NO: 6222 - DNA, 201 bp, Homo sapiens
ccagttcctgaacttctccaccgagcccaaccacgactacatagaaatccggaatggcccctatgagaccagccgcatgatgggaagattcagtggaagcragcttccaagctccctcctctccacgtcccacgagaccaccgtgtatttccacagcgaccactcccagaatcggccaggattcaagctggagtatcaggc

SEQ ID NO: 6223 - DNA, 201 bp, Homo sapiens
gcagggtccttgagagaacaggggagcaagcctgccccagtacccaaaaaacaatggctatcatgtactggggttattctctgtgcctgacactttacctrtagtatttctagtctgcacaataacaccaaaatgtaggatttgttattcccctttgacagatgagaaaacagaagcctgcaaaggtaaagacagagttag

SEQ ID NO: 6224 - DNA, 201 bp, Homo sapiens
tacgcgatgggcggacttactcagcgcccttgatcggggtttaccacgggacccaggttccccagttcctcatcagcaccagcaactacctctacctcctyttctctaccgacaagagtcactcggacatcggcttccagctccgctatgagactataacactgcagtcagaccactgtctggatccaggaatcccagtaa

SEQ ID NO: 6225 - DNA, 201 bp, Homo sapiens
aagcagggctttgccattcaattttcagtgtccacagcaacgtcctgcaatgaccctgggatcccgcagaatgggagtcggagtggtgacagttgggaagscggcgactccacagtgttccagtgtgaccctggctacgcgctgcagggaagtgcagagatcagctgtgtgaagatcgagaacaggttcttctggcagccc

SEQ ID NO: 6226 - DNA, 201 bp, Homo sapiens
tactactatactggccaaagggtcatccgctgtcaggccaatggcaaatggagcctcggggactctacgcccacctgccgaatcatctcctgtggagagckcccgattccccccaatggccaccgcatcggaacactgtctgtctacggggcaacagccatcttctcctgcaattccggatacacactggtgggctccagg

SEQ ID NO: 6227 - DNA, 201 bp, Homo sapiens
gcctcttcctcgccttccgcagcgatgcatctgtgagcaatgctggcttcgtcattgactatacagaaaacccgcgggagtcatgttttgatcctggttcyatcaagaacggcacacgggtggggtccgacctgaagctgggctcctccgtcacctactactgccacgggggctacgaagttgagggcacctcgaccctga

SEQ ID NO: 6228 - DNA, 201 bp, Homo sapiens
atatctacgacggacgggactctctcagccctctcataggaagcttctatggctcccagctcccaggccgcattgaaagcagcagcaacagcctcttcctygccttccgcagcgatgcatctgtgagcaatgctggcttcgtcattgactatacagaaaacccgcgggagtcatgttttgatcctggttccatcaagaacg

SEQ ID NO: 6229 - DNA, 201 bp, Homo sapiens
aggattcaacatcaccttctcagagtacgacttggagccctgtgaggagcccgaggtcccagcctacagcatccggaagggcttgcagtttggcgtgggcracaccttgaccttctcctgcttccccgggtaccgtctggagggcaccgcccgcatcacgtgcctggggggcagacggcgcctgtggagctcgcctctgcc

SEQ ID NO: 6230 - DNA, 201 bp, Homo sapiens
cgaagccatccctctctgtcaagctctttcctgtgggcttcctgaggcccccaagaatggaatggtgtttggcaaggagtacacagtgggaaccaaggccrtgtacagctgcagtgaaggctaccacctccaggcaggcgctgaggccactgcagagtgtctggacacaggcctatggagcaaccgcaatgtcccaccaca

SEQ ID NO: 6231 - DNA, 201 bp, Homo sapiens
ctgggatcccggctcatggcatccgtttgggggacagctttgatccaggcactgtgatgcgcttcagctgtgaagctggccacgtgctccggggatcgtcmgagcgcacctgtcaagccaatggctcgtggagcggctcgcagcctgagtgtggagtgatctcttgtgggaaccctgggactccaagtaatgcccgagttg

SEQ ID NO: 6232 - DNA, 201 bp, Homo sapiens
ctggcatacccgaaaggggcaaaagactaggctcggatttcaggttaggatccagcgtccagttcacctgcaacgagggctatgacctgcaagggtccaarcggatcacctgtatgaaagtgagcgacatgtttgcggcctggagcgaccacaggccagtctgccgagcccgcatgtgtgatgcccaccttcgaggcccct

SEQ ID NO: 6233 - DNA, 201 bp, Homo sapiens
tcaggttaggatccagcgtccagttcacctgcaacgagggctatgacctgcaagggtccaagcggatcacctgtatgaaagtgagcgacatgtttgcggcytggagcgaccacaggccagtctgccgagcccgcatgtgtgatgcccaccttcgaggcccctcgggcatcatcacctcccccaatttccccattcagtatg

SEQ ID NO: 6234 - DNA, 201 bp, Homo sapiens
tcagaatgcaaacccagatcagtctgccccaaagtccactacaccagctgccagaaaccctgttctagaaggggcagctaagaagggaggagccgatgaawctctacagtagcactgtggccaggtctggaaagccaggcaagacacctgtgtgtcctatctgggttctgctgtctccgcgtaggcagcttcggggcaagg

SEQ ID NO: 6235 - DNA, 201 bp, Homo sapiens
ctgtgcgcatctgccagcaggatcatcactggtcgggcaagacccctttctgtgtgccaattacctgtggacacccaggcaaccctgtcaacggcctcacycagggtaaccagtttaacctcaacgatgtggtcaagtttgtttgcaaccctgggtatatggctgagggggctgctaggtcccaatgcctggccagcgggc

SEQ ID NO: 6236 - DNA, 201 bp, Homo sapiens
tgtaccagattacagggcctgtggagatctttatgaataagttcaaagatgatcactgggctttagatggccatgtctcgtcagagtcctccggagccacyttcatctaccaaggctctgtcaagggccaaggctttgggcagttcggctttcaaagactggacctcaggctgctggagtcagaccccgagtccattggcc

SEQ ID NO: 6237 - DNA, 201 bp, Homo sapiens
ctatggaagagaccataaaggcttcaaaactagaagtgcgcatgaaggatgcttcatgccctgttccccacacagagaagagatgaagagggggaggtacrgtcagctttcaaaacaatatgccccccgcccatcccatgtgtgaggacatggtgactcggtgactgtaacagtaggacacatcccatcatgcggtcagag

SEQ ID NO: 6238 - DNA, 201 bp, Homo sapiens
tgccttgctggacactgtgggactcctgagcccattgtcaacggacacatcaatggggagaactacagctaccggggcagtgtggtgtaccaatgcaatgstggcttccgcctgatcggcatgtctgtgcgcatctgccagcaggatcatcactggtcgggcaagacccctttctgtgtgccaattacctgtggacaccca

SEQ ID NO: 6239 - DNA, 201 bp, Homo sapiens
caaagggtcatccgctgtcaggccaatggcaaatggagcctcggggactctacgcccacctgccgaatcatctcctgtggagagctcccgattccccccartggccaccgcatcggaacactgtctgtctacggggcaacagccatcttctcctgcaattccggatacacactggtgggctccagggtgcgtgagtgcatg

SEQ ID NO: 6240 - DNA, 201 bp, Homo sapiens
ctactactatactggccaaagggtcatccgctgtcaggccaatggcaaatggagcctcggggactctacgcccacctgccgaatcatctcctgtggagagstcccgattccccccaatggccaccgcatcggaacactgtctgtctacggggcaacagccatcttctcctgcaattccggatacacactggtgggctccag

SEQ ID NO: 6241 - DNA, 201 bp, Homo sapiens
ctctggagtgtgagcccaacttccagtggagccgggccctgcccagttgtgaagctctctgtggtggcttcattcaaggctccagtgggaccatcttgtcrccagggttccctgacttctaccccaacaacttgaactgcacctggattatcgaaacatctcatggcaagggtgtgttcttcactttccacaccttccacc

SEQ ID NO: 6242 - DNA, 201 bp, Homo sapiens
gtggaggcaacctcacagagcgcaggggcaccatcctgtcccctggcttcccagagccgtacctcaacagcctcaactgtgtgtggaagatcgtggtcccygaaggcgctggcatccagatccaagttgtcagttttgtgacagagcagaactgggactcgctggaagtatttgatggtgcagataacactgtaaccatgc

SEQ ID NO: 6243 - DNA, 201 bp, Homo sapiens
aggctacctgcttcagggctccaccaccaggacctgcctcccaaacctgacctggagtggaaccccacctgactgtgtcccccaccactgcaggcagccakagacgccaacgcatgccaacgtcggggccctggatttgccctccatgggctacacgctcatctactcctgccaggagggcttctccctcaagggtggctc

SEQ ID NO: 6244 - DNA, 201 bp, Homo sapiens
agttccctgggattcaaggcttcttatgaagagatcgagcagggcagttgcggtgaccctggcatacctgcatatggccggagggaaggctcccggtttcrccacggtgacacactcaagtttgagtgccagcccgcctttgagctggtgggacagaaggcaatcacatgccaaaagaataaccaatggtcggctaagaag

SEQ ID NO: 6245 - DNA, 201 bp, Homo sapiens
tgccacgggggctacgaagttgagggcacctcgaccctgagctgcatcctggggcctgatgggaagcccgtgtggaacaatccccggccagtctgcacagkcccctgtgggggacagtatgtgggttcggacggagtggtcttgtcccccaactacccccagaactacaccagtggacagatctgcttgtattttgttact

SEQ ID NO: 6246 - DNA, 201 bp, Homo sapiens
caggcactcagggtactttgctgtcccccaactttcctgtgaactacaataacaatcatgaatgcatctactccatccagacccagccagggaagggaatycagctgaaagccagggcattcgaactctccgaaggagatgtcctcaaggtttatgatggcaacaacaactccgcccgtttgctgggagtttttagccatt

SEQ ID NO: 6247 - DNA, 201 bp, Homo sapiens
ggctctgtcaagggccaaggctttgggcagttcggctttcaaagactggacctcaggctgctggagtcagaccccgagtccattggccgccactttgcttycaacagcagctcagtggcagccgcgatcctggtgcctttcatcgccctcattattgcgggcttcgtgctctatctctacaagcacaggagaagacccaaa

SEQ ID NO: 6248 - DNA, 201 bp, Homo sapiens
ttcctcgaaccagcgccacgcagtgcagctctgtgccggaaccccgctatggcaagaggctgggcagtgacttctcggtgggggccatcgtccgcttcgawtgcaactccggctatgccctgcaggggtcgccagagatcgagtgcctccctgtgcctggggccttggcccaatggaatgtctcagcgcccacgtgtgtgg

SEQ ID NO: 6249 - DNA, 201 bp, Homo sapiens
cccaggttccccagttcctcatcagcaccagcaactacctctacctcctcttctctaccgacaagagtcactcggacatcggcttccagctccgctatgasactataacactgcagtcagaccactgtctggatccaggaatcccagtaaatggacagcgtcatgggaatgacttctacgtgggcgcgctggtgaccttca

SEQ ID NO: 6250 - DNA, 201 bp, Homo sapiens
ctccgctcatccccaatgggaaggtggtggggtctgacttcatgtggggctcaagtgtgacttatgcctgcctggaggggtaccagctctccctgcccgcrgtgttcacctgtgagggaaatgggtcctggaccggagagctgcctcagtgtttccctgtgttctgcggggatcctggtgtcccgtcccgtgggaggagag

SEQ ID NO: 6251 - DNA, 201 bp, Homo sapiens
ggacagcgacacctggttcttaagcaaattctagattggaacaattagaagatctgactgatgttaagagtggccagaggaaagtgagaggcgtccatttycagcagacacaatggaggctgacagaggcaggagcctacccctggccacaccacctctgggacacggcacccccctgggcctggagggagagggccaatc

SEQ ID NO: 6252 - DNA, 201 bp, Homo sapiens
gagtcagaccccgagtccattggccgccactttgcttccaacagcagctcagtggcagccgcgatcctggtgcctttcatcgccctcattattgcgggctycgtgctctatctctacaagcacaggagaagacccaaagttcctttcaatggctatgctggccacgagaacaccaatgttcgggccacatttgagaaccca

SEQ ID NO: 6253 - DNA, 201 bp, Homo sapiens
agccggggaggatagggcaggagtctggccaggagcccaaggtcaagtctggctgtcaactgacaaagagaagagaagacaagtctgtggcccagacaggrtgccaagtctgggggcagcagcagggtccttgagagaacaggggagcaagcctgccccagtacccaaaaaacaatggctatcatgtactggggttattct

SEQ ID NO: 6254 - DNA, 201 bp, Homo sapiens
tctcggtgggggccatcgtccgcttcgaatgcaactccggctatgccctgcaggggtcgccagagatcgagtgcctccctgtgcctggggccttggcccartggaatgtctcagcgcccacgtgtgtggtgccgtgtggaggcaacctcacagagcgcaggggcaccatcctgtcccctggcttcccagagccgtacctca

SEQ ID NO: 6255 - DNA, 201 bp, Homo sapiens; identical to SEQ ID NO: 6242

SEQ ID NO: 6256 - DNA, 201 bp, Homo sapiens; identical to SEQ ID NO: 6254

SEQ ID NO: 6257 - DNA, 201 bp, Homo sapiens; identical to SEQ ID NO: 6222

SEQ ID NO: 6258 - DNA, 201 bp, Homo sapiens; identical to SEQ ID NO: 6248

SEQ ID NO: 6259 - DNA, 201 bp, Homo sapiens
aagaaaatgtgacttcaaaggaaaagaacaaatttccaaagacttgggggagtgaaggcagagcctggtgcagatggacgaggtctgcagacggagggcaraggtggtggaaggggccaggggcctgcaggcctccccctggaactgggactggtctcggtctgctgacgtcagggtcagctcccccgcggagctgacttc

SEQ ID NO: 6260 - DNA, 201 bp, Homo sapiens
ccagcctctgtgttgaggttgccgggggtaggggtggggccacacaaatctccaggagccaccactcaacacaatggccctgcctcccaccgctttatttytttcggtttcggatgcaaaacaaaaaattttaaaagaaaatgtgacttcaaaggaaaagaacaaatttccaaagacttgggggagtgaaggcagagcctg

SEQ ID NO: 6261 - DNA, 201 bp, Homo sapiens
tctacgtggccagcttccccgtggctctgccactgcagccaccaaccctgcgggccccggagcgagaactcggcacaggagagcagcccttgtcccccacracggccacgtccccctatggagggggccacgcccttgccggtcaaacttcacccaagcaggagaatgggaccttggctctacttccaggggcccccgacc

SEQ ID NO: 6262 - DNA, 201 bp, Homo sapiens
gaatgggaccttggctctacttccaggggcccccgacccttcccagcctctgtgttgaggttgccgggggtaggggtggggccacacaaatctccaggagycaccactcaacacaatggccctgcctcccaccgctttatttctttcggtttcggatgcaaaacaaaaaattttaaaagaaaatgtgacttcaaaggaaaa

SEQ ID NO: 6263 - DNA, 201 bp, Homo sapiens
tgggaccttggctctacttccaggggcccccgacccttcccagcctctgtgttgaggttgccgggggtaggggtggggccacacaaatctccaggagccaycactcaacacaatggccctgcctcccaccgctttatttctttcggtttcggatgcaaaacaaaaaattttaaaagaaaatgtgacttcaaaggaaaagaa

SEQ ID NO: 6264 - DNA, 201 bp, Homo sapiens
gggacgtgaacatctctttccgagaggcgtcctgcagccaggacggcaaccttcccaccctcatatccagcgtccaccgcagccgccacctcgttatgccsgagcatcagagccgctgtgaattccagagaggcagcctggagattggcctgcgacccgccggtgacctgttgggcaagaggctgggccgctccccccgta

SEQ ID NO: 6265 - DNA, 201 bp, Homo sapiens
ccaccactcaacacaatggccctgcctcccaccgctttatttctttcggtttcggatgcaaaacaaaaaattttaaaagaaaatgtgacttcaaaggaaargaacaaatttccaaagacttgggggagtgaaggcagagcctggtgcagatggacgaggtctgcagacggagggcagaggtggtggaaggggccaggggcc

SEQ ID NO: 6266 - DNA, 201 bp, Homo sapiens
gtttcggatgcaaaacaaaaaattttaaaagaaaatgtgacttcaaaggaaaagaacaaatttccaaagacttgggggagtgaaggcagagcctggtgcaratggacgaggtctgcagacggagggcagaggtggtggaaggggccaggggcctgcaggcctccccctggaactgggactggtctcggtctgctgacgtca

SEQ ID NO: 6267 - DNA, 201 bp, Homo sapiens
cacaatggccctgcctcccaccgctttatttctttcggtttcggatgcaaaacaaaaaattttaaaagaaaatgtgacttcaaaggaaaagaacaaatttycaaagacttgggggagtgaaggcagagcctggtgcagatggacgaggtctgcagacggagggcagaggtggtggaaggggccaggggcctgcaggcctcc

SEQ ID NO: 6268 - DNA, 201 bp, Homo sapiens
tcctcgtcctgcagagtgctccggtgttccaggtggagccccaggacatgacagtgagatctggggatgacgtggccctgcggtgccaggccactggagarcccacacccaccattgaatggctacaggcgggtcaacccttgcgggccagccggcggctccggaccctgcccgatgggagcctgtggctggagaacgtgg

SEQ ID NO: 6269 - DNA, 201 bp, Homo sapiens
cccaggacatgacagtgagatctggggatgacgtggccctgcggtgccaggccactggagagcccacacccaccattgaatggctacaggcgggtcaaccyttgcgggccagccggcggctccggaccctgcccgatgggagcctgtggctggagaacgtggagactggggatgcaggcacctacgactgcgtcgctcaca

SEQ ID NO: 6270 - DNA, 201 bp, Homo sapiens
cagcttcgtccacgtgaaggaggctcctgtcctacaaggggaggctttctcctacctggtggaacctgtaggaggcagcattcagctagactgtgtggtgygtggagacccagtgccggacatccactggatcaaagatggccttccactgcggggcagccacctccggcaccagctgcagaatggctcgctgaccatcca

SEQ ID NO: 6271 - DNA, 201 bp, Homo sapiens
tcctcacatgtcacagcacgggtataccagctccgaccgtgtcctggagcaaggcaggcgcccagctaggagctcgggggagtggctatcgtgtctcaccrtcgggcgccctggagatcgggcaggccctccccatccacgcaggccgctacacctgctcagcccgcaactctgccggcgtagcccacaagcacgtcttcc

SEQ ID NO: 6272 - DNA, 201 bp, Homo sapiens
gaggcagcacgctgcagcgggccgctgtctccagagaagacagcgggacctatgtctgctgggcggagaacagagtgggccgcacgcaggcggtcagcttygtccacgtgaaggaggctcctgtcctacaaggggaggctttctcctacctggtggaacctgtaggaggcagcattcagctagactgtgtggtgcgtggag

SEQ ID NO: 6273 - DNA, 201 bp, Homo sapiens
ctggtactgcctgtgttcaccaccctgcctggggaccgcagcctgcgccttggggacaggctgtggcttcgctgtgcagcccggggcagccccacccctcrcattggctggactgtcaacgaccggccagtcacagaaggggtgtctgagcaggatggaggcagcacgctgcagcgggccgctgtctccagagaagacagc

SEQ ID NO: 6274 - DNA, 201 bp, Homo sapiens
cagagacagtgagccaggtggctgggagccccctggtcctgacctgtgatgtgtccggggtccctgcacccacggtcacttggctgaaggacaggatgccygtggagagcagcgcggtgcacggtgtggtctcccgggggggccgcctccagctgagccgcctgcaaccggcccaggcgggcacctacacgtgcgtggctg

SEQ ID NO: 6275 - DNA, 201 bp, Homo sapiens
atgctggaaagatagcaactgaagctttggagaatatacgtactatagtgtcattaacaagggaaaaagccttcgagcaaatgtatgaagagatgcttcakactcaacacagaaatacctcgaagaaagcacagattattggaagctgttatgcattcagccatgcctttatatattttgcctatgcggcagggtttcgat

SEQ ID NO: 6276 - DNA, 201 bp, Homo sapiens
gcacagctttctggcggccagaaacaaagactagctattgcaagggctcttctccaaaaacccaaaattttattgttggatgaggccacttcagccctcgrtaatgacagtgagaaggtggttcagcatgcccttgataaagccaggacgggaaggacatgcctagtggtcactcacaggctctctgcaattcagaacgca

SEQ ID NO: 6277 - DNA, 201 bp, Homo sapiens
ttcccaaatagcaatcgttcctcaagagcctgtgctcttcaactgcagcattgctgagaacatcgcctatggtgacaacagccgtgtggtgccattagatragatcaaagaagccgcaaatgcagcaaatatccattcttttattgaaggtctccctgagaaatacaacacacaagttggactgaaaggagcacagctttc

SEQ ID NO: 6278 - DNA, 201 bp, Homo sapiens
gttcaacttctgcagagactttatgaccccgtgcaaggacaagtgctgtttgatggtgtggatgcaaaagaattgaatgtacagtggctccgttcccaaayagcaatcgttcctcaagagcctgtgctcttcaactgcagcattgctgagaacatcgcctatggtgacaacagccgtgtggtgccattagatgagatcaaa

SEQ ID NO: 6279 - DNA, 201 bp, Homo sapiens
ttctccaaaaacccaaaattttattgttggatgaggccacttcagccctcgataatgacagtgagaaggtggttcagcatgcccttgataaagccaggacrggaaggacatgcctagtggtcactcacaggctctctgcaattcagaacgcagatttgatagtggttctgcacaatggaaagataaaggaacaaggaactc

SEQ ID NO: 6280 - DNA, 201 bp, Homo sapiens
ggagaatatacgtactatagtgtcattaacaagggaaaaagccttcgagcaaatgtatgaagagatgcttcagactcaacacagaaatacctcgaagaaarcacagattattggaagctgttatgcattcagccatgcctttatatattttgcctatgcggcagggtttcgatttggagcctatttaattcaagctggacg

SEQ ID NO: 6281 - DNA, 180 bp, Homo sapiens
ctacaatcgtggtagcacaccgactttctactattcgaagtgcagatttgattgtgaccctaaaggatggaatgctggcrgagaaaggagcacatgctgaactaatggcaaaacgaggtctatattattcacttgtgatgtcacaggatattaaaaaagctgatgaacagatggagtcaa

SEQ ID NO: 6282 - DNA, 201 bp, Homo sapiens
gtttcgatttggagcctatttaattcaagctggacgaatgaccccagagggcatgttcatagtttttactgcaattgcatatggagctatggccatcggaraaacgctcgttttggctcctgaatattccaaagccaaatcgggggctgcgcatctgtttgccttgttggaaaagaaaccaaatatagacagccgcagtca

SEQ ID NO: 6283 - DNA, 201 bp, Homo sapiens
aagagatgcttcagactcaacacagaaatacctcgaagaaagcacagattattggaagctgttatgcattcagccatgcctttatatattttgcctatgcrgcagggtttcgatttggagcctatttaattcaagctggacgaatgaccccagagggcatgttcatagtttttactgcaattgcatatggagctatggcca

SEQ ID NO: 6284 - DNA, 201 bp, Homo sapiens
aaaggtcttgctgtattgcccaaggctggaggacagtgatgcaatcatggctccctgcagccttgatcttctgagctcagtccctgctttgataaccacasgcagctacgggaaagagtgggaaaagtgagatagtcccaagaaacaggcaacagcaggatagcatcagctctaaaaatatctgaattggaaatcacaact

SEQ ID NO: 6285 - DNA, 201 bp, Homo sapiens
tccccctcggtgtatttctactaataaatgcacagctccagaagttgaaaatgcaattagagtaccaggaaacaggagtttctttaccctcactgagatcrtcagatttagatgtcagcccgggtttgtcatggtagggtcccacactgtgcagtgccagaccaatggcagatgggggcccaagctgccacactgctccag

SEQ ID NO: 6286 - DNA, 201 bp, Homo sapiens
ttgcaccagcaaagatgatcaagttggtgtttggagcagccctccccctcggtgtatttctactaataaatgcacagctccagaagttgaaaatgcaattrgagtaccaggaaacaggagtttctttaccctcactgagatcatcagatttagatgtcagcccgggtttgtcatggtagggtcccacactgtgcagtgcca

SEQ ID NO: 6287 - DNA, 201 bp, Homo sapiens
cctgccaacacgcccggctaatttttttgtatttttagtagagacggggtttcaccatgttagccaggatggtctggatctcctgacctcgtgatccaccygcctcggcctcccaaagtgctgcgattacaggcatgagccaccgcgcctggccgctttcgatattttctaaactttaattcaaaagcactttgtgctgtg

SEQ ID NO: 6288 - DNA, 201 bp, Homo sapiens
ggacatctttgaattatgaatgccgtcctgggtattttgggaaaatgttctctatctcctgcctagaaaacttggtctggtcaagtgttgaagacaactgyagacgaaaatcatgtggacctccaccagaacccttcaatggaatggtgcatataaacacagatacacagtttggatcaacagttaattattcttgtaatg

SEQ ID NO: 6289 - DNA, 201 bp, Homo sapiens
tctcccaggctggagtgcagtggcgtaatctcggctcactgcaagctccgcctcccgggttgacaccattttcctgcctcagcctcctgagtagttgggaytaccagtagatgggactacaggcacctgccaacacgcccggctaatttttttgtatttttagtagagacggggtttcaccatgttagccaggatggtctg

SEQ ID NO: 6290 - DNA, 201 bp, Homo sapiens
aggcagcagcgttcatccccgaactctgcaaacaaatgaagaaaatagcagggtccttccttgacaaagtactatacagctgaagaacatctcgaatacarttttggtgggaaaggagccaattgatttcaacagaatcagatctgagcttcataaagtctttgaagtgacttcacagagacgcagacatgtgcacttgaa

SEQ ID NO: 6291 - DNA, 201 bp, Homo sapiens
tcatgggaatggggtttggagcagccctgcccctcgctgtgaactttctgttcgtgctggtcactgtaaaaccccagagcagtttccatttgccagtcctwcgatcccaattaatgactttgagtttccagtcgggacatctttgaattatgaatgccgtcctgggtattttgggaaaatgttctctatctcctgcctaga

SEQ ID NO: 6292 - DNA, 201 bp, Homo sapiens
ggaggcagcagcgttcatccccgaactctgcaaacaaatgaagaaaatagcagggtccttccttgacaaagtactatacagctgaagaacatctcgaatayaattttggtgggaaaggagccaattgatttcaacagaatcagatctgagcttcataaagtctttgaagtgacttcacagagacgcagacatgtgcacttg

SEQ ID NO: 6293 - DNA, 201 bp, Homo sapiens
tgctggcggttgtggtgctgcttgcgctgccggtggcctggggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactg

SEQ ID NO: 6294 - DNA, 201 bp, Homo sapiens
atagcagtgttccagtgtgtgaacaaatcttttgtccaagtcctccagttattcctaatgggagacacacaggaaaacctctggaagtctttccctttggraaaacagtaaattacacatgcgacccccacccagacagagggacgagcttcgacctcattggagagagcaccatccgctgcacaagtgaccctcaaggga

SEQ ID NO: 6295 - DNA, 201 bp, Homo sapiens
tgacttcacagagacgcagacatgtgcacttgaagatgctgccccttccctggtacctagcaaagctcctgcctctttgtgtgcgtcactgtgaaaccccyacccttctgcctcgtgctaaacgcacacagtatctagtcaggggaaaagactgcatttaggagatagaaaatagtttggattacttaaaggaataaggtg

SEQ ID NO: 6296 - DNA, 201 bp, Homo sapiens
gtggaaaatggaatattggtatctgacaacagaagcttattttccttaaatgaagttgtggagtttaggtgtcagcctggctttgtcatgaaaggaccccrccgtgtgaagtgccaggccctgaacaaatgggagccagagttaccaagctgctccagggtgtgtcagccgcctccagaaatcctgcatggtgagcatacc

SEQ ID NO: 6297 - DNA, 201 bp, Homo sapiens
gatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaagaagtaaattgtagcttcccactgtttatgaatggaatctcgaa

SEQ ID NO: 6298 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctgcctgcccacatccacccaagatccaaaacgggcattacatt

SEQ ID NO: 6299 - DNA, 201 bp, Homo sapiens
gggagaaaggtgtttgagcttgtgggtgagccctccatatactgcaccagcaatgacgatcaagtgggcatctggagcggcccggcccctcagtgcattayacctaacaaatgcacgcctccaaatgtggaaaatggaatattggtatctgacaacagaagcttattttccttaaatgaagttgtggagtttaggtgtcag

SEQ ID NO: 6300 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtcaatgcaatgccccagaatggcttccatttgccaggcctaccaacctaactgatgagtttgagtttcccattgggacat

SEQ ID NO: 6301 - DNA, 201 bp, Homo sapiens
aatgggagccggagctaccaagctgctccagggtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagccccca

SEQ ID NO: 6302 - DNA, 201 bp, Homo sapiens
catgggaatggggtttggagcagccctgcccctcgctgtgaactttctgttcgtgctggtcactgtaaaaccccagagcagtttccatttgccagtcctaygatcccaattaatgactttgagtttccagtcgggacatctttgaattatgaatgccgtcctgggtattttgggaaaatgttctctatctcctgcctagaa

SEQ ID NO: 6303 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtcaatgcaatgccccagaatggcttccatttgccaggcctaccaacctaactgatgagtttgagtttc

SEQ ID NO: 6304 - DNA, 201 bp, Homo sapiens
cagtgttccagtgtgtgaacaaatcttttgtccaagtcctccagttattcctaatgggagacacacaggaaaacctctggaagtctttccctttgggaaarcagtaaattacacatgcgacccccacccagacagagggacgagcttcgacctcattggagagagcaccatccgctgcacaagtgaccctcaagggaatgg

SEQ ID NO: 6305 - DNA, 201 bp, Homo sapiens
tccatccgctgcacaagtgaccctcaagggaatggggtttggagcagccctgcccctcgctgtgaactttctgttcctgctgcctgcccacatccacccargatccaaaacgggcattacattggaggacacgtatctctatatcttcctgggatgacaatcagctacatttgtgaccccggctacctgttagtgggaaag

SEQ ID NO: 6306 - DNA, 201 bp, Homo sapiens
gctgtttgagcttgtgggagaacggtcaatatattgcaccagcaaagatgatcaagttggtgtttggagcagccctccccctcggtgtatttctactaatraatgcacagctccagaagttgaaaatgcaattagagtaccaggaaacaggagtttctttaccctcactgagatcatcagatttagatgtcagcccgggtt

SEQ ID NO: 6307 - DNA, 201 bp, Homo sapiens
ctatggatcagtggtgacctaccgctgcaatcctggaagcggagggagaaaggtgtttgagcttgtgggtgagccctccatatactgcaccagcaatgacratcaagtgggcatctggagcggccccgcccctcagtgcattatacctaacaaatgcacgcctccaaatgtggaaaatggaatattggtatctgacaacag

SEQ ID NO: 6308 - DNA, 201 bp, Homo sapiens
tggagacttctacagcaacaatagaacatcttttcacaatggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaataaatgcacagctcc

SEQ ID NO: 6309 - DNA, 201 bp, Homo sapiens
tgggataagaaggcacctatttgtgagatcatatcttgtgagccacctccaaccatatccaatggagacttctacagcaacaatagaacatcttttcacartggaacggtggtaacttaccagtgccacactggaccagatggagaacagctgtttgagcttgtgggagaacggtcaatatattgcaccagcaaagatgat

SEQ ID NO: 6310 - DNA, 201 bp, Homo sapiens
tgtttggagcagccctccccctcggtgtatttctactaataaatgcacagctccagaagttgaaaatgcaattagagtaccaggaaacaggagtttctttwccctcactgagatcatcagatttagatgtcagcccgggtttgtcatggtagggtcccacactgtgcagtgccagaccaatggcagatgggggcccaagct

SEQ ID NO: 6311 - DNA, 201 bp, Homo sapiens
ccccgccgtgtgaagtgccaggccctgaacaaatgggagccagagttaccaagctgctccagggtgtgtcagccgcctccagaaatcctgcatggtgagcrtaccccaagccatcaggacaacttttcacctgggcaggaagtgttctacagctgtgagcctggctatgacctcagaggggctgcgtctctgcactgcaca

SEQ ID NO: 6312 - DNA, 201 bp, Homo sapiens
gccaattgatttcaacagaatcagatctgagcttcataaagtctttgaagtgacttcacagagacgcagacatgtgcacttgaagatgctgccccttcccyggtacctagcaaagctcctgcctctttgtgtgcgtcactgtgaaacccccacccttctgcctcgtgctaaacgcacacagtatctagtcaggggaaaaga

SEQ ID NO: 6313 - DNA, 201 bp, Homo sapiens
tgaatgccgccctggttattccggaagaccgttttctatcatctgcctaaaaaactcagtctggactggtgctaaggacaggtgcagacgtaaatcatgtygtaatcctccagatcctgtgaatggcatggtgcatgtgatcaaaggcatccagttcggatcccaaattaaatattcttgtactaaaggataccgactcat

SEQ ID NO: 6314 - DNA, 201 bp, Homo sapiens
tttgaagtgtgaagatgggtatactctggaaggcagtccctggagccagtgccaggcggatgacagatgggaccctcctctggccaaatgtacctctcgtrcacatgatgctctcatagttggcactttatctggtacgatcttctttattttactcatcattttcctctcttggataattctaaagcacagaaaaggcaa

SEQ ID NO: 6315 - DNA, 201 bp, Homo sapiens
gctggactattgggagagtggctcaaacccatgttgcagttctggagtcacacactggacagtctaagtgtcacactcatcaaaaccactgcctcctaggrtgcatcacatgtggcatcaattacacagtgacattaaaagcaattagtgccaccgggttgactgcagattgctcctaccaaagttatttctctggtgcct

SEQ ID NO: 6316 - DNA, 201 bp, Homo sapiens
gatgactccacctgcaatcagagaacaagtcctcgggcccctgccaacattcaagtctctttcgatagtggagctctgaaggcatctttttcctgggcackggcagaaggagctttcaattatactgtgatggctttgagcgactcttcagagctgacctgcagtacaactttcagttcctgcaccatctcttccctccag

SEQ ID NO: 6317 - DNA, 201 bp, Homo sapiens
gtgaagagtgatgatggcttggaagtacactgcaacacatctctcactcagtgcaacttcttatctgagtgtggcttcacttattttattagtgtttttgyctataacaaggcagggcaaagtcctttgggtgacatattcaattataccacagctccctgttgtcctagtgacattaaccccgtgttggtgtccagtgac

SEQ ID NO: 6318 - DNA, 201 bp, Homo sapiens
gtaagctctccaagttcagactccattcttgtgcagtgggaagctgtatatatggcaattgcattctccgtgtccattatgcgagccaatggcttggggartatatggaaagagaatactacaaacacctccttgacattcaccagtttagaagccggaactctctacaccataaaggcctatgcatggaatgccaacaga

SEQ ID NO: 6319 - DNA, 201 bp, Homo sapiens
agtgttggctgcaccaattctagaagtaagctctccaagttcagactccattcttgtgcagtgggaagctgtatatatggcaattgcattctccgtgtccrttatgcgagccaatggcttggggagtatatggaaagagaatactacaaacacctccttgacattcaccagtttagaagccggaactctctacaccataaa

SEQ ID NO: 6320 - DNA, 201 bp, Homo sapiens
aaatcatcttcagcaatgaccctgaaaactgttgcttgtgcacccggaagagtgacgatccaagaagatccccctggccacctgtctgtggcttggtccartgtagatctgggtgactactatgtggtctttgtgaagagtgatgatggcttggaagtacactgcaacacatctctcactcagtgcaacttcttatctgag

SEQ ID NO: 6321 - DNA, 201 bp, Homo sapiens
tggtgtccagtgacagagttgagattgtctggtctcctgtccgtggtgccgaactgtatgaaaccaaggctgtagatgggtacaacatggttgagtgcaaygacactactcctgcgtgcaccctttcggctctagagtgtgacaccaagtacaacatcacagtgtattcattcaatgaagtccgaggcagcaatatgtcat

SEQ ID NO: 6322 - DNA, 201 bp, Homo sapiens
aggggctctgccaattacagcactgacctctatggctccaaaggcattttcacgtgcaccccgagtgctggcctcagtttctgtgatgtcactgagatacyctgtggggatgtatacactgtgatggtctcaccagttgctaaaacaggattgaagcttactttctgtccaaaaaaaatatattcagtaacttgctctgga

SEQ ID NO: 6323 - DNA, 201 bp, Homo sapiens
ctcactcagtgcaacttcttatctgagtgtggcttcacttattttattagtgtttttgcctataacaaggcagggcaaagtcctttgggtgacatattcarttataccacagctccctgttgtcctagtgacattaaccccgtgttggtgtccagtgacagagttgagattgtctggtctcctgtccgtggtgccgaactg

SEQ ID NO: 6324 - DNA, 201 bp, Homo sapiens
ctcctgcgtgcaccctttcggctctagagtgtgacaccaagtacaacatcacagtgtattcattcaatgaagtccgaggcagcaatatgtcatgtactccscagttcataaccacagctccttgcagtcctgaaataaaaaatgtttcaagggatgcattctccatgattaatgtgcactggcgatccactaatgatgatg

SEQ ID NO: 6325 - DNA, 201 bp, Homo sapiens
caaagacagtgttggctgcaccaattctagaagtaagctctccaagttcagactccattcttgtgcagtgggaagctgtatatatggcaattgcattctcygtgtccattatgcgagccaatggcttggggagtatatggaaagagaatactacaaacacctccttgacattcaccagtttagaagccggaactctctaca

SEQ ID NO: 6326 - DNA, 201 bp, Homo sapiens
ccacagctccttgcagtcctgaaataaaaaatgtttcaagggatgcattctccatgattaatgtgcactggcgatccactaatgatgatgctacttacacrgtgactgcccaaggggagaaaggactgtatcagtgcagcagcacaggagagtcctgcaccatgcggggcttgccctgtggctcagtgttctctgtcactg

SEQ ID NO: 6327 - DNA, 201 bp, Homo sapiens
gccggacatggtacattctttcactgaccctctgccgtttcctggcctggaattattttgcacaccttcgtttggaggttttacagctgacccgccaccckgagaactggaccctgcaagcccggtggcggcttgtggggctgcccgtccacttgctctttttgcggttctacaagcgtgacaaagacgagcattaccgga

SEQ ID NO: 6328 - DNA, 201 bp, Homo sapiens
tctacaagcgtgacaaagacgagcattaccggacctatgatgcctactccactttctacctgaattccagtggcctcatttgtcgccatcgtctagataakctgatgccttcacactcacctccaacgcctgtgaagaagctgctagtgggagccctggtggccctggggctgtcagagccagaacctgacttaaacctgt

SEQ ID NO: 6329 - DNA, 201 bp, Homo sapiens
tgagcctcctgggaaactcacctgtcttgctcctggatgaaccatctacgggcatagaccccacagggcagcagcaaatgtggcaggcaatccaggcagtygttaaaaacacagagagaggtgtcctcctgaccacccataacctggctgaggcggaagccttgtgtgaccgtgtggccatcatggtgtctggaaggctta

SEQ ID NO: 6330 - DNA, 201 bp, Homo sapiens
tgatccttttcagtacccagtccatggatgaggctgacatcctggctgatagaaaagtgatcatgtccaatgggagactgaagtgtgcaggttcttctatstttttgaaaagaaggtggggtcttggatatcacctaagtttacataggaatgaaatatgtaacccagaacaaataacatccttcattactcatcacatcc

SEQ ID NO: 6331 - DNA, 201 bp, Homo sapiens
tttttcgcaaaaggagaaaaaacagtggcctttggtcattttacttcttttttgcctccaccatcatgttttccatcactttaatcaatcattttgacctragtatattgattaccaccatggtattggttccttcatataccttgcttggatttaaaacttttttggaagtgagagaccaggagcactacagagaatttc

SEQ ID NO: 6332 - DNA, 201 bp, Homo sapiens
cagaagaaaagttgcttttcaaagaggaagaagaaaatagcagcaagaaatatctctttctgtgttcaagaaggtgaaattttgggattgctaggacccartggtgctggaaaaagttcatctattagaatgatatctgggatcacaaagccaactgctggagaggtggaactgaaaggctgcagttcagttttgggccac

SEQ ID NO: 6333 - DNA, 201 bp, Homo sapiens
tgcaaaacattcaagataaccttgctaaacatttaagtgaaggacagaaaagaaagctgacttttgggattaccattttaggagatcctcaaattttgctyttagatgaaccaactactggattggatcccttttccagagatcaagtgtggagcctcctgagagagcgtagagcagatcatgtgatccttttcagtaccc

SEQ ID NO: 6334 - DNA, 201 bp, Homo sapiens
gtctaagaatttgatgaaaatgatgggtctccaagattcagcattctggctctcctggggtctaatctatgctggcttcatctttattatttccatattcrttacaattatcataacattcacccaaattatagtcatgactggcttcatggtcatatttatactcttttttttatatggcttatctttggtagctttggt

SEQ ID NO: 6335 - DNA, 201 bp, Homo sapiens
ggctccgtttcttaaagttaaaacgtcaaactaaagtgttattgaccctattattggtatttggaatcgcaatattccctttgattgttgaaaatataatrtatgctatgttaaatgaaaagatcgattgggaatttaaaaacgaattgtattttctctctcctggacaacttccccaggaaccccgtaccagcctgttga

SEQ ID NO: 6336 - DNA, 201 bp, Homo sapiens
atgaagaaattgatacaacaatgagatggaaactcctccctcattcagatgaaccttaaaacctcaaacctagtaattttttgttgatctcctataaactyatgttttatgtaataattaatagtatgtttaattttaaagatcatttaaaattaacatcaggtatattttgtaaatttagttaacaaatacataaatttt

SEQ ID NO: 6337 - DNA, 201 bp, Homo sapiens; identical to SEQ ID NO: 6329

SEQ ID NO: 6338 - DNA, 201 bp, Homo sapiens
ccattttaggagatcctcaatccatggatgaggctgacatcctggctgatagaaaagtgatcatgtccaatgggagactgaagtgtgcaggttcttctatstttttgaaaagaaggtggggtcttggatatcacctaagtttacataggaatgaaatatgtaacccagaacaaataacatccttcattactcatcacatcc

SEQ ID NO: 6339 - DNA, 201 bp, Homo sapiens; identical to SEQ ID NO: 6331

SEQ ID NO: 6340 - DNA, 201 bp, Homo sapiens; identical to SEQ ID NO: 6332

SEQ ID NO: 6341 - DNA, 201 bp, Homo sapiens; identical to SEQ ID NO: 6334

SEQ ID NO: 6342 - DNA, 201 bp, Homo sapiens; identical to SEQ ID NO: 6335

SEQ ID NO: 6343 - DNA, 201 bp, Homo sapiens; identical to SEQ ID NO: 6336

SEQ ID NO: 6344 - DNA, 201 bp, Homo sapiens
ggagaacatggaattgtggttttctctttgggatcaatggtctcagaaattccagagaagaaagctatggcaattgctgatgctttgggcaaaatccctcrgacagtcctgtggcggtacactggaacccgaccatcgaatcttgcgaacaacacgatacttgttaagtggctaccccaaaacgatctgcttggtcacccg

SEQ ID NO: 6345 - DNA, 201 bp, Homo sapiens
tggagaacatggaattgtggttttctctttgggatcaatggtctcagaaattccagagaagaaagctatggcaattgctgatgctttgggcaaaatccctyagacagtcctgtggcggtacactggaacccgaccatcgaatcttgcgaacaacacgatacttgttaagtggctaccccaaaacgatctgcttggtcaccc

SEQ ID NO: 6346 - DNA, 201 bp, Homo sapiens
ttgtggttttctctttgggatcaatggtctcagaaattccagagaagaaagctatggcaattgctgatgctttgggcaaaatccctcagacagtcctgtgrcggtacactggaacccgaccatcgaatcttgcgaacaacacgatacttgttaagtggctaccccaaaacgatctgcttggtcacccgatgacccgtgcct

SEQ ID NO: 6347 - DNA, 201 bp, Homo sapiens
gtcatcaatgacaaaagttacaaggagaacatcatgcgcctctccagccttcacaaggaccgcccggtggagccgctggacctggccgtgttctgggtggmgtttgtgatgaggcacaagggcgcgccacacctgcgccccgcagcccacgacctcacctggtaccagtaccattccttggacgtgattggtttcctcttg

SEQ ID NO: 6348 - DNA, 201 bp, Homo sapiens
ggtgttgtgtggagctactgcataatgaggccctgatcaggcacctgaatgctacttcctttgatgtggttttaacagaccccgttaacctctgcggggcrgtgctggctaagtacctgtcgattcctgctgtgtttttttggaggtacattccatgtgacttagactttaagggcacacagtgtccaaatccttcctcct

SEQ ID NO: 6349 - DNA, 201 bp, Homo sapiens
gcccggtggagccgctggacctggccgtgttctgggtggagtttgtgatgaggcacaagggcgcgccacacctgcgccccgcagcccacgacctcacctgrtaccagtaccattccttggacgtgattggtttcctcttggccgtcgtgctgacagtggccttcatcacctttaaatgttgtgcttatggctaccggaaat

SEQ ID NO: 6350 - DNA, 201 bp, Homo sapiens
gcccactgatggcagcccctggctcagcatgcgggaggccttgcgggagctccatgccagaggccaccaggcggtggtcctcaccccagaggtgaatatgyacatcaaagaagagaaatttttcaccctgacagcctatgctgttccatggacccagaaggaatttgatcgcgttacgctgggctacactcaagggttctt

SEQ ID NO: 6351 - DNA, 201 bp, Homo sapiens
ccgtgcctttatcacccatgctggttcccatggtgtttatgaaagcatatgcaatggcgttcccatggtgatgatgcccttgtttggtgatcagatggacratgcaaagcgcatggagactaagggagctggagtgaccctgaatgttctggaaatgacttctgaagatttagaaaatgctctaaaagcagtcatcaatga

SEQ ID NO: 6352 - DNA, 201 bp, Homo sapiens
ctggacctggccgtgttctgggtggagtttgtgatgaggcacaagggcgcgccacacctgcgccccgcagcccacgacctcacctggtaccagtaccattycttggacgtgattggtttcctcttggccgtcgtgctgacagtggccttcatcacctttaaatgttgtgcttatggctaccggaaatgcttggggaaaaaa

SEQ ID NO: 6353 - DNA, 201 bp, Homo sapiens
agcccacgacctcacctggtaccagtaccattccttggacgtgattggtttcctcttggccgtcgtgctgacagtggccttcatcacctttaaatgttgtscttatggctaccggaaatgcttggggaaaaaagggcgagttaagaaagcccacaaatccaagacccattgagaagtgggtgggaaataaggtaaaatttt

SEQ ID NO: 6354 - DNA, 201 bp, Homo sapiens
ttcataggtgttgtgtggagctactgcataatgaggccctgatcaggcacctgaatgctacttcctttgatgtggttttaacagaccccgttaacctctgyggggcggtgctggctaagtacctgtcgattcctgctgtgtttttttggaggtacattccatgtgacttagactttaagggcacacagtgtccaaatcctt

SEQ ID NO: 6355 - DNA, 201 bp, Homo sapiens
tggccttcatcacctttaaatgttgtgcttatggctaccggaaatgcttggggaaaaaagggcgagttaagaaagcccacaaatccaagacccattgagargtgggtgggaaataaggtaaaattttgaaccattccctagtcatttccaaacttgaaaacagaatcagtgttaaattcattttattcttattaaggaaat

SEQ ID NO: 6356 - DNA, 199 bp, Homo sapiens
acagtcagctgtcggtggcttctgctgagatggccagaggactccaggttcccctgccgcggctggccacaggactgctgctcctcctcagtgtccagmcctgggctgagagtggaaaggtgttggtggtgcccactgatggcagcccctggctcagcatgcgggaggccttgcgggagctccatgccagaggccacca

SEQ ID NO: 6357 - DNA, 201 bp, Homo sapiens
catttttcagaggacgtgcagacaggctggcattctagattacttttcttactctgaaacatggcctgtttgggagtgcgggattcaaaggtggtcccacsgctgcccctactgcaaatggcagttttaatcttatcttttggcttctgcagatggttgcaattgatccttaaccaataatggtcagtcctcatctctgtc

SEQ ID NO: 6358 - DNA, 201 bp, Homo sapiens
gctgcccctactgcaaatggcagttttaatcttatcttttggcttctgcagatggttgcaattgatccttaaccaataatggtcagtcctcatctctgtcstgcttcataggtgccaccttgtgtgtttaaagaagggaagctttgtacctttagagtgtaggtgaaatgaatgaatggcttggagtgcactgagaacagc

SEQ ID NO: 6359 - DNA, 201 bp, Homo sapiens
tatgaacaatgtatctttggcccttcataggtgttgtgtggagctactgcataatgaggccctgatcaggcacctgaatgctacttcctttgatgtggttytaacagaccccgttaacctctgcggggcggtgctggctaagtacctgtcgattcctgctgtgtttttttggaggtacattccatgtgacttagactttaa

SEQ ID NO: 6360 - DNA, 201 bp, Homo sapiens
tgtggttttctctttgggatcaatggtctcagaaattccagagaagaaagctatggcaattgctgatgctttgggcaaaatccctcagacagtcctgtggyggtacactggaacccgaccatcgaatcttgcgaacaacacgatacttgttaagtggctaccccaaaacgatctgcttggtcacccgatgacccgtgcctt

SEQ ID NO: 6361 - DNA, 201 bp, Homo sapiens
tgctacttcctttgatgtggttttaacagaccccgttaacctctgcggggcggtgctggctaagtacctgtcgattcctgctgtgtttttttggaggtacwttccatgtgacttagactttaagggcacacagtgtccaaatccttcctcctatattcctaagttactaacgaccaattcagaccacatgacattcctgca

SEQ ID NO: 6362 - DNA, 201 bp, Homo sapiens
tcgaatcttgcgaacaacacgatacttgttaagtggctaccccaaaacgatctgcttggtcacccgatgacccgtgcctttatcacccatgctggttcccrtggtgtttatgaaagcatatgcaatggcgttcccatggtgatgatgcccttgtttggtgatcagatggacaatgcaaagcgcatggagactaagggagct

SEQ ID NO: 6363 - DNA, 201 bp, Homo sapiens
gatgctttgggcaaaatccctcagacagtcctgtggcggtacactggaacccgaccatcgaatcttgcgaacaacacgatacttgttaagtggctaccccraaacgatctgcttggtcacccgatgacccgtgcctttatcacccatgctggttcccatggtgtttatgaaagcatatgcaatggcgttcccatggtgatg

SEQ ID NO: 6364 - DNA, 201 bp, Homo sapiens
aatcttgcgaacaacacgatacttgttaagtggctaccccaaaacgatctgcttggtcacccgatgacccgtgcctttatcacccatgctggttcccatgktgtttatgaaagcatatgcaatggcgttcccatggtgatgatgcccttgtttggtgatcagatggacaatgcaaagcgcatggagactaagggagctgga

SEQ ID NO: 6365 - DNA, 201 bp, Homo sapiens
tgatgctttgggcaaaatccctcagacagtcctgtggcggtacactggaacccgaccatcgaatcttgcgaacaacacgatacttgttaagtggctacccyaaaacgatctgcttggtcacccgatgacccgtgcctttatcacccatgctggttcccatggtgtttatgaaagcatatgcaatggcgttcccatggtgat

SEQ ID NO: 6366 - DNA, 201 bp, Homo sapiens
gagtttgtgatgaggcacaagggcgcgccacacctgcgccccgcagcccacgacctcacctggtaccagtaccattccttggacgtgattggtttcctctwggccgtcgtgctgacagtggccttcatcacctttaaatgttgtgcttatggctaccggaaatgcttggggaaaaaagggcgagttaagaaagcccacaaa

SEQ ID NO: 6367 - DNA, 201 bp, Homo sapiens
gggttctttgaaacagaacatcttctgaagagatattctagaagtatggcaattatgaacaatgtatctttggcccttcataggtgttgtgtggagctacygcataatgaggccctgatcaggcacctgaatgctacttcctttgatgtggttttaacagaccccgttaacctctgcggggcggtgctggctaagtacctg

SEQ ID NO: 6368 - DNA, 201 bp, Homo sapiens
cctgtggcggtacactggaacccgaccatcgaatcttgcgaacaacacgatacttgttaagtggctaccccaaaacgatctgcttggtcacccgatgaccsgtgcctttatcacccatgctggttcccatggtgtttatgaaagcatatgcaatggcgttcccatggtgatgatgcccttgtttggtgatcagatggacaa

SEQ ID NO: 6369 - DNA, 201 bp, Homo sapiens
gtggcggtacactggaacccgaccatcgaatcttgcgaacaacacgatacttgttaagtggctaccccaaaacgatctgcttggtcacccgatgacccgtrcctttatcacccatgctggttcccatggtgtttatgaaagcatatgcaatggcgttcccatggtgatgatgcccttgtttggtgatcagatggacaatgc

SEQ ID NO: 6370 - DNA, 201 bp, Homo sapiens
tggtgatcagatggacaatgcaaagcgcatggagactaagggagctggagtgaccctgaatgttctggaaatgacttctgaagatttagaaaatgctctaraagcagtcatcaatgacaaaagttacaaggagaacatcatgcgcctctccagccttcacaaggaccgcccggtggagccgctggacctggccgtgttctg

SEQ ID NO: 6371 - DNA, 201 bp, Homo sapiens
catggagactaagggagctggagtgaccctgaatgttctggaaatgacttctgaagatttagaaaatgctctaaaagcagtcatcaatgacaaaagttacwaggagaacatcatgcgcctctccagccttcacaaggaccgcccggtggagccgctggacctggccgtgttctgggtggagtttgtgatgaggcacaaggg

SEQ ID NO: 6372 - DNA, 201 bp, Homo sapiens
tctccagccttcacaaggaccgcccggtggagccgctggacctggccgtgttctgggtggagtttgtgatgaggcacaagggcgcgccacacctgcgcccygcagcccacgacctcacctggtaccagtaccattccttggacgtgattggtttcctcttggccgtcgtgctgacagtggccttcatcacctttaaatgtt

SEQ ID NO: 6373 - DNA, 201 bp, Homo sapiens
ataaattaatcagccccagagtgctttaaaaaattctcttaaataaaaataatagactcgctagtcagtaaagatatttgaatatgtatcgtgccccctcyggtgtctttgatcaggatgacatgtgccatttttcagaggacgtgcagacaggctggcattctagattacttttcttactctgaaacatggcctgtttgg

SEQ ID NO: 6374 - DNA, 201 bp, Homo sapiens
aggactgctgctcctcctcagtgtccagccctgggctgagagtggaaaggtgttggtggtgcccactgatggcagcccctggctcagcatgcgggaggccktgcgggagctccatgccagaggccaccaggcggtggtcctcaccccagaggtgaatatgcacatcaaagaagagaaatttttcaccctgacagcctatgc

SEQ ID NO: 6375 - DNA, 201 bp, Homo sapiens
ccatcgaatcttgcgaacaacacgatacttgttaagtggctaccccaaaacgatctgcttggtcacccgatgacccgtgcctttatcacccatgctggttyccatggtgtttatgaaagcatatgcaatggcgttcccatggtgatgatgcccttgtttggtgatcagatggacaatgcaaagcgcatggagactaaggga

SEQ ID NO: 6376 - DNA, 201 bp, Homo sapiens
catgcgcctctccagccttcacaaggaccgcccggtggagccgctggacctggccgtgttctgggtggagtttgtgatgaggcacaagggcgcgccacacmtgcgccccgcagcccacgacctcacctggtaccagtaccattccttggacgtgattggtttcctcttggccgtcgtgctgacagtggccttcatcacctt

SEQ ID NO: 6377 - DNA, 201 bp, Homo sapiens
ggagccgctggacctggccgtgttctgggtggagtttgtgatgaggcacaagggcgcgccacacctgcgccccgcagcccacgacctcacctggtaccagkaccattccttggacgtgattggtttcctcttggccgtcgtgctgacagtggccttcatcacctttaaatgttgtgcttatggctaccggaaatgcttggg

SEQ ID NO: 6378 - DNA, 201 bp, Homo sapiens
tgcctttatcacccatgctggttcccatggtgtttatgaaagcatatgcaatggcgttcccatggtgatgatgcccttgtttggtgatcagatggacaatscaaagcgcatggagactaagggagctggagtgaccctgaatgttctggaaatgacttctgaagatttagaaaatgctctaaaagcagtcatcaatgacaa

SEQ ID NO: 6379 - DNA, 201 bp, Homo sapiens
atgctgttccatggacccagaaggaatttgatcgcgttacgctgggctacactcaagggttctttgaaacagaacatcttctgaagagatattctagaagyatggcaattatgaacaatgtatctttggcccttcataggtgttgtgtggagctactgcataatgaggccctgatcaggcacctgaatgctacttcctttg

SEQ ID NO: 6380 - DNA, 201 bp, Homo sapiens
ccaattcagaccacatgacattcctgcaaagggtcaagaacatgctctaccctctggccctgtcctacatttgccatactttttctgccccttatgcaagycttgcctctgagctttttcagagagaggtgtcagtggtggatcttgtcagctatgcatccgtgtggctgttccgaggggactttgtgatggactacccca

SEQ ID NO: 6381 - DNA, 160 bp, Homo sapiens
acagtcagctgtcggtggcttctgctgagatggccagaggactccaggttcccctgccgyggctggccacaggactgctgctcctcctcagtgtccagccctgggctgagagtggaaaggtgttggtggtgcccactgatggcagcccctggctcagcat

SEQ ID NO: 6382 - DNA, 201 bp, Homo sapiens
tccttcctcctatattcctaagttactaacgaccaattcagaccacatgacattcctgcaaagggtcaagaacatgctctaccctctggccctgtcctacmtttgccatactttttctgccccttatgcaagtcttgcctctgagctttttcagagagaggtgtcagtggtggatcttgtcagctatgcatccgtgtggct

SEQ ID NO: 6383 - DNA, 201 bp, Homo sapiens
cgcccggtggagccgctggacctggccgtgttctgggtggagtttgtgatgaggcacaagggcgcgccacacctgcgccccgcagcccacgacctcacctrgtaccagtaccattccttggacgtgattggtttcctcttggccgtcgtgctgacagtggccttcatcacctttaaatgttgtgcttatggctaccggaaa

SEQ ID NO: 6384 - DNA, 201 bp, Homo sapiens
tattcctaagttactaacgaccaattcagaccacatgacattcctgcaaagggtcaagaacatgctctaccctctggccctgtcctacatttgccatactktttctgccccttatgcaagtcttgcctctgagctttttcagagagaggtgtcagtggtggatcttgtcagctatgcatccgtgtggctgttccgagggga

SEQ ID NO: 6385 - DNA, 201 bp, Homo sapiens
attgggggcatcaactgtgccaacgggaagccactatctcaggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6386 - DNA, 201 bp, Homo sapiens
acacgatacttgttaagtggctaccccaaaacgatctgcttggtcacccgatgacccgtgcctttatcacccatgctggttcccatggtgtttatgaaagsatatgcaatggcgttcccatggtgatgatgcccttgtttggtgatcagatggacaatgcaaagcgcatggagactaagggagctggagtgaccctgaatg

SEQ ID NO: 6387 - DNA, 201 bp, Homo sapiens
ctatattcctaagttactaacgaccaattcagaccacatgacattcctgcaaagggtcaagaacatgctctaccctctggccctgtcctacatttgccatrctttttctgccccttatgcaagtcttgcctctgagctttttcagagagaggtgtcagtggtggatcttgtcagctatgcatccgtgtggctgttccgagg

SEQ ID NO: 6388 - DNA, 201 bp, Homo sapiens; identical to SEQ ID NO: 6344

SEQ ID NO: 6389 - DNA, 201 bp, Homo sapiens; identical to SEQ ID NO: 6345

SEQ ID NO: 6390 - DNA, 201 bp, Homo sapiens; identical to SEQ ID NO: 6346

SEQ ID NO: 6391 - DNA, 201 bp, Homo sapiens; identical to SEQ ID NO: 6347

SEQ ID NO: 6392 - DNA, 201 bp, Homo sapiens; identical to SEQ ID NO: 6349

SEQ ID NO: 6393 - DNA, 201 bp, Homo sapiens; identical to SEQ ID NO: 6351

SEQ ID NO: 6394 - DNA, 201 bp, Homo sapiens; identical to SEQ ID NO: 6352

SEQ ID NO: 6395 - DNA, 201 bp, Homo sapiens; identical to SEQ ID NO: 6353

SEQ ID NO: 6396 - DNA, 201 bp, Homo sapiens
ggtgagttggcaactgggaaaatcactgaattgcacagtgaagacttactcaacctcatacactctggaggatctggaccgggaattcatggatttcgccsatgctcaatggaaagcacaagtacgaagtttgttttctctatttctgagttcatccaatggtttttttaacttatttttttcgcattgcaggagtttgtt

SEQ ID NO: 6397 - DNA, 201 bp, Homo sapiens
ttgcacagtgaagacttactcaacctcatacactctggaggatctggaccgggaattcatggatttcgccgatgctcaatggaaagcacaagtacgaagtwtgttttctctatttctgagttcatccaatggtttttttaacttatttttttcgcattgcaggagtttgtttaatgaccgaaaattagtagaatacttaaa

SEQ ID NO: 6398 - DNA, 201 bp, Homo sapiens
agttcttttgatgcggtgtttcttgatccttttgatgcctgtggcttaattgttgccaaatatttctccctcccctctgtggtcttcgccaggggaatagsttgccactatcttgaagaaggtgcacagtgccctgctcctctttcctatgtccccagaattctcttagggttctcagatgccatgactttcaaggagaga

SEQ ID NO: 6399 - DNA, 201 bp, Homo sapiens; identical to SEQ ID NO: 6355

SEQ ID NO: 6400 - DNA, 201 bp, Homo sapiens; identical to SEQ ID NO: 6357

SEQ ID NO: 6401 - DNA, 201 bp, Homo sapiens
cctactgtatcatagcagcttagaatcccagctgctggctcgggctgcagttctctcatggctcgcacagggtggaccagccccattcccctatgtgtttstctgctgctgacctgtggctttgctgaggcagggaagctgctggtagtgcccatggatgggagtcactggttcaccatgcagtcggtggtggagaaactt

SEQ ID NO: 6402 - DNA, 201 bp, Homo sapiens; identical to SEQ ID NO: 6358

SEQ ID NO: 6403 - DNA, 201 bp, Homo sapiens
gttcatccaatggtttttttaacttatttttttcgcattgcaggagtttgtttaatgaccgaaaattagtagaatacttaaaggagagttcttttgatgcrgtgtttcttgatccttttgatgcctgtggcttaattgttgccaaatatttctccctcccctctgtggtcttcgccaggggaatagcttgccactatcttg

SEQ ID NO: 6404 - DNA, 201 bp, Homo sapiens
atggtttttttaacttatttttttcgcattgcaggagtttgtttaatgaccgaaaattagtagaatacttaaaggagagttcttttgatgcggtgtttctkgatccttttgatgcctgtggcttaattgttgccaaatatttctccctcccctctgtggtcttcgccaggggaatagcttgccactatcttgaagaaggtg

SEQ ID NO: 6405 - DNA, 201 bp, Homo sapiens; identical to SEQ ID NO: 6362

SEQ ID NO: 6406 - DNA, 201 bp, Homo sapiens; identical to SEQ ID NO: 6360

SEQ ID NO: 6407 - DNA, 201 bp, Homo sapiens; identical to SEQ ID NO: 6363

SEQ ID NO: 6408 - DNA, 201 bp, Homo sapiens; identical to SEQ ID NO: 6364

SEQ ID NO: 6409 - DNA, 201 bp, Homo sapiens; identical to SEQ ID NO: 6365

SEQ ID NO: 6410 - DNA, 201 bp, Homo sapiens; identical to SEQ ID NO: 6366

SEQ ID NO: 6411 - DNA, 201 bp, Homo sapiens; identical to SEQ ID NO: 6368

SEQ ID NO: 6412 - DNA, 201 bp, Homo sapiens; identical to SEQ ID NO: 6369

SEQ ID NO: 6413 - DNA, 201 bp, Homo sapiens; identical to SEQ ID NO: 6370

SEQ ID NO: 6414 - DNA, 201 bp, Homo sapiens; identical to SEQ ID NO: 6371

SEQ ID NO: 6415 - DNA, 201 bp, Homo sapiens; identical to SEQ ID NO: 6372

SEQ ID NO: 6416 - DNA, 201 bp, Homo sapiens; identical to SEQ ID NO: 6373

SEQ ID NO: 6417 - DNA, 201 bp, Homo sapiens
gcacagtgaagacttactcaacctcatacactctggaggatctggaccgggaattcatggatttcgccgatgctcaatggaaagcacaagtacgaagtttrttttctctatttctgagttcatccaatggtttttttaacttatttttttcgcattgcaggagtttgtttaatgaccgaaaattagtagaatacttaaagg

SEQ ID NO: 6418 - DNA, 201 bp, Homo sapiens
cttactcaacctcatacactctggaggatctggaccgggaattcatggatttcgccgatgctcaatggaaagcacaagtacgaagtttgttttctctattwctgagttcatccaatggtttttttaacttatttttttcgcattgcaggagtttgtttaatgaccgaaaattagtagaatacttaaaggagagttcttttg

SEQ ID NO: 6419 - DNA, 201 bp, Homo sapiens
ttactcaacctcatacactctggaggatctggaccgggaattcatggatttcgccgatgctcaatggaaagcacaagtacgaagtttgttttctctatttmtgagttcatccaatggtttttttaacttatttttttcgcattgcaggagtttgtttaatgaccgaaaattagtagaatacttaaaggagagttcttttga

SEQ ID NO: 6420 - DNA, 201 bp, Homo sapiens
ggatctggaccgggaattcatggatttcgccgatgctcaatggaaagcacaagtacgaagtttgttttctctatttctgagttcatccaatggtttttttracttatttttttcgcattgcaggagtttgtttaatgaccgaaaattagtagaatacttaaaggagagttcttttgatgcggtgtttcttgatccttttga

SEQ ID NO: 6421 - DNA, 201 bp, Homo sapiens; identical to SEQ ID NO: 6375

SEQ ID NO: 6422 - DNA, 201 bp, Homo sapiens; identical to SEQ ID NO: 6376

SEQ ID NO: 6423 - DNA, 201 bp, Homo sapiens
cttatttttttcgcattgcaggagtttgtttaatgaccgaaaattagtagaatacttaaaggagagttcttttgatgcggtgtttcttgatccttttgatrcctgtggcttaattgttgccaaatatttctccctcccctctgtggtcttcgccaggggaatagcttgccactatcttgaagaaggtgcacagtgccctgc

SEQ ID NO: 6424 - DNA, 201 bp, Homo sapiens; identical to SEQ ID NO: 6378

SEQ ID NO: 6425 - DNA, 201 bp, Homo sapiens; identical to SEQ ID NO: 6377

SEQ ID NO: 6426 - DNA, 201 bp, Homo sapiens
ggagtttgtttaatgaccgaaaattagtagaatacttaaaggagagttcttttgatgcggtgtttcttgatccttttgatgcctgtggcttaattgttgcyaaatatttctccctcccctctgtggtcttcgccaggggaatagcttgccactatcttgaagaaggtgcacagtgccctgctcctctttcctatgtcccca

SEQ ID NO: 6427 - DNA, 201 bp, Homo sapiens
atacttaaaggagagttcttttgatgcggtgtttcttgatccttttgatgcctgtggcttaattgttgccaaatatttctccctcccctctgtggtcttcrccaggggaatagcttgccactatcttgaagaaggtgcacagtgccctgctcctctttcctatgtccccagaattctcttagggttctcagatgccatgac

SEQ ID NO: 6428 - DNA, 201 bp, Homo sapiens
ccactatcttgaagaaggtgcacagtgccctgctcctctttcctatgtccccagaattctcttagggttctcagatgccatgactttcaaggagagagtayggaaccacatcatgcacttggaggaacatttattttgccagtatttttccaaaaatgccctagaaatagcctctgaaattctccaaacacctgtcacagc

SEQ ID NO: 6429 - DNA, 201 bp, Homo sapiens
agaaggtgcacagtgccctgctcctctttcctatgtccccagaattctcttagggttctcagatgccatgactttcaaggagagagtacggaaccacatcrtgcacttggaggaacatttattttgccagtatttttccaaaaatgccctagaaatagcctctgaaattctccaaacacctgtcacagcatatgatctcta

SEQ ID NO: 6430 - DNA, 201 bp, Homo sapiens
gccctgctcctctttcctatgtccccagaattctcttagggttctcagatgccatgactttcaaggagagagtacggaaccacatcatgcacttggaggamcatttattttgccagtatttttccaaaaatgccctagaaatagcctctgaaattctccaaacacctgtcacagcatatgatctctacagccacacatcaa

SEQ ID NO: 6431 - DNA, 201 bp, Homo sapiens
aggagagagtacggaaccacatcatgcacttggaggaacatttattttgccagtatttttccaaaaatgccctagaaatagcctctgaaattctccaaacmcctgtcacagcatatgatctctacagccacacatcaatttggttgttgcgaacagactttgttttggactatcccaaacccgtgatgcccaatatgatct

SEQ ID NO: 6432 - DNA, 201 bp, Homo sapiens; identical to SEQ ID NO: 6383

SEQ ID NO: 6433 - DNA, 201 bp, Homo sapiens
tacggaaccacatcatgcacttggaggaacatttattttgccagtatttttccaaaaatgccctagaaatagcctctgaaattctccaaacacctgtcacrgcatatgatctctacagccacacatcaatttggttgttgcgaacagactttgttttggactatcccaaacccgtgatgcccaatatgatcttcattggtg

SEQ ID NO: 6434 - DNA, 201 bp, Homo sapiens
attggtggtatcaactgccatcagggaaagccattgcctatggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6435 - DNA, 201 bp, Homo sapiens; identical to SEQ ID NO: 6386

SEQ ID NO: 6436 - DNA, 201 bp, Homo sapiens; identical to SEQ ID NO: 6344

SEQ ID NO: 6437 - DNA, 201 bp, Homo sapiens; identical to SEQ ID NO: 6345

SEQ ID NO: 6438 - DNA, 104 bp, Homo sapiens
tggrgtcaggttttgtgctggtatttctcccacctactgtatcataggagcttagattcccagctgcttgctctcagctgcagttctctgatggcttgcacagg

SEQ ID NO: 6439 - DNA, 201 bp, Homo sapiens; identical to SEQ ID NO: 6346

SEQ ID NO: 6440 - DNA, 201 bp, Homo sapiens; identical to SEQ ID NO: 6347

SEQ ID NO: 6441 - DNA, 201 bp, Homo sapiens; identical to SEQ ID NO: 6349

SEQ ID NO: 6442 - DNA, 201 bp, Homo sapiens; identical to SEQ ID NO: 6351

SEQ ID NO: 6443 - DNA, 201 bp, Homo sapiens; identical to SEQ ID NO: 6352

SEQ ID NO: 6444 - DNA, 201 bp, Homo sapiens; identical to SEQ ID NO: 6353

SEQ ID NO: 6445 - DNA, 201 bp, Homo sapiens
tctgaaattctccaaacacctgttacggagtatgatctctacagccacacatcaatttggttgttgcgaacggactttgttttggactatcccaaacccgwgatgcccaacatgatcttcattggtggtatcaactgccatcagggaaagccgttgcctatggaatttgaagcctacattaatgcttctggagaacatgga

SEQ ID NO: 6446 - DNA, 201 bp, Homo sapiens; identical to SEQ ID NO: 6355

SEQ ID NO: 6447 - DNA, 201 bp, Homo sapiens; identical to SEQ ID NO: 6357

SEQ ID NO: 6448 - DNA, 201 bp, Homo sapiens; identical to SEQ ID NO: 6358

SEQ ID NO: 6449 - DNA, 201 bp, Homo sapiens; identical to SEQ ID NO: 6360

SEQ ID NO: 6450 - DNA, 201 bp, Homo sapiens; identical to SEQ ID NO: 6362

SEQ ID NO: 6451 - DNA, 201 bp, Homo sapiens; identical to SEQ ID NO: 6363

SEQ ID NO: 6452 - DNA, 201 bp, Homo sapiens; identical to SEQ ID NO: 6364

SEQ ID NO: 6453 - DNA, 201 bp, Homo sapiens; identical to SEQ ID NO: 6365

SEQ ID NO: 6454 - DNA, 201 bp, Homo sapiens; identical to SEQ ID NO: 6366

SEQ ID NO: 6455 - DNA, 201 bp, Homo sapiens; identical to SEQ ID NO: 6368

SEQ ID NO: 6456 - DNA, 201 bp, Homo sapiens; identical to SEQ ID NO: 6369

SEQ ID NO: 6457 - DNA, 201 bp, Homo sapiens; identical to SEQ ID NO: 6370

SEQ ID NO: 6458 - DNA, 201 bp, Homo sapiens; identical to SEQ ID NO: 6371

SEQ ID NO: 6459 - DNA, 201 bp, Homo sapiens; identical to SEQ ID NO: 6372

SEQ ID NO: 6460 - DNA, 201 bp, Homo sapiens; identical to SEQ ID NO: 6373

SEQ ID NO: 6461 - DNA, 201 bp, Homo sapiens
ctgatggcttgcacagggtggaccagcccccttcctctatgtgtgtgtctgctgctgacctgtggctttgccgaggcagggaagctactggtagtgcccayggatgggagccactggttcaccatgaggtcggtggtggagaaactcattctcagggggcatgaggtggttgtagtcatgccagaggtgagttggcaactg

SEQ ID NO: 6462 - DNA, 201 bp, Homo sapiens; identical to SEQ ID NO: 6376

SEQ ID NO: 6463 - DNA, 201 bp, Homo sapiens; identical to SEQ ID NO: 6375

SEQ ID NO: 6464 - DNA, 201 bp, Homo sapiens; identical to SEQ ID NO: 6377

SEQ ID NO: 6465 - DNA, 201 bp, Homo sapiens; identical to SEQ ID NO: 6378

SEQ ID NO: 6466 - DNA, 201 bp, Homo sapiens; identical to SEQ ID NO: 6383

SEQ ID NO: 6467 - DNA, 201 bp, Homo sapiens
attggtggtatcaactgccatcagggaaagccgttgcctatggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6468 - DNA, 201 bp, Homo sapiens; identical to SEQ ID NO: 6386

SEQ ID NO: 6469 - DNA, 201 bp, Homo sapiens; identical to SEQ ID NO: 6344

SEQ ID NO: 6470 - DNA, 201 bp, Homo sapiens; identical to SEQ ID NO: 6345

SEQ ID NO: 6471 - DNA, 201 bp, Homo sapiens; identical to SEQ ID NO: 6346

SEQ ID NO: 6472 - DNA, 201 bp, Homo sapiens
actacacaagaaaaatctatccagtgccgtatgaccaagaagagctgaagaaccgttaccaatcatttggaaacaatcactttgctgagcgatcattcctractgctcctcagacagagtacaggaataacatgattgttattggcctgtacttcatcaactgccagagcctcctgcaggacagggacaccctgaacttct

SEQ ID NO: 6473 - DNA, 201 bp, Homo sapiens; identical to SEQ ID NO: 6347

SEQ ID NO: 6474 - DNA, 201 bp, Homo sapiens
gttccctggagcatacattcagcagaagcccagaccctgtgtcctacattcccaggtgctacacaaagttttcagaccacatgactttttcccaacgagtkgccaacttccttgttaatttgttggagccctatctattttattgtctgttttcaaagtatgaagaactcgcatcagctgtcctcaagagagatgtggata

SEQ ID NO: 6475 - DNA, 201 bp, Homo sapiens
cagccttaccctgtggggtgatcctggctgagtatttgggcctaccatctgtgtacctcttcaggggttttccgtgttccctggagcatacattcagcagmagcccagaccctgtgtcctacattcccaggtgctacacaaagttttcagaccacatgactttttcccaacgagtggccaacttccttgttaatttgttgg

SEQ ID NO: 6476 - DNA, 201 bp, Homo sapiens; identical to SEQ ID NO: 6349

SEQ ID NO: 6477 - DNA, 201 bp, Homo sapiens
actctttattaccgttgttactttaactctttccaggatggcctgcctccttcgctcatttcagagaatttctgcaggggttttcttcttagcactttggkgcatggttgtaggtgacaagctgctggtggtccctcaggacggaagccactggcttagtatgaaggatatagttgaggttctcagtgaccggggtcatga

SEQ ID NO: 6478 - DNA, 201 bp, Homo sapiens; identical to SEQ ID NO: 6351

SEQ ID NO: 6479 - DNA, 201 bp, Homo sapiens; identical to SEQ ID NO: 6352

SEQ ID NO: 6480 - DNA, 201 bp, Homo sapiens
tttcacagacccagccttaccctgtggggtgatcctggctgagtatttgggcctaccatctgtgtacctcttcaggggttttccgtgttccctggagcatrcattcagcagaagcccagaccctgtgtcctacattcccaggtgctacacaaagttttcagaccacatgactttttcccaacgagtggccaacttccttgt

SEQ ID NO: 6481 - DNA, 201 bp, Homo sapiens
agtttagggaaaatacctaggagccctgtgatttggagagtgaaaactctttattaccgttgttactttaactctttccaggatggcctgcctccttcgckcatttcagagaatttctgcaggggttttcttcttagcactttggggcatggttgtaggtgacaagctgctggtggtccctcaggacggaagccactggct

SEQ ID NO: 6482 - DNA, 201 bp, Homo sapiens; identical to SEQ ID NO: 6353

SEQ ID NO: 6483 - DNA, 201 bp, Homo sapiens
agtgaaaactctttattaccgttgttactttaactctttccaggatggcctgcctccttcgctcatttcagagaatttctgcaggggttttcttcttagcwctttggggcatggttgtaggtgacaagctgctggtggtccctcaggacggaagccactggcttagtatgaaggatatagttgaggttctcagtgaccggg

SEQ ID NO: 6484 - DNA, 201 bp, Homo sapiens; identical to SEQ ID NO: 6355

SEQ ID NO: 6485 - DNA, 201 bp, Homo sapiens; identical to SEQ ID NO: 6357

SEQ ID NO: 6486 - DNA, 201 bp, Homo sapiens; identical to SEQ ID NO: 6358

SEQ ID NO: 6487 - DNA, 201 bp, Homo sapiens; identical to SEQ ID NO: 6362

SEQ ID NO: 6488 - DNA, 201 bp, Homo sapiens; identical to SEQ ID NO: 6360

SEQ ID NO: 6489 - DNA, 201 bp, Homo sapiens; identical to SEQ ID NO: 6363

SEQ ID NO: 6490 - DNA, 201 bp, Homo sapiens; identical to SEQ ID NO: 6364

SEQ ID NO: 6491 - DNA, 201 bp, Homo sapiens; identical to SEQ ID NO: 6365

SEQ ID NO: 6492 - DNA, 201 bp, Homo sapiens; identical to SEQ ID NO: 6368

SEQ ID NO: 6493 - DNA, 201 bp, Homo sapiens; identical to SEQ ID NO: 6366

SEQ ID NO: 6494 - DNA, 201 bp, Homo sapiens; identical to SEQ ID NO: 6369

SEQ ID NO: 6495 - DNA, 201 bp, Homo sapiens; identical to SEQ ID NO: 6370

SEQ ID NO: 6496 - DNA, 201 bp, Homo sapiens; identical to SEQ ID NO: 6371

SEQ ID NO: 6497 - DNA, 201 bp, Homo sapiens
agccactggcttagtatgaaggatatagttgaggttctcagtgaccggggtcatgagattgtagtggtggtgcctgaagttaatttgcttttgaaagaatmcaaatactacacaagaaaaatctatccagtgccgtatgaccaagaagagctgaagaaccgttaccaatcatttggaaacaatcactttgctgagcgatca

SEQ ID NO: 6498 - DNA, 201 bp, Homo sapiens; identical to SEQ ID NO: 6372

SEQ ID NO: 6499 - DNA, 201 bp, Homo sapiens; identical to SEQ ID NO: 6373

SEQ ID NO: 6500 - DNA, 201 bp, Homo sapiens; identical to SEQ ID NO: 6375

SEQ ID NO: 6501 - DNA, 201 bp, Homo sapiens; identical to SEQ ID NO: 6376

SEQ ID NO: 6502 - DNA, 201 bp, Homo sapiens; identical to SEQ ID NO: 6377

SEQ ID NO: 6503 - DNA, 201 bp, Homo sapiens; identical to SEQ ID NO: 6378

SEQ ID NO: 6504 - DNA, 201 bp, Homo sapiens; identical to SEQ ID NO: 6383

SEQ ID NO: 6505 - DNA, 201 bp, Homo sapiens
attggaggtatcaactgtaagaagaggaaagacttgtctcaggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6506 - DNA, 201 bp, Homo sapiens; identical to SEQ ID NO: 6386

SEQ ID NO: 6507 - DNA, 201 bp, Homo sapiens; identical to SEQ ID NO: 6366

SEQ ID NO: 6508 - DNA, 201 bp, Homo sapiens; identical to SEQ ID NO: 6368

SEQ ID NO: 6509 - DNA, 201 bp, Homo sapiens; identical to SEQ ID NO: 6369

SEQ ID NO: 6510 - DNA, 201 bp, Homo sapiens; identical to SEQ ID NO: 6370

SEQ ID NO: 6511 - DNA, 201 bp, Homo sapiens; identical to SEQ ID NO: 6344

SEQ ID NO: 6512 - DNA, 201 bp, Homo sapiens; identical to SEQ ID NO: 6371

SEQ ID NO: 6513 - DNA, 201 bp, Homo sapiens; identical to SEQ ID NO: 6345

SEQ ID NO: 6514 - DNA, 201 bp, Homo sapiens; identical to SEQ ID NO: 6346

SEQ ID NO: 6515 - DNA, 201 bp, Homo sapiens
ccgttcctttatgtgtgtgtctactgctgacctgtggctttgccgaggcagggaagctgctggtagtgcccatggatgggagtcactggttcaccatgcartcggtggtggagaaacttatcctcagggggcatgaggtggttgtagtcatgccagaggtgagttggcaactggaaagatcactgaattgcacagtgaaga

SEQ ID NO: 6516 - DNA, 201 bp, Homo sapiens; identical to SEQ ID NO: 6347

SEQ ID NO: 6517 - DNA, 201 bp, Homo sapiens
cagatgccatgactttcaaggagagagtatggaaccacatcgtgcacttggaggaccatttattttgccagtatctttttagaaatgccctagaaatagcytctgaaattctccaaacccctgtcacggcatatgatctctacagtcacacatcaatttggttgttgcgaacggactttgttttggactatcccaaacccg

SEQ ID NO: 6518 - DNA, 201 bp, Homo sapiens
catcgtgcacttggaggaccatttattttgccagtatctttttagaaatgccctagaaatagcctctgaaattctccaaacccctgtcacggcatatgatmtctacagtcacacatcaatttggttgttgcgaacggactttgttttggactatcccaaacccgtgatgcccaacatgatcttcattggtggtatcaactg

SEQ ID NO: 6519 - DNA, 201 bp, Homo sapiens; identical to SEQ ID NO: 6349

SEQ ID NO: 6520 - DNA, 201 bp, Homo sapiens; identical to SEQ ID NO: 6372

SEQ ID NO: 6521 - DNA, 201 bp, Homo sapiens; identical to SEQ ID NO: 6373

SEQ ID NO: 6522 - DNA, 201 bp, Homo sapiens; identical to SEQ ID NO: 6351

SEQ ID NO: 6523 - DNA, 201 bp, Homo sapiens; identical to SEQ ID NO: 6352

SEQ ID NO: 6524 - DNA, 201 bp, Homo sapiens; identical to SEQ ID NO: 6353

SEQ ID NO: 6525 - DNA, 201 bp, Homo sapiens; identical to SEQ ID NO: 6376

SEQ ID NO: 6526 - DNA, 201 bp, Homo sapiens; identical to SEQ ID NO: 6375

SEQ ID NO: 6527 - DNA, 201 bp, Homo sapiens; identical to SEQ ID NO: 6377

SEQ ID NO: 6528 - DNA, 201 bp, Homo sapiens; identical to SEQ ID NO: 6378

SEQ ID NO: 6529 - DNA, 201 bp, Homo sapiens
ccagtatctttttagaaatgccctagaaatagcctctgaaattctccaaacccctgtcacggcatatgatctctacagtcacacatcaatttggttgttgygaacggactttgttttggactatcccaaacccgtgatgcccaacatgatcttcattggtggtatcaactgtcatcagggaaagccattgcctatggaatt

SEQ ID NO: 6530 - DNA, 201 bp, Homo sapiens; identical to SEQ ID NO: 6355

SEQ ID NO: 6531 - DNA, 201 bp, Homo sapiens; identical to SEQ ID NO: 6357

SEQ ID NO: 6532 - DNA, 201 bp, Homo sapiens; identical to SEQ ID NO: 6383

SEQ ID NO: 6533 - DNA, 201 bp, Homo sapiens; identical to SEQ ID NO: 6358

SEQ ID NO: 6534 - DNA, 201 bp, Homo sapiens
tggtcttcaccaggggaatattttgccaccatcttgaagaaggtgcacagtgccctgctcctctttcctatgtccccaatgatctcttagggttctcagaygccatgactttcaaggagagagtatggaaccacatcgtgcacttggaggaccatttattttgccagtatctttttagaaatgccctagaaatagcctctg

SEQ ID NO: 6535 - DNA, 201 bp, Homo sapiens
attggtggtatcaactgtcatcagggaaagccattgcctatggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6536 - DNA, 201 bp, Homo sapiens; identical to SEQ ID NO: 6360

SEQ ID NO: 6537 - DNA, 201 bp, Homo sapiens; identical to SEQ ID NO: 6362

SEQ ID NO: 6538 - DNA, 201 bp, Homo sapiens; identical to SEQ ID NO: 6386

SEQ ID NO: 6539 - DNA, 201 bp, Homo sapiens; identical to SEQ ID NO: 6363

SEQ ID NO: 6540 - DNA, 201 bp, Homo sapiens; identical to SEQ ID NO: 6364

SEQ ID NO: 6541 - DNA, 201 bp, Homo sapiens; identical to SEQ ID NO: 6365

SEQ ID NO: 6542 - DNA, 201 bp, Homo sapiens; identical to SEQ ID NO: 6344

SEQ ID NO: 6543 - DNA, 201 bp, Homo sapiens; identical to SEQ ID NO: 6345

SEQ ID NO: 6544 - DNA, 201 bp, Homo sapiens; identical to SEQ ID NO: 6346

SEQ ID NO: 6545 - DNA, 201 bp, Homo sapiens; identical to SEQ ID NO: 6347

SEQ ID NO: 6546 - DNA, 201 bp, Homo sapiens; identical to SEQ ID NO: 6349

SEQ ID NO: 6547 - DNA, 201 bp, Homo sapiens; identical to SEQ ID NO: 6351

SEQ ID NO: 6548 - DNA, 201 bp, Homo sapiens; identical to SEQ ID NO: 6352

SEQ ID NO: 6549 - DNA, 201 bp, Homo sapiens; identical to SEQ ID NO: 6353

SEQ ID NO: 6550 - DNA, 201 bp, Homo sapiens; identical to SEQ ID NO: 6355

SEQ ID NO: 6551 - DNA, 201 bp, Homo sapiens; identical to SEQ ID NO: 6357

SEQ ID NO: 6552 - DNA, 201 bp, Homo sapiens; identical to SEQ ID NO: 6358

SEQ ID NO: 6553 - DNA, 201 bp, Homo sapiens
acaggactgctgcttctcctcagtgtccagccctgggctgagagtggaaaggtgttggtggtgcccattgatggcagccactggctcagcatgcgggaggycttgcgggagctccatgccagaggccaccaggcagtggtcctcaccccagaggtgaatatgcacatcaaagaagagaactttttcaccctgacaacctat

SEQ ID NO: 6554 - DNA, 181 bp, Homo sapiens
atggccacaggactccaggttcccctgccgtggctggccacaggactgctgcttctcctcagtgtccagccctgggctgaragtggaaaggtgttggtggtgcccattgatggcagccactggctcagcatgcgggaggtcttgcgggagctccatgccagaggccaccaggcagtggtcc

SEQ ID NO: 6555 - DNA, 201 bp, Homo sapiens; identical to SEQ ID NO: 6360

SEQ ID NO: 6556 - DNA, 201 bp, Homo sapiens; identical to SEQ ID NO: 6362

SEQ ID NO: 6557 - DNA, 201 bp, Homo sapiens
tattcctagattactaacaaccaattcagaccacatgacattcatgcaaagggtcaagaacatgctctaccctctggccctgtcctacatttgccatgctktttctgctccttatgcaagccttgcctctgagctttttcagagagaggtgtcagtggtggatattctcagtcatgcatctgtgtggctgttccgagggga

SEQ ID NO: 6558 - DNA, 201 bp, Homo sapiens; identical to SEQ ID NO: 6363

SEQ ID NO: 6559 - DNA, 201 bp, Homo sapiens; identical to SEQ ID NO: 6364

SEQ ID NO: 6560 - DNA, 201 bp, Homo sapiens; identical to SEQ ID NO: 6365

SEQ ID NO: 6561 - DNA, 201 bp, Homo sapiens; identical to SEQ ID NO: 6368

SEQ ID NO: 6562 - DNA, 201 bp, Homo sapiens; identical to SEQ ID NO: 6366

SEQ ID NO: 6563 - DNA, 201 bp, Homo sapiens; identical to SEQ ID NO: 6369

SEQ ID NO: 6564 - DNA, 201 bp, Homo sapiens; identical to SEQ ID NO: 6370

SEQ ID NO: 6565 - DNA, 201 bp, Homo sapiens; identical to SEQ ID NO: 6371

SEQ ID NO: 6566 - DNA, 201 bp, Homo sapiens; identical to SEQ ID NO: 6372

SEQ ID NO: 6567 - DNA, 201 bp, Homo sapiens; identical to SEQ ID NO: 6373

SEQ ID NO: 6568 - DNA, 201 bp, Homo sapiens
tgagctttttcagagagaggtgtcagtggtggatattctcagtcatgcatctgtgtggctgttccgaggggactttgtgatggactaccccaggccaatcrtgcccaacatggtcttcattgggggcatcaactgtgccaacaggaagccactatctcaggaatttgaagcctacattaatgcttctggagaacatggaat

SEQ ID NO: 6569 - DNA, 201 bp, Homo sapiens; identical to SEQ ID NO: 6375

SEQ ID NO: 6570 - DNA, 201 bp, Homo sapiens; identical to SEQ ID NO: 6376

SEQ ID NO: 6571 - DNA, 201 bp, Homo sapiens; identical to SEQ ID NO: 6378

SEQ ID NO: 6572 - DNA, 201 bp, Homo sapiens; identical to SEQ ID NO: 6377

SEQ ID NO: 6573 - DNA, 131 bp, Homo sapiens
atggccacaggactccaggttcccctgccgyggctggccacaggactgctgcttctcctcagtgtccagccctgggctgagagtggaaaggtgttggtggtgcccattgatggcagccactggctcagcat

SEQ ID NO: 6574 - DNA, 201 bp, Homo sapiens; identical to SEQ ID NO: 6383

SEQ ID NO: 6575 - DNA, 201 bp, Homo sapiens
ggtcttgtgtggagctactacataatgaggccctgatcaggcacctgaatgctacttcctttgatgtggttttaacagaccccgttaacctctgcgcggcrgtgctggctaagtacctgtcgattcctactgtgttttttttgaggaacattccatgtgatttagactttaagggcacacagtgtccaaacccttcctcct

SEQ ID NO: 6576 - DNA, 201 bp, Homo sapiens
attgggggcatcaactgtgccaacaggaagccactatctcaggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6577 - DNA, 201 bp, Homo sapiens; identical to SEQ ID NO: 6386

SEQ ID NO: 6578 - DNA, 201 bp, Homo sapiens
ctcgctggacggcaccattgcgaagtgcattttctctattaacaagttcatccaatggtatttttgacttatttttttcaaattgcaggagtttgtttaakgacaaaaaattagtagaatacttaaaggagagttgttttgatgcagtgtttctcgatccttttgatgcctgtggcttaattgttgccaaatatttctccc

SEQ ID NO: 6579 - DNA, 133 bp, Homo sapiens
atggctcgtgcagggtggactggcctccttccmctatatgtgtgtctactgctgacctgtggctttgccaaggcagggaagctgctggtagtgcccatggatgggagccactggttcaccatgcagtcggtgg

SEQ ID NO: 6580 - DNA, 201 bp, Homo sapiens; identical to SEQ ID NO: 6344

SEQ ID NO: 6581 - DNA, 201 bp, Homo sapiens; identical to SEQ ID NO: 6345

SEQ ID NO: 6582 - DNA, 201 bp, Homo sapiens; identical to SEQ ID NO: 6346

SEQ ID NO: 6583 - DNA, 201 bp, Homo sapiens; identical to SEQ ID NO: 6347

SEQ ID NO: 6584 - DNA, 201 bp, Homo sapiens; identical to SEQ ID NO: 6349

SEQ ID NO: 6585 - DNA, 201 bp, Homo sapiens; identical to SEQ ID NO: 6351

SEQ ID NO: 6586 - DNA, 201 bp, Homo sapiens; identical to SEQ ID NO: 6352

SEQ ID NO: 6587 - DNA, 201 bp, Homo sapiens; identical to SEQ ID NO: 6353

SEQ ID NO: 6588 - DNA, 201 bp, Homo sapiens; identical to SEQ ID NO: 6355

SEQ ID NO: 6589 - DNA, 201 bp, Homo sapiens; identical to SEQ ID NO: 6357

SEQ ID NO: 6590 - DNA, 201 bp, Homo sapiens; identical to SEQ ID NO: 6358

SEQ ID NO: 6591 - DNA, 201 bp, Homo sapiens; identical to SEQ ID NO: 6360

SEQ ID NO: 6592 - DNA, 201 bp, Homo sapiens; identical to SEQ ID NO: 6362

SEQ ID NO: 6593 - DNA, 201 bp, Homo sapiens; identical to SEQ ID NO: 6363

SEQ ID NO: 6594 - DNA, 201 bp, Homo sapiens; identical to SEQ ID NO: 6364

SEQ ID NO: 6595 - DNA, 201 bp, Homo sapiens; identical to SEQ ID NO: 6365

SEQ ID NO: 6596 - DNA, 201 bp, Homo sapiens; identical to SEQ ID NO: 6368

SEQ ID NO: 6597 - DNA, 201 bp, Homo sapiens; identical to SEQ ID NO: 6366

SEQ ID NO: 6598 - DNA, 201 bp, Homo sapiens; identical to SEQ ID NO: 6369

SEQ ID NO: 6599 - DNA, 201 bp, Homo sapiens; identical to SEQ ID NO: 6370

SEQ ID NO: 6600 - DNA, 201 bp, Homo sapiens; identical to SEQ ID NO: 6371

SEQ ID NO: 6601 - DNA, 201 bp, Homo sapiens
tcgtagtcatgccagaggtgagttggcaactgggaagatcactgaattgcacagtgaagacttactcaacctcatacactctggaggatcaggaccgggarttcatggtttttgccgatgctcgctggacggcaccattgcgaagtgcattttctctattaacaagttcatccaatggtatttttgacttatttttttcaa

SEQ ID NO: 6602 - DNA, 201 bp, Homo sapiens; identical to SEQ ID NO: 6372

SEQ ID NO: 6603 - DNA, 201 bp, Homo sapiens; identical to SEQ ID NO: 6373

SEQ ID NO: 6604 - DNA, 201 bp, Homo sapiens; identical to SEQ ID NO: 6376

SEQ ID NO: 6605 - DNA, 201 bp, Homo sapiens; identical to SEQ ID NO: 6375

SEQ ID NO: 6606 - DNA, 201 bp, Homo sapiens
cactctggaggatcaggaccgggagttcatggtttttgccgatgctcgctggacggcaccattgcgaagtgcattttctctattaacaagttcatccaatrgtatttttgacttatttttttcaaattgcaggagtttgtttaaggacaaaaaattagtagaatacttaaaggagagttgttttgatgcagtgtttctcga

SEQ ID NO: 6607 - DNA, 201 bp, Homo sapiens; identical to SEQ ID NO: 6378

SEQ ID NO: 6608 - DNA, 201 bp, Homo sapiens; identical to SEQ ID NO: 6377

SEQ ID NO: 6609 - DNA, 201 bp, Homo sapiens
gtgcagggtggactggcctccttccactatatgtgtgtctactgctgacctgtggctttgccaaggcagggaagctgctggtagtgcccatggatgggagycactggttcaccatgcagtcggtggtggagaaactcatcctcagggggcatgaggtggtcgtagtcatgccagaggtgagttggcaactgggaagatcac

SEQ ID NO: 6610 - DNA, 201 bp, Homo sapiens
ctattaacaagttcatccaatggtatttttgacttatttttttcaaattgcaggagtttgtttaaggacaaaaaattagtagaatacttaaaggagagttsttttgatgcagtgtttctcgatccttttgatgcctgtggcttaattgttgccaaatatttctccctcccctctgtggtcttcgccaggggaatattttgc

SEQ ID NO: 6611 - DNA, 201 bp, Homo sapiens; identical to SEQ ID NO: 6383

SEQ ID NO: 6612 - DNA, 201 bp, Homo sapiens
tttgcccctattttttcaaaaatgtcttagaaatagcctctgaaattctccaaacccctgtcacggcatatgatctctacagccacacatcaatttggttrttgcgaactgactttgttttggagtatcccaaacccgtgatgcccaatatgatcttcattggtggtatcaactgtcatcagggaaagccagtgcctatgg

SEQ ID NO: 6613 - DNA, 201 bp, Homo sapiens
ccaaggcagggaagctgctggtagtgcccatggatgggagccactggttcaccatgcagtcggtggtggagaaactcatcctcagggggcatgaggtggtsgtagtcatgccagaggtgagttggcaactgggaagatcactgaattgcacagtgaagacttactcaacctcatacactctggaggatcaggaccgggagt

SEQ ID NO: 6614 - DNA, 201 bp, Homo sapiens
ccactatcttgaagaaggtgcacagtgccctgctcctctttcctatgtccccagacttctcttagggttctcagacgccatgactttcaaggagagagtayggaaccacatcatgcacttggaggaacatttattttgcccctattttttcaaaaatgtcttagaaatagcctctgaaattctccaaacccctgtcacggc

SEQ ID NO: 6615 - DNA, 201 bp, Homo sapiens
attggtggtatcaactgtcatcagggaaagccagtgcctatggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6616 - DNA, 201 bp, Homo sapiens
tggacggcaccattgcgaagtgcattttctctattaacaagttcatccaatggtatttttgacttatttttttcaaattgcaggagtttgtttaaggacaraaaattagtagaatacttaaaggagagttgttttgatgcagtgtttctcgatccttttgatgcctgtggcttaattgttgccaaatatttctccctcccc

SEQ ID NO: 6617 - DNA, 201 bp, Homo sapiens; identical to SEQ ID NO: 6386

SEQ ID NO: 6618 - DNA, 201 bp, Homo sapiens
ctggacggcaccattgcgaagtgcattttctctattaacaagttcatccaatggtatttttgacttatttttttcaaattgcaggagtttgtttaaggacmaaaaattagtagaatacttaaaggagagttgttttgatgcagtgtttctcgatccttttgatgcctgtggcttaattgttgccaaatatttctccctccc

SEQ ID NO: 6619 - DNA, 201 bp, Homo sapiens; identical to SEQ ID NO: 6344

SEQ ID NO: 6620 - DNA, 201 bp, Homo sapiens; identical to SEQ ID NO: 6345

SEQ ID NO: 6621 - DNA, 201 bp, Homo sapiens; identical to SEQ ID NO: 6346

SEQ ID NO: 6622 - DNA, 201 bp, Homo sapiens; identical to SEQ ID NO: 6347

SEQ ID NO: 6623 - DNA, 201 bp, Homo sapiens; identical to SEQ ID NO: 6349

SEQ ID NO: 6624 - DNA, 201 bp, Homo sapiens; identical to SEQ ID NO: 6351

SEQ ID NO: 6625 - DNA, 201 bp, Homo sapiens; identical to SEQ ID NO: 6352

SEQ ID NO: 6626 - DNA, 201 bp, Homo sapiens
agtgtccaaacccttcctcctatattcctagattactaacgaccaattcagaccacatgacattcctgcaaagggtcaagaacatgctctaccctctggcyctgtcctacctttgccatgctgtttctgctccttatgcaagccttgcctctgagctttttcagagagaggtgtcagtggtggatcttgtcagccatgcat

SEQ ID NO: 6627 - DNA, 201 bp, Homo sapiens; identical to SEQ ID NO: 6353

SEQ ID NO: 6628 - DNA, 201 bp, Homo sapiens
ctaccctctggccctgtcctacctttgccatgctgtttctgctccttatgcaagccttgcctctgagctttttcagagagaggtgtcagtggtggatcttstcagccatgcatctgtgtggctgttccgaggggactttgtgatggactaccccaggccgatcatgcccaacatggtcttcattgggggcatcaactgtgc

SEQ ID NO: 6629 - DNA, 201 bp, Homo sapiens; identical to SEQ ID NO: 6355

SEQ ID NO: 6630 - DNA, 201 bp, Homo sapiens; identical to SEQ ID NO: 6357

SEQ ID NO: 6631 - DNA, 201 bp, Homo sapiens
gctctaccctctggccctgtcctacctttgccatgctgtttctgctccttatgcaagccttgcctctgagctttttcagagagaggtgtcagtggtggatmttgtcagccatgcatctgtgtggctgttccgaggggactttgtgatggactaccccaggccgatcatgcccaacatggtcttcattgggggcatcaactg

SEQ ID NO: 6632 - DNA, 201 bp, Homo sapiens; identical to SEQ ID NO: 6358

SEQ ID NO: 6633 - DNA, 201 bp, Homo sapiens
tgctgtttctgctccttatgcaagccttgcctctgagctttttcagagagaggtgtcagtggtggatcttgtcagccatgcatctgtgtggctgttccgasgggactttgtgatggactaccccaggccgatcatgcccaacatggtcttcattgggggcatcaactgtgccaacgggaagccactatctcaggaatttga

SEQ ID NO: 6634 - DNA, 201 bp, Homo sapiens
ctgctccttatgcaagccttgcctctgagctttttcagagagaggtgtcagtggtggatcttgtcagccatgcatctgtgtggctgttccgaggggacttygtgatggactaccccaggccgatcatgcccaacatggtcttcattgggggcatcaactgtgccaacgggaagccactatctcaggaatttgaagcctaca

SEQ ID NO: 6635 - DNA, 201 bp, Homo sapiens; identical to SEQ ID NO: 6362

SEQ ID NO: 6636 - DNA, 201 bp, Homo sapiens; identical to SEQ ID NO: 6360

SEQ ID NO: 6637 - DNA, 201 bp, Homo sapiens; identical to SEQ ID NO: 6363

SEQ ID NO: 6638 - DNA, 201 bp, Homo sapiens; identical to SEQ ID NO: 6364

SEQ ID NO: 6639 - DNA, 201 bp, Homo sapiens; identical to SEQ ID NO: 6365

SEQ ID NO: 6640 - DNA, 201 bp, Homo sapiens; identical to SEQ ID NO: 6366

SEQ ID NO: 6641 - DNA, 201 bp, Homo sapiens; identical to SEQ ID NO: 6368

SEQ ID NO: 6642 - DNA, 201 bp, Homo sapiens; identical to SEQ ID NO: 6369

SEQ ID NO: 6643 - DNA, 201 bp, Homo sapiens; identical to SEQ ID NO: 6370

SEQ ID NO: 6644 - DNA, 201 bp, Homo sapiens; identical to SEQ ID NO: 6371

SEQ ID NO: 6645 - DNA, 201 bp, Homo sapiens; identical to SEQ ID NO: 6372

SEQ ID NO: 6646 - DNA, 201 bp, Homo sapiens
gaaattttctagaagaatggcaattatgaacaatatgtctttgatcatacataggtcttgtgtggagctactgcataatgaggccctgatcaggcacctgmatgctacttcctttgatgtggttctaacagacccctttcacctctgcgcggcggtgctggctaagtacctgtcgattcctgctgtgtttttcttgaggaa

SEQ ID NO: 6647 - DNA, 201 bp, Homo sapiens; identical to SEQ ID NO: 6373

SEQ ID NO: 6648 - DNA, 201 bp, Homo sapiens
gcagccactggctcagcatgcgggaggccttgcgggacctccatgcgagaggccaccaggtggtggtcctcaccctggaggtgaatatgtacatcaaagargagaactttttcaccctgacaacgtatgccatttcatggacccaggacgaatttgatcgccttttgctgggtcacactcaatcgttctttgaaacagaac

SEQ ID NO: 6649 - DNA, 201 bp, Homo sapiens; identical to SEQ ID NO: 6376

SEQ ID NO: 6650 - DNA, 201 bp, Homo sapiens; identical to SEQ ID NO: 6375

SEQ ID NO: 6651 - DNA, 201 bp, Homo sapiens; identical to SEQ ID NO: 6377

SEQ ID NO: 6652 - DNA, 201 bp, Homo sapiens; identical to SEQ ID NO: 6378

SEQ ID NO: 6653 - DNA, 201 bp, Homo sapiens
ggactgctgcttctcctcagtgtccagccctgggctgagagtgggaaggtgctggtggtgcccactgatggcagccactggctcagcatgcgggaggcctygcgggacctccatgcgagaggccaccaggtggtggtcctcaccctggaggtgaatatgtacatcaaagaagagaactttttcaccctgacaacgtatgcc

SEQ ID NO: 6654 - DNA, 201 bp, Homo sapiens
tgcttctcctcagtgtccagccctgggctgagagtgggaaggtgctggtggtgcccactgatggcagccactggctcagcatgcgggaggccttgcgggasctccatgcgagaggccaccaggtggtggtcctcaccctggaggtgaatatgtacatcaaagaagagaactttttcaccctgacaacgtatgccatttcat

SEQ ID NO: 6655 - DNA, 201 bp, Homo sapiens
aaggtgctggtggtgcccactgatggcagccactggctcagcatgcgggaggccttgcgggacctccatgcgagaggccaccaggtggtggtcctcacccyggaggtgaatatgtacatcaaagaagagaactttttcaccctgacaacgtatgccatttcatggacccaggacgaatttgatcgccttttgctgggtcac

SEQ ID NO: 6656 - DNA, 201 bp, Homo sapiens
ctcctatattcctagattactaacgaccaattcagaccacatgacattcctgcaaagggtcaagaacatgctctaccctctggccctgtcctacctttgcyatgctgtttctgctccttatgcaagccttgcctctgagctttttcagagagaggtgtcagtggtggatcttgtcagccatgcatctgtgtggctgttccg

SEQ ID NO: 6657 - DNA, 201 bp, Homo sapiens
atgcaagccttgcctctgagctttttcagagagaggtgtcagtggtggatcttgtcagccatgcatctgtgtggctgttccgaggggactttgtgatggaytaccccaggccgatcatgcccaacatggtcttcattgggggcatcaactgtgccaacgggaagccactatctcaggaatttgaagcctacattaatgctt

SEQ ID NO: 6658 - DNA, 201 bp, Homo sapiens; identical to SEQ ID NO: 6383

SEQ ID NO: 6659 - DNA, 201 bp, Homo sapiens; identical to SEQ ID NO: 6385

SEQ ID NO: 6660 - DNA, 201 bp, Homo sapiens; identical to SEQ ID NO: 6386

SEQ ID NO: 6661 - DNA, 186 bp, Homo sapiens
ataagtaggagagggcgaacctctggcaggagcaaaggcgccatggctgtggagtcccagggcggacgcccacttgtcctgggcckgctgctgtgtgtgctgggcccagtggtgtcccatgctgggaagatactgttgatcccagtggatggcagccactggctgagcatgcttggggccatccag

SEQ ID NO: 6662 - DNA, 201 bp, Homo sapiens; identical to SEQ ID NO: 6344

SEQ ID NO: 6663 - DNA, 201 bp, Homo sapiens; identical to SEQ ID NO: 6345

SEQ ID NO: 6664 - DNA, 201 bp, Homo sapiens; identical to SEQ ID NO: 6346

SEQ ID NO: 6665 - DNA, 201 bp, Homo sapiens; identical to SEQ ID NO: 6347

SEQ ID NO: 6666 - DNA, 201 bp, Homo sapiens; identical to SEQ ID NO: 6349

SEQ ID NO: 6667 - DNA, 201 bp, Homo sapiens
gctgcagcagaggggacatgaaatagttgtcctagcacctgacgcctcgttgtacatcagagacggagcattttacaccttgaagacgtaccctgtgccaytccaaagggaggatgtgaaagagtcttttgttagtctcgggcataatgtttttgagaatgattctttcctgcagcgtgtgatcaaaacatacaagaaaat

SEQ ID NO: 6668 - DNA, 201 bp, Homo sapiens
tacgtgcccaggcctctctcctctcattcagatcacatgaccttcctgcagcgggtgaagaacatgctcattgccttttcacagaactttctgtgcgacgkggtttattccccgtatgcaacccttgcctcagaattccttcagagagaggtgactgtccaggacctattgagctctgcatctgtctggctgtttagaagt

SEQ ID NO: 6669 - DNA, 201 bp, Homo sapiens; identical to SEQ ID NO: 6351

SEQ ID NO: 6670 - DNA, 201 bp, Homo sapiens; identical to SEQ ID NO: 6352

SEQ ID NO: 6671 - DNA, 201 bp, Homo sapiens; identical to SEQ ID NO: 6353

SEQ ID NO: 6672 - DNA, 201 bp, Homo sapiens
cagccactggctgagcatgcttggggccatccagcagctgcagcagaggggacatgaaatagttgtcctagcacctgacgcctcgttgtacatcagagacrgagcattttacaccttgaagacgtaccctgtgccattccaaagggaggatgtgaaagagtcttttgttagtctcgggcataatgtttttgagaatgattc

SEQ ID NO: 6673 - DNA, 201 bp, Homo sapiens
gctgctgtgtgtgctgggcccagtggtgtcccatgctgggaagatactgttgatcccagtggatggcagccactggctgagcatgcttggggccatccagyagctgcagcagaggggacatgaaatagttgtcctagcacctgacgcctcgttgtacatcagagacggagcattttacaccttgaagacgtaccctgtgcc

SEQ ID NO: 6674 - DNA, 201 bp, Homo sapiens; identical to SEQ ID NO: 6355

SEQ ID NO: 6675 - DNA, 201 bp, Homo sapiens; identical to SEQ ID NO: 6357

SEQ ID NO: 6676 - DNA, 201 bp, Homo sapiens; identical to SEQ ID NO: 6358

SEQ ID NO: 6677 - DNA, 201 bp, Homo sapiens
tgagcatgcttggggccatccagcagctgcagcagaggggacatgaaatagttgtcctagcacctgacgcctcgttgtacatcagagacggagcattttamaccttgaagacgtaccctgtgccattccaaagggaggatgtgaaagagtcttttgttagtctcgggcataatgtttttgagaatgattctttcctgcagc

SEQ ID NO: 6678 - DNA, 201 bp, Homo sapiens; identical to SEQ ID NO: 6362

SEQ ID NO: 6679 - DNA, 201 bp, Homo sapiens; identical to SEQ ID NO: 6360

SEQ ID NO: 6680 - DNA, 201 bp, Homo sapiens; identical to SEQ ID NO: 6363

SEQ ID NO: 6681 - DNA, 201 bp, Homo sapiens; identical to SEQ ID NO: 6364

SEQ ID NO: 6682 - DNA, 201 bp, Homo sapiens; identical to SEQ ID NO: 6365

SEQ ID NO: 6683 - DNA, 201 bp, Homo sapiens; identical to SEQ ID NO: 6366

SEQ ID NO: 6684 - DNA, 201 bp, Homo sapiens; identical to SEQ ID NO: 6368

SEQ ID NO: 6685 - DNA, 201 bp, Homo sapiens
ccagggcggacgcccacttgtcctgggcctgctgctgtgtgtgctgggcccagtggtgtcccatgctgggaagatactgttgatcccagtggatggcagcsactggctgagcatgcttggggccatccagcagctgcagcagaggggacatgaaatagttgtcctagcacctgacgcctcgttgtacatcagagacggagc

SEQ ID NO: 6686 - DNA, 201 bp, Homo sapiens; identical to SEQ ID NO: 6369

SEQ ID NO: 6687 - DNA, 201 bp, Homo sapiens
gccatgcagcctggaatttgaggctacccagtgccccaacccattctcctacgtgcccaggcctctctcctctcattcagatcacatgaccttcctgcagygggtgaagaacatgctcattgccttttcacagaactttctgtgcgacgtggtttattccccgtatgcaacccttgcctcagaattccttcagagagaggt

SEQ ID NO: 6688 - DNA, 201 bp, Homo sapiens; identical to SEQ ID NO: 6370

SEQ ID NO: 6689 - DNA, 201 bp, Homo sapiens; identical to SEQ ID NO: 6371

SEQ ID NO: 6690 - DNA, 201 bp, Homo sapiens
cctctctcctctcattcagatcacatgaccttcctgcagcgggtgaagaacatgctcattgccttttcacagaactttctgtgcgacgtggtttattcccmgtatgcaacccttgcctcagaattccttcagagagaggtgactgtccaggacctattgagctctgcatctgtctggctgtttagaagtgactttgtgaag

SEQ ID NO: 6691 - DNA, 201 bp, Homo sapiens
cagctttgatgtcatgctgacggaccctttccttccttgcagccccatcgtggcccagtacctgtctctgcccactgtattcttcttgcatgcactgccaygcagcctggaatttgaggctacccagtgccccaacccattctcctacgtgcccaggcctctctcctctcattcagatcacatgaccttcctgcagcgggt

SEQ ID NO: 6692 - DNA, 201 bp, Homo sapiens; identical to SEQ ID NO: 6372

SEQ ID NO: 6693 - DNA, 201 bp, Homo sapiens; identical to SEQ ID NO: 6373

SEQ ID NO: 6694 - DNA, 201 bp, Homo sapiens; identical to SEQ ID NO: 6375

SEQ ID NO: 6695 - DNA, 201 bp, Homo sapiens; identical to SEQ ID NO: 6376

SEQ ID NO: 6696 - DNA, 201 bp, Homo sapiens; identical to SEQ ID NO: 6377

SEQ ID NO: 6697 - DNA, 201 bp, Homo sapiens; identical to SEQ ID NO: 6378

SEQ ID NO: 6698 - DNA, 201 bp, Homo sapiens
gcctgctgctgtgtgtgctgggcccagtggtgtcccatgctgggaagatactgttgatcccagtggatggcagccactggctgagcatgcttggggccatycagcagctgcagcagaggggacatgaaatagttgtcctagcacctgacgcctcgttgtacatcagagacggagcattttacaccttgaagacgtaccctg

SEQ ID NO: 6699 - DNA, 201 bp, Homo sapiens
cttttcacagaactttctgtgcgacgtggtttattccccgtatgcaacccttgcctcagaattccttcagagagaggtgactgtccaggacctattgagcyctgcatctgtctggctgtttagaagtgactttgtgaaggattaccctaggcccatcatgcccaatatggtttttgttggtggaatcaactgccttcacca

SEQ ID NO: 6700 - DNA, 201 bp, Homo sapiens
gaaagcagctttgatgtcatgctgacggaccctttccttccttgcagccccatcgtggcccagtacctgtctctgcccactgtattcttcttgcatgcacwgccatgcagcctggaatttgaggctacccagtgccccaacccattctcctacgtgcccaggcctctctcctctcattcagatcacatgaccttcctgcag

SEQ ID NO: 6701 - DNA, 201 bp, Homo sapiens; identical to SEQ ID NO: 6383

SEQ ID NO: 6702 - DNA, 201 bp, Homo sapiens
gttggtggaatcaactgccttcaccaaaatccactatcccaggaatttgaagcctacattaatgcttctggagaacatggaattgtggttttctctttggratcaatggtctcagaaattccagagaagaaagctatggcaattgctgatgctttgggcaaaatccctcagacagtcctgtggcggtacactggaacccga

SEQ ID NO: 6703 - DNA, 201 bp, Homo sapiens; identical to SEQ ID NO: 6386

SEQ ID NO: 6704 - DNA, 201 bp, Homo sapiens
ggctgtgctgcttctgttcaggtgtgccactggtgaggcatggcaggagataatgcttgccagccttcccggaaatcggtgtgatcctgagtctgacttcrgccctggtgaagagtttacctgtggtagcaattttgccatcgcctatttcatcagcttcttcatgctctgtgccttcctgatcataaatctctttgtggc

SEQ ID NO: 6705 - DNA, 201 bp, Homo sapiens
tgatcataaatctctttgtggctgtgatcatggacaactttgattatctcaccagagattggtccatcctgggcccccatcaccttgatgaattcaagagratctggtctgaatatgaccctggggccaagggccgcatcaaacacttggatgtggttgccctgctgagacgtatccagccccctctgggatttgggaagc

SEQ ID NO: 6706 - DNA, 201 bp, Homo sapiens
acggtctgggcccctctgcctatgtgtcttccttcttcaaccgctttgactgctttgtggtctgtgggggcatcctagagaccaccttggtggaggtgggygccatgcagcccttgggcatctcagtgctccgatgtgtgcgcctcctcaggatctttaaggtcaccagacactgggcttctctgagcaatctggtggcat

SEQ ID NO: 6707 - DNA, 201 bp, Homo sapiens
caacatggtcttcactggcctcttcactattgagatggtgctcaaaatcatcgccttcaagcccaagcattacttcactgatgcctggaacacgtttgacrctcttattgtggtgggcagcatagtggatattgccgtcactgaagtcaatgtgagaactggcctagctctgaggacagctcccgcatttccattaccttc

SEQ ID NO: 6708 - DNA, 201 bp, Homo sapiens
aattaccgtgtggagatctcagtgttcttcattgtctacatcatcatcattgcgttcttcatgatgaacatcttcgtgggcttcgtcatcatcactttccrtgcccagggcgagcaggagtaccaaaactgtgagctggacaagaaccagcgtcaatgtgtggaatatgccctcaaggcccagccactccgccgttacatc

SEQ ID NO: 6709 - DNA, 201 bp, Homo sapiens
gatgaggaggagggggctctggccagctgtacacgctgcctaaacaagatcatgaaaaccagagtctgccgccgcctccgccgagccaaccgggtccttcrggcacgctgccgtcgggcagtgaagtccaatgcctgctactgggctgtgctgttgctcgtcttcctcaacacgttgaccatcgcctctgagcaccacggg

SEQ ID NO: 6710 - DNA, 201 bp, Homo sapiens
ctacacctgcacggacgaggccaaacacacccctcaagaatgcaagggctccttcctggtatacccagatggagacgtgtcacggcccctggtccgggagyggctctgggtcaacagtgatttcaactttgacaatgtcctttcagccatgatggccctgttcactgtctccacctttgaaggctggcctgcactgctata

SEQ ID NO: 6711 - DNA, 201 bp, Homo sapiens
tgggcagcatagtggatattgccgtcactgaagtcaatgtgagaactggcctagctctgaggacagctcccgcatttccattaccttctttcgcctcttcygagttatgcggctggtcaagcttctcagtaagggtgaagggatccgcacattgctctggacattcatcaagtccttccaggccttgccctatgtggctct

SEQ ID NO: 6712 - DNA, 201 bp, Homo sapiens
agcttggtggaggctgtgcttatctcagagggtctgggcctctttgctcgagacccacgtttcgtggccctggccaagcaggagattgcagatgcgtgtcrcctgacgctggatgagatggacaatgctgccagtgacctgctggcacagggaaccagctctctctatagcgacgaggagtccatcctctcccgcttcgat

SEQ ID NO: 6713 - DNA, 201 bp, Homo sapiens
agccaatggggcaggccctggtcccgaatgggggctgtgccccgggcccccagctgtggaaggtgaaagcagtggggcatcaggcctagggacccctaagygaagaaaccagcacagcaagcacaagacagtggcagtggccagtgcccagcggtcacctcgggcactcttctgcctcaccctggccaatcctctgcgacg

SEQ ID NO: 6714 - DNA, 201 bp, Homo sapiens
tcgcctatttcatcagcttcttcatgctctgtgccttcctgatcataaatctctttgtggctgtgatcatggacaactttgattatctcaccagagattgrtccatcctgggcccccatcaccttgatgaattcaagaggatctggtctgaatatgaccctggggccaagggccgcatcaaacacttggatgtggttgccc

SEQ ID NO: 6715 - DNA, 201 bp, Homo sapiens
acaatgtcctttcagccatgatggccctgttcactgtctccacctttgaaggctggcctgcactgctatacaaggccatcgatgcatatgcagaggaccayggccccatctataattaccgtgtggagatctcagtgttcttcattgtctacatcatcatcattgcgttcttcatgatgaacatcttcgtgggcttcgtca

SEQ ID NO: 6716 - DNA, 201 bp, Homo sapiens
ggtcatccccccaccagacgaggaggaggtcaccgtgggcaaattctacgccacatttctgatccaggactatttccgcaaattccggcggaggaaagaawaagggctactaggcaacgacgccgcccctagcacctcttccgcccttcaggctggtctgcggagcctgcaggacttgggtcctgagatgcggcaggccct

SEQ ID NO: 6717 - DNA, 201 bp, Homo sapiens
ctctactggatgcaagatgccatggggtatgaactgccctgggtgtactttgtgagccttgtcatctttgggtccttcttcgtcctcaaccttgtgcttgrcgtcctgagtggggagttctccaaggagagagagaaagcgaaagctcgcggggacttccagaagcagcgggagaagcagcagatggaggaagacctgcgg

SEQ ID NO: 6718 - DNA, 201 bp, Homo sapiens
aagacaccaccccagagcccagtccagccaatggggcaggccctggtcccgaatgggggctgtgccccgggcccccagctgtggaaggtgaaagcagtggrgcatcaggcctagggacccctaagcgaagaaaccagcacagcaagcacaagacagtggcagtggccagtgcccagcggtcacctcgggcactcttctgcc

SEQ ID NO: 6719 - DNA, 201 bp, Homo sapiens
aacacagttgccctagccatgcagcactatgagcagactgctcccttcaactatgccatggacatcctcaacatggtcttcactggcctcttcactattgwgatggtgctcaaaatcatcgccttcaagcccaagcattacttcactgatgcctggaacacgtttgacgctcttattgtggtgggcagcatagtggatatt

SEQ ID NO: 6720 - DNA, 201 bp, Homo sapiens
cgagcccactccttccgcaaccatattctgggttacttcgattatgccttcacctccattttcactgtggagattctactaaagatgacagtgtttggggmcttcctgcaccgcggctccttctgccgtagctggtttaatatgttggatctgctggtggtcagtgtgtccctcatctcctttggcatccactccagcgcc

SEQ ID NO: 6721 - DNA, 201 bp, Homo sapiens
ccaaagctgggggaagagaggggggttgtgtgcagatggcccttcaatctcgaaagaaagatgtcggaatctgaaggcgggaaagacaccaccccagagcycagtccagccaatggggcaggccctggtcccgaatgggggctgtgccccgggcccccagctgtggaaggtgaaagcagtggggcatcaggcctagggacc

SEQ ID NO: 6722 - DNA, 201 bp, Homo sapiens
tcagagatacatggatgggcacctggtaccacgccgccgtctgctgccccccacacctgcaggtcggaagccctccttcaccatccagtgtctgcagcgcmagggcagttgtgaggatttacccatcccaggcacctatcatcgtgggcgaaattcagggcccaatagggctcagggttcctgggcaacaccacctcagcg

SEQ ID NO: 6723 - DNA, 201 bp, Homo sapiens
cgaaattcagggcccaatagggctcagggttcctgggcaacaccacctcagcggggtcggctcctgtatgccccgctgttgttggtggaagagggcgcagsgggggaggggtacctcggcagatccagtggcccactgcgcaccttcacctgtctgcacgtgcctggaacccactcggaccccagccatgggaagaggggc

SEQ ID NO: 6724 - DNA, 201 bp, Homo sapiens
ggactggatcactcaagccgaagagctggacatggaggacccctccgccgatgacaaccttggttctatggctgaagagggccgggcgggccatcggccayagctggccgagctgaccaataggaggcgtggacgtctgcgctggttcagtcattctactcgctccacacactccaccagcagccatgccagcctcccagc

SEQ ID NO: 6725 - DNA, 201 bp, Homo sapiens
gccgtcattggcatgcagatgttcggcaaggtggctcttcaggatggcacacagataaaccgaaacaacaacttccagacctttccacaggctgtgctgcwtctgttcaggtgtgccactggtgaggcatggcaggagataatgcttgccagccttcccggaaatcggtgtgatcctgagtctgacttcggccctggtgaa

SEQ ID NO: 6726 - DNA, 201 bp, Homo sapiens
ggtatcatggcatatggtggccccttcttcccaggaatgttggtgtgcatctatttcatcattctcttcatctgtggcaactacatcctgttgaacgtgtktcttgccattgctgtggacaacctggccagtggagatgcaggcactgccaaggacaagggcggggagaagagcaatgagaaggatctcccacaggagaat

SEQ ID NO: 6727 - DNA, 201 bp, Homo sapiens
gcagggggtgtggaactcctgcaggaagttgtacccaaggagaaggtggtacccatccctgagggcagcgccttcttctgcctcagccaaaccaacccgcygaggaagggctgccacaccctcatccaccatcatgtcttcaccaatcttatcctggtgttcatcatcctcagcagtgtgtccctggccgctgaggacccc

SEQ ID NO: 6728 - DNA, 201 bp, Homo sapiens
gggactcaagcatgtggtgcagtgtgtatttgtggccatccggaccatcggaaacatcatgattgtcaccacacttctgcaatttatgttcgcctgcatcrgggtgcagctcttcaaggggaaattctacacctgcacggacgaggccaaacacacccctcaagaatgcaagggctccttcctggtatacccagatggaga

SEQ ID NO: 6729 - DNA, 201 bp, Homo sapiens
cagctggccgagctgaccaataggaggcgtggacgtctgcgctggttcagtcattctactcgctccacacactccaccagcagccatgccagcctcccagycagtgacaccggttccatgacagagacccaaggcgatgaggatgaggaggagggggctctggccagctgtacacgctgcctaaacaagatcatgaaaacc

SEQ ID NO: 6730 - DNA, 201 bp, Homo sapiens
tctgaatatgaccctggggccaagggccgcatcaaacacttggatgtggttgccctgctgagacgtatccagccccctctgggatttgggaagctgtgccsacaccgagtggcctgcaagagacttgtggcaatgaacatgcccctcaactcagatgggacggtgacattcaacgccacactctttgccctggtccggaca

SEQ ID NO: 6731 - DNA, 201 bp, Homo sapiens
ggccgcatcaaacacttggatgtggttgccctgctgagacgtatccagccccctctgggatttgggaagctgtgcccacaccgagtggcctgcaagagacytgtggcaatgaacatgcccctcaactcagatgggacggtgacattcaacgccacactctttgccctggtccggacatccctgaagatcaaaacagaaggg

SEQ ID NO: 6732 - DNA, 201 bp, Homo sapiens
tggggcatcaggcctagggacccctaagcgaagaaaccagcacagcaagcacaagacagtggcagtggccagtgcccagcggtcacctcgggcactcttcygcctcaccctggccaatcctctgcgacggtcctgcatcagcatcgtggagtggaagcccttcgacatcctcatcctgctgaccatctttgccaactgcgt

SEQ ID NO: 6733 - DNA, 201 bp, Homo sapiens
ccccacacctgcaggtcggaagccctccttcaccatccagtgtctgcagcgccagggcagttgtgaggatttacccatcccaggcacctatcatcgtgggygaaattcagggcccaatagggctcagggttcctgggcaacaccacctcagcggggtcggctcctgtatgccccgctgttgttggtggaagagggcgcagc

SEQ ID NO: 6734 - DNA, 201 bp, Homo sapiens
aaagccaggaggcttcgatgtgaaggcattgagggcgtttcgggtgctgcggccactgaggctggtgtctggggtcccgagcctgcacatagtgctcaatyccatcatgaaggctctggtgccgctgctgcacattgcactgctcgtgctcttcgtcatcatcatttatgccatcattgggctcgagctgttccttggacg

SEQ ID NO: 6735 - DNA, 201 bp, Homo sapiens
tctctgagcaatctggtggcatccctgctcaattcaatgaaatccatcgcatccttgctgcttctcctcttcctcttcatcattatcttctccctgcttgrcatgcagctgtttgggggcaagttcaactttgaccagacccacaccaagcgaagcacctttgacacgttcccccaggccctcctcactgtctttcagatc

SEQ ID NO: 6736 - DNA, 201 bp, Homo sapiens; identical to SEQ ID NO: 6704

SEQ ID NO: 6737 - DNA, 201 bp, Homo sapiens; identical to SEQ ID NO: 6705

SEQ ID NO: 6738 - DNA, 201 bp, Homo sapiens; identical to SEQ ID NO: 6706

SEQ ID NO: 6739 - DNA, 201 bp, Homo sapiens
caacatggtcttcactggcctcttcactattgagatggtgctcaaaatcatcgccttcaagcccaagcattacttcactgatgcctggaacacgtttgacrctcttattgtggtgggcagcatagtggatattgccgtcactgaagtcaataatggtggccaccttggcgagagctctgaggacagctcccgcatttccat

SEQ ID NO: 6740 - DNA, 201 bp, Homo sapiens; identical to SEQ ID NO: 6708

SEQ ID NO: 6741 - DNA, 201 bp, Homo sapiens; identical to SEQ ID NO: 6709

SEQ ID NO: 6742 - DNA, 201 bp, Homo sapiens; identical to SEQ ID NO: 6710

SEQ ID NO: 6743 - DNA, 201 bp, Homo sapiens
catagtggatattgccgtcactgaagtcaataatggtggccaccttggcgagagctctgaggacagctcccgcatttccattaccttctttcgcctcttcygagttatgcggctggtcaagcttctcagtaagggtgaagggatccgcacattgctctggacattcatcaagtccttccaggccttgccctatgtggctct

SEQ ID NO: 6744 - DNA, 201 bp, Homo sapiens; identical to SEQ ID NO: 6712

SEQ ID NO: 6745 - DNA, 201 bp, Homo sapiens; identical to SEQ ID NO: 6713

SEQ ID NO: 6746 - DNA, 201 bp, Homo sapiens; identical to SEQ ID NO: 6714

SEQ ID NO: 6747 - DNA, 201 bp, Homo sapiens; identical to SEQ ID NO: 6716

SEQ ID NO: 6748 - DNA, 201 bp, Homo sapiens; identical to SEQ ID NO: 6715

SEQ ID NO: 6749 - DNA, 201 bp, Homo sapiens; identical to SEQ ID NO: 6717

SEQ ID NO: 6750 - DNA, 201 bp, Homo sapiens; identical to SEQ ID NO: 6718

SEQ ID NO: 6751 - DNA, 201 bp, Homo sapiens; identical to SEQ ID NO: 6719

SEQ ID NO: 6752 - DNA, 201 bp, Homo sapiens; identical to SEQ ID NO: 6721

SEQ ID NO: 6753 - DNA, 201 bp, Homo sapiens; identical to SEQ ID NO: 6722

SEQ ID NO: 6754 - DNA, 201 bp, Homo sapiens; identical to SEQ ID NO: 6723

SEQ ID NO: 6755 - DNA, 201 bp, Homo sapiens; identical to SEQ ID NO: 6720

SEQ ID NO: 6756 - DNA, 201 bp, Homo sapiens; identical to SEQ ID NO: 6724

SEQ ID NO: 6757 - DNA, 201 bp, Homo sapiens
accttgatgtgtccacagatgttcggcaaggtggctcttcaggatggcacacagataaaccgaaacaacaacttccagacctttccacaggctgtgctgcwtctgttcaggtgtgccactggtgaggcatggcaggagataatgcttgccagccttcccggaaatcggtgtgatcctgagtctgacttcggccctggtgaa

SEQ ID NO: 6758 - DNA, 201 bp, Homo sapiens; identical to SEQ ID NO: 6726

SEQ ID NO: 6759 - DNA, 201 bp, Homo sapiens; identical to SEQ ID NO: 6727

SEQ ID NO: 6760 - DNA, 201 bp, Homo sapiens; identical to SEQ ID NO: 6728

SEQ ID NO: 6761 - DNA, 201 bp, Homo sapiens; identical to SEQ ID NO: 6729

SEQ ID NO: 6762 - DNA, 201 bp, Homo sapiens; identical to SEQ ID NO: 6730

SEQ ID NO: 6763 - DNA, 201 bp, Homo sapiens; identical to SEQ ID NO: 6731

SEQ ID NO: 6764 - DNA, 201 bp, Homo sapiens; identical to SEQ ID NO: 6733

SEQ ID NO: 6765 - DNA, 201 bp, Homo sapiens
tggggcatcaggcctagggacccctaagcgaagaaaccagcacagcaagcacaagacagtggcagtggccagtgcccagcggtcacctcgggcactcttcygcctcaccctggccaatcctctgcgacggtcctgcatcagcatcgtggaggtccttgactgtgtccacctgaggcccttcgacatcctcatcctgctgac

SEQ ID NO: 6766 - DNA, 201 bp, Homo sapiens; identical to SEQ ID NO: 6735

SEQ ID NO: 6767 - DNA, 201 bp, Homo sapiens; identical to SEQ ID NO: 6734

SEQ ID NO: 6768 - DNA, 201 bp, Homo sapiens; identical to SEQ ID NO: 6704

SEQ ID NO: 6769 - DNA, 201 bp, Homo sapiens; identical to SEQ ID NO: 6705

SEQ ID NO: 6770 - DNA, 201 bp, Homo sapiens; identical to SEQ ID NO: 6706

SEQ ID NO: 6771 - DNA, 201 bp, Homo sapiens; identical to SEQ ID NO: 6739

SEQ ID NO: 6772 - DNA, 201 bp, Homo sapiens; identical to SEQ ID NO: 6708

SEQ ID NO: 6773 - DNA, 201 bp, Homo sapiens; identical to SEQ ID NO: 6709

SEQ ID NO: 6774 - DNA, 201 bp, Homo sapiens; identical to SEQ ID NO: 6710

SEQ ID NO: 6775 - DNA, 201 bp, Homo sapiens; identical to SEQ ID NO: 6743

SEQ ID NO: 6776 - DNA, 201 bp, Homo sapiens; identical to SEQ ID NO: 6712

SEQ ID NO: 6777 - DNA, 201 bp, Homo sapiens; identical to SEQ ID NO: 6713

SEQ ID NO: 6778 - DNA, 201 bp, Homo sapiens; identical to SEQ ID NO: 6714

SEQ ID NO: 6779 - DNA, 201 bp, Homo sapiens; identical to SEQ ID NO: 6715

SEQ ID NO: 6780 - DNA, 201 bp, Homo sapiens; identical to SEQ ID NO: 6716

SEQ ID NO: 6781 - DNA, 201 bp, Homo sapiens; identical to SEQ ID NO: 6717

SEQ ID NO: 6782 - DNA, 201 bp, Homo sapiens; identical to SEQ ID NO: 6718

SEQ ID NO: 6783 - DNA, 201 bp, Homo sapiens; identical to SEQ ID NO: 6719

SEQ ID NO: 6784 - DNA, 201 bp, Homo sapiens; identical to SEQ ID NO: 6721

SEQ ID NO: 6785 - DNA, 201 bp, Homo sapiens; identical to SEQ ID NO: 6723

SEQ ID NO: 6786 - DNA, 201 bp, Homo sapiens
caaaagatacatggatgggcacctggtaccacgccgccgtctgctgccccccacacctgcaggtcggaagccctccttcaccatccagtgtctgcagcgcmagggcagttgtgaggatttacccatcccaggcacctatcatcgtgggcgaaattcagggcccaatagggctcagggttcctgggcaacaccacctcagcg

SEQ ID NO: 6787 - DNA, 201 bp, Homo sapiens; identical to SEQ ID NO: 6720

SEQ ID NO: 6788 - DNA, 201 bp, Homo sapiens; identical to SEQ ID NO: 6757

SEQ ID NO: 6789 - DNA, 201 bp, Homo sapiens; identical to SEQ ID NO: 6724

SEQ ID NO: 6790 - DNA, 201 bp, Homo sapiens; identical to SEQ ID NO: 6726

SEQ ID NO: 6791 - DNA, 201 bp, Homo sapiens; identical to SEQ ID NO: 6727

SEQ ID NO: 6792 - DNA, 201 bp, Homo sapiens; identical to SEQ ID NO: 6729

SEQ ID NO: 6793 - DNA, 201 bp, Homo sapiens; identical to SEQ ID NO: 6728

SEQ ID NO: 6794 - DNA, 201 bp, Homo sapiens; identical to SEQ ID NO: 6730

SEQ ID NO: 6795 - DNA, 201 bp, Homo sapiens; identical to SEQ ID NO: 6731

SEQ ID NO: 6796 - DNA, 201 bp, Homo sapiens; identical to SEQ ID NO: 6732

SEQ ID NO: 6797 - DNA, 201 bp, Homo sapiens; identical to SEQ ID NO: 6733

SEQ ID NO: 6798 - DNA, 201 bp, Homo sapiens; identical to SEQ ID NO: 6735

SEQ ID NO: 6799 - DNA, 201 bp, Homo sapiens; identical to SEQ ID NO: 6734

SEQ ID NO: 6800 - DNA, 201 bp, Homo sapiens; identical to SEQ ID NO: 6704

SEQ ID NO: 6801 - DNA, 201 bp, Homo sapiens; identical to SEQ ID NO: 6705

SEQ ID NO: 6802 - DNA, 201 bp, Homo sapiens; identical to SEQ ID NO: 6706

SEQ ID NO: 6803 - DNA, 201 bp, Homo sapiens; identical to SEQ ID NO: 6739

SEQ ID NO: 6804 - DNA, 201 bp, Homo sapiens; identical to SEQ ID NO: 6708

SEQ ID NO: 6805 - DNA, 201 bp, Homo sapiens; identical to SEQ ID NO: 6709

SEQ ID NO: 6806 - DNA, 201 bp, Homo sapiens; identical to SEQ ID NO: 6710

SEQ ID NO: 6807 - DNA, 201 bp, Homo sapiens; identical to SEQ ID NO: 6743

SEQ ID NO: 6808 - DNA, 201 bp, Homo sapiens; identical to SEQ ID NO: 6712

SEQ ID NO: 6809 - DNA, 201 bp, Homo sapiens; identical to SEQ ID NO: 6713

SEQ ID NO: 6810 - DNA, 201 bp, Homo sapiens; identical to SEQ ID NO: 6714

SEQ ID NO: 6811 - DNA, 201 bp, Homo sapiens; identical to SEQ ID NO: 6715

SEQ ID NO: 6812 - DNA, 201 bp, Homo sapiens; identical to SEQ ID NO: 6716

SEQ ID NO: 6813 - DNA, 201 bp, Homo sapiens; identical to SEQ ID NO: 6717

SEQ ID NO: 6814 - DNA, 201 bp, Homo sapiens; identical to SEQ ID NO: 6718

SEQ ID NO: 6815 - DNA, 201 bp, Homo sapiens; identical to SEQ ID NO: 6719

SEQ ID NO: 6816 - DNA, 201 bp, Homo sapiens; identical to SEQ ID NO: 6721

SEQ ID NO: 6817 - DNA, 201 bp, Homo sapiens; identical to SEQ ID NO: 6723

SEQ ID NO: 6818 - DNA, 201 bp, Homo sapiens; identical to SEQ ID NO: 6722

SEQ ID NO: 6819 - DNA, 201 bp, Homo sapiens; identical to SEQ ID NO: 6720

SEQ ID NO: 6820 - DNA, 201 bp, Homo sapiens; identical to SEQ ID NO: 6757

SEQ ID NO: 6821 - DNA, 201 bp, Homo sapiens
gcagcagatggaggaagacctgcggggctacctggactggatcactcaagccgaagagctggacatggaggacccctccgccgatgacaaccttgggccayagctggccgagctgaccaataggaggcgtggacgtctgcgctggttcagtcattctactcgctccacacactccaccagcagccatgccagcctcccagc

SEQ ID NO: 6822 - DNA, 201 bp, Homo sapiens; identical to SEQ ID NO: 6726

SEQ ID NO: 6823 - DNA, 201 bp, Homo sapiens; identical to SEQ ID NO: 6727

SEQ ID NO: 6824 - DNA, 201 bp, Homo sapiens; identical to SEQ ID NO: 6729

SEQ ID NO: 6825 - DNA, 201 bp, Homo sapiens; identical to SEQ ID NO: 6728

SEQ ID NO: 6826 - DNA, 201 bp, Homo sapiens; identical to SEQ ID NO: 6730

SEQ ID NO: 6827 - DNA, 201 bp, Homo sapiens; identical to SEQ ID NO: 6731

SEQ ID NO: 6828 - DNA, 201 bp, Homo sapiens; identical to SEQ ID NO: 6765

SEQ ID NO: 6829 - DNA, 201 bp, Homo sapiens; identical to SEQ ID NO: 6733

SEQ ID NO: 6830 - DNA, 201 bp, Homo sapiens; identical to SEQ ID NO: 6735

SEQ ID NO: 6831 - DNA, 201 bp, Homo sapiens; identical to SEQ ID NO: 6734

SEQ ID NO: 6832 - DNA, 201 bp, Homo sapiens; identical to SEQ ID NO: 6704

SEQ ID NO: 6833 - DNA, 201 bp, Homo sapiens; identical to SEQ ID NO: 6705

SEQ ID NO: 6834 - DNA, 201 bp, Homo sapiens; identical to SEQ ID NO: 6706

SEQ ID NO: 6835 - DNA, 201 bp, Homo sapiens; identical to SEQ ID NO: 6739

SEQ ID NO: 6836 - DNA, 201 bp, Homo sapiens; identical to SEQ ID NO: 6708

SEQ ID NO: 6837 - DNA, 201 bp, Homo sapiens; identical to SEQ ID NO: 6709

SEQ ID NO: 6838 - DNA, 201 bp, Homo sapiens; identical to SEQ ID NO: 6710

SEQ ID NO: 6839 - DNA, 201 bp, Homo sapiens; identical to SEQ ID NO: 6743

SEQ ID NO: 6840 - DNA, 201 bp, Homo sapiens; identical to SEQ ID NO: 6712

SEQ ID NO: 6841 - DNA, 201 bp, Homo sapiens; identical to SEQ ID NO: 6714

SEQ ID NO: 6842 - DNA, 201 bp, Homo sapiens; identical to SEQ ID NO: 6715

SEQ ID NO: 6843 - DNA, 201 bp, Homo sapiens; identical to SEQ ID NO: 6716

SEQ ID NO: 6844 - DNA, 201 bp, Homo sapiens; identical to SEQ ID NO: 6717

SEQ ID NO: 6845 - DNA, 201 bp, Homo sapiens; identical to SEQ ID NO: 6719

SEQ ID NO: 6846 - DNA, 201 bp, Homo sapiens; identical to SEQ ID NO: 6720

SEQ ID NO: 6847 - DNA, 201 bp, Homo sapiens; identical to SEQ ID NO: 6722

SEQ ID NO: 6848 - DNA, 201 bp, Homo sapiens; identical to SEQ ID NO: 6723

SEQ ID NO: 6849 - DNA, 201 bp, Homo sapiens; identical to SEQ ID NO: 6757

SEQ ID NO: 6850 - DNA, 201 bp, Homo sapiens; identical to SEQ ID NO: 6724

SEQ ID NO: 6851 - DNA, 201 bp, Homo sapiens; identical to SEQ ID NO: 6726

SEQ ID NO: 6852 - DNA, 201 bp, Homo sapiens; identical to SEQ ID NO: 6727

SEQ ID NO: 6853 - DNA, 201 bp, Homo sapiens; identical to SEQ ID NO: 6729

SEQ ID NO: 6854 - DNA, 201 bp, Homo sapiens; identical to SEQ ID NO: 6728

SEQ ID NO: 6855 - DNA, 201 bp, Homo sapiens; identical to SEQ ID NO: 6730

SEQ ID NO: 6856 - DNA, 201 bp, Homo sapiens; identical to SEQ ID NO: 6731

SEQ ID NO: 6857 - DNA, 201 bp, Homo sapiens; identical to SEQ ID NO: 6733

SEQ ID NO: 6858 - DNA, 201 bp, Homo sapiens; identical to SEQ ID NO: 6734

SEQ ID NO: 6859 - DNA, 201 bp, Homo sapiens; identical to SEQ ID NO: 6735

SEQ ID NO: 6860 - DNA, 201 bp, Homo sapiens; identical to SEQ ID NO: 6704

SEQ ID NO: 6861 - DNA, 201 bp, Homo sapiens; identical to SEQ ID NO: 6705

SEQ ID NO: 6862 - DNA, 201 bp, Homo sapiens; identical to SEQ ID NO: 6706

SEQ ID NO: 6863 - DNA, 201 bp, Homo sapiens
caacatggtcttcactggcctcttcactattgagatggtgctcaaaatcatcgccttcaagcccaagcattacttcactgatgcctggaacacgtttgacrctcttattgtggtgggcagcatagtggatattgccgtcactgaaagctctgaggacagctcccgcatttccattaccttctttcgcctcttccgagttat

SEQ ID NO: 6864 - DNA, 201 bp, Homo sapiens; identical to SEQ ID NO: 6708

SEQ ID NO: 6865 - DNA, 201 bp, Homo sapiens; identical to SEQ ID NO: 6709

SEQ ID NO: 6866 - DNA, 201 bp, Homo sapiens; identical to SEQ ID NO: 6710

SEQ ID NO: 6867 - DNA, 201 bp, Homo sapiens
gtttgacgctcttattgtggtgggcagcatagtggatattgccgtcactgaaagctctgaggacagctcccgcatttccattaccttctttcgcctcttcygagttatgcggctggtcaagcttctcagtaagggtgaagggatccgcacattgctctggacattcatcaagtccttccaggccttgccctatgtggctct

SEQ ID NO: 6868 - DNA, 201 bp, Homo sapiens; identical to SEQ ID NO: 6712

SEQ ID NO: 6869 - DNA, 201 bp, Homo sapiens; identical to SEQ ID NO: 6714

SEQ ID NO: 6870 - DNA, 201 bp, Homo sapiens; identical to SEQ ID NO: 6715

SEQ ID NO: 6871 - DNA, 201 bp, Homo sapiens; identical to SEQ ID NO: 6716

SEQ ID NO: 6872 - DNA, 201 bp, Homo sapiens; identical to SEQ ID NO: 6717

SEQ ID NO: 6873 - DNA, 201 bp, Homo sapiens
tctcaacctgattttctcctgcagcactatgagcagactgctcccttcaactatgccatggacatcctcaacatggtcttcactggcctcttcactattgwgatggtgctcaaaatcatcgccttcaagcccaagcattacttcactgatgcctggaacacgtttgacgctcttattgtggtgggcagcatagtggatatt

SEQ ID NO: 6874 - DNA, 201 bp, Homo sapiens
cgagcccactccttccgcaaccatattctgggttacttcgattatgccttcacctccattttcactgtggagattctactaaagatgacagtgtttggggmcttcctgcaccgcggctccttctgccgtagctggtttaatatgttggatctgctggtggtcagtgtgtccctcatctcctttggcatccaggcccagcca

SEQ ID NO: 6875 - DNA, 201 bp, Homo sapiens; identical to SEQ ID NO: 6722

SEQ ID NO: 6876 - DNA, 201 bp, Homo sapiens; identical to SEQ ID NO: 6723

SEQ ID NO: 6877 - DNA, 201 bp, Homo sapiens; identical to SEQ ID NO: 6757

SEQ ID NO: 6878 - DNA, 201 bp, Homo sapiens; identical to SEQ ID NO: 6821

SEQ ID NO: 6879 - DNA, 201 bp, Homo sapiens
ggtatcatggcatatggtggccccttcttcccaggaatgttggtgtgcatctatttcatcattctcttcatctgtggcaactacatcctgttgaacgtgtktcttgccattgctgtggacaacctggccagtggagatgcaggcactgccaaggacaagggcgggctccctctggctgctttgagaacggactgttgggag

SEQ ID NO: 6880 - DNA, 201 bp, Homo sapiens; identical to SEQ ID NO: 6727

SEQ ID NO: 6881 - DNA, 201 bp, Homo sapiens; identical to SEQ ID NO: 6729

SEQ ID NO: 6882 - DNA, 201 bp, Homo sapiens; identical to SEQ ID NO: 6728

SEQ ID NO: 6883 - DNA, 201 bp, Homo sapiens; identical to SEQ ID NO: 6730

SEQ ID NO: 6884 - DNA, 201 bp, Homo sapiens; identical to SEQ ID NO: 6731

SEQ ID NO: 6885 - DNA, 201 bp, Homo sapiens; identical to SEQ ID NO: 6733

SEQ ID NO: 6886 - DNA, 201 bp, Homo sapiens; identical to SEQ ID NO: 6734

SEQ ID NO: 6887 - DNA, 201 bp, Homo sapiens; identical to SEQ ID NO: 6735

SEQ ID NO: 6888 - DNA, 201 bp, Homo sapiens; identical to SEQ ID NO: 6704

SEQ ID NO: 6889 - DNA, 201 bp, Homo sapiens; identical to SEQ ID NO: 6705

SEQ ID NO: 6890 - DNA, 201 bp, Homo sapiens; identical to SEQ ID NO: 6706

SEQ ID NO: 6891 - DNA, 201 bp, Homo sapiens; identical to SEQ ID NO: 6707

SEQ ID NO: 6892 - DNA, 201 bp, Homo sapiens; identical to SEQ ID NO: 6708

SEQ ID NO: 6893 - DNA, 201 bp, Homo sapiens; identical to SEQ ID NO: 6709

SEQ ID NO: 6894 - DNA, 201 bp, Homo sapiens; identical to SEQ ID NO: 6710

SEQ ID NO: 6895 - DNA, 201 bp, Homo sapiens; identical to SEQ ID NO: 6711

SEQ ID NO: 6896 - DNA, 201 bp, Homo sapiens; identical to SEQ ID NO: 6712

SEQ ID NO: 6897 - DNA, 201 bp, Homo sapiens; identical to SEQ ID NO: 6713

SEQ ID NO: 6898 - DNA, 201 bp, Homo sapiens; identical to SEQ ID NO: 6714

SEQ ID NO: 6899 - DNA, 201 bp, Homo sapiens; identical to SEQ ID NO: 6715

SEQ ID NO: 6900 - DNA, 201 bp, Homo sapiens; identical to SEQ ID NO: 6716

SEQ ID NO: 6901 - DNA, 201 bp, Homo sapiens; identical to SEQ ID NO: 6717

SEQ ID NO: 6902 - DNA, 201 bp, Homo sapiens; identical to SEQ ID NO: 6718

SEQ ID NO: 6903 - DNA, 201 bp, Homo sapiens; identical to SEQ ID NO: 6719

SEQ ID NO: 6904 - DNA, 201 bp, Homo sapiens; identical to SEQ ID NO: 6720

SEQ ID NO: 6905 - DNA, 201 bp, Homo sapiens; identical to SEQ ID NO: 6721

SEQ ID NO: 6906 - DNA, 201 bp, Homo sapiens; identical to SEQ ID NO: 6722

SEQ ID NO: 6907 - DNA, 201 bp, Homo sapiens; identical to SEQ ID NO: 6723

SEQ ID NO: 6908 - DNA, 201 bp, Homo sapiens; identical to SEQ ID NO: 6821

SEQ ID NO: 6909 - DNA, 201 bp, Homo sapiens; identical to SEQ ID NO: 6725

SEQ ID NO: 6910 - DNA, 201 bp, Homo sapiens; identical to SEQ ID NO: 6726

SEQ ID NO: 6911 - DNA, 201 bp, Homo sapiens; identical to SEQ ID NO: 6727

SEQ ID NO: 6912 - DNA, 201 bp, Homo sapiens; identical to SEQ ID NO: 6728

SEQ ID NO: 6913 - DNA, 201 bp, Homo sapiens; identical to SEQ ID NO: 6729

SEQ ID NO: 6914 - DNA, 201 bp, Homo sapiens; identical to SEQ ID NO: 6730

SEQ ID NO: 6915 - DNA, 201 bp, Homo sapiens; identical to SEQ ID NO: 6731

SEQ ID NO: 6916 - DNA, 201 bp, Homo sapiens; identical to SEQ ID NO: 6732

SEQ ID NO: 6917 - DNA, 201 bp, Homo sapiens; identical to SEQ ID NO: 6733

SEQ ID NO: 6918 - DNA, 201 bp, Homo sapiens; identical to SEQ ID NO: 6734

SEQ ID NO: 6919 - DNA, 201 bp, Homo sapiens; identical to SEQ ID NO: 6735

SEQ ID NO: 6920 - DNA, 201 bp, Homo sapiens
gatagacctgaaaaccaagtcctgtagtgcagtggaattttctacttctggtcatgcttacactgatacagggaaagcatcaggcaacctagaacccgaaygtaaggtctgtaactatggacttaccttcactcaaaaacggaacacagacaatactcttgggacagaaatctctttggagaataagttggctaaagggtt

SEQ ID NO: 6921 - DNA, 201 bp, Homo sapiens
ttacactgatacagggaaagcatcaggcaacctagaacccgaatgtaaggtctgtaactatggacttaccttcactcaaaaacggaacacagacaatactsttgggacagaaatctctttggagaataagttggctaaagggttgaaactgagtcttgataccatattggtaccaaacacaggaaagaagagtggggaatt

SEQ ID NO: 6922 - DNA, 201 bp, Homo sapiens
ggttatactcagacccttcgacccggagtcaaattgaccctttatcagctttaatcgatggaaacaacttcagtgcaggaggtcacaaggttggcttggcrtttgaactgcaagcttaatgtggtttgaggaaagcatcagatttgtccctggaagtgaagagaaatgaacccaccatgttttggccctacaatccttctg

SEQ ID NO: 6923 - DNA, 201 bp, Homo sapiens
acagaaatctctttggagaataagttggctaaagggttgaaactgagtcttgataccatattggtaccaaacacaggaaagaagagtggggaattgaaggyctcctataaatgggattgttttagtgttggcagtaatgttgatctagatttttccggaccaaccatctatggctgggctgtgttggtctttgaagggtgg

SEQ ID NO: 6924 - DNA, 201 bp, Homo sapiens
tgggttatactcagacccttcgacccggagtcaaattgaccctttatcagctttaatcgatggaaacaacttcagtgcaggaggtcacaaggttggcttgscgtttgaactgcaagcttaatgtggtttgaggaaagcatcagatttgtccctggaagtgaagagaaatgaacccaccatgttttggccctacaatccttc

SEQ ID NO: 6925 - DNA, 201 bp, Homo sapiens
tgtgttggtctttgaagggtggcttgccggctatcagatgagttttgacacagccaaatccaaattgtcacagaataatttcgccctgggttacgaggctrcagacttccagctgcacacacatgtgaccgatggcactgaatttggaggttctatctaccagaaggttaatgggattgaaatgtcaataaaccttgcttg

SEQ ID NO: 6926 - DNA, 201 bp, Homo sapiens
caaccatctatggctgggctgtgttggtctttgaagggtggcttgccggctatcagatgagttttgacacagccaaatccaaattgtcacagaataatttygccctgggttacgaggctgcagacttccagctgcacacacatgtgaccgatggcactgaatttggaggttctatctaccagaaggttaatgggattgaaa

SEQ ID NO: 6927 - DNA, 201 bp, Homo sapiens
acttccagctgcacacacatgtgaccgatggcactgaatttggaggttctatctaccagaaggttaatgggattgaaatgtcaataaaccttgcttggacrgctggagtaacaacacccattttggcattgctactaagtacaagctggattgtagaacttctctctctgctaaagtaaataatgccagcctgattggact

SEQ ID NO: 6928 - DNA, 201 bp, Homo sapiens
tgtcacagaataatttcgccctgggttacgaggctgcagacttccagctgcacacacatgtgaccgatggcactgaatttggaggttctatctaccagaargttaatgggattgaaatgtcaataaaccttgcttggacggctggagtaacaacacccattttggcattgctactaagtacaagctggattgtagaacttc

SEQ ID NO: 6929 - DNA, 201 bp, Homo sapiens
gctatcagatgagttttgacacagccaaatccaaattgtcacagaataatttcgccctgggttacgaggctgcagacttccagctgcacacacatgtgacygatggcactgaatttggaggttctatctaccagaaggttaatgggattgaaatgtcaataaaccttgcttggacggctggagtaacaacacccattttgg

SEQ ID NO: 6930 - DNA, 201 bp, Homo sapiens
gggcttctcctttgtgagtggcttcaccatctccatgatcaaggtctgttttatctccagcgtcacgttctgtggctccaacgtcttgaaccacttcttcygtgacatttcccccatcctcaagctggcctgcacggacttctccactgcagagctggtggatttcatcctggccttcatcatcctggtgtttccgctcct

SEQ ID NO: 6931 - DNA, 201 bp, Homo sapiens
gccacccgctgcgctaccacgtccttgtgaccccggggctgtgcctccagctggtgggcttctcctttgtgagtggcttcaccatctccatgatcaaggtstgttttatctccagcgtcacgttctgtggctccaacgtcttgaaccacttcttctgtgacatttcccccatcctcaagctggcctgcacggacttctcca

SEQ ID NO: 6932 - DNA, 201 bp, Homo sapiens
cactgcagagctggtggatttcatcctggccttcatcatcctggtgtttccgctcctggccaccatactgtcatattggcacatcaccctggctgtcctgygcatcccctcggccaccggctgctggagagccttctctacctgcgcctctcacctcaccgtggtcaccgtcttctatacagccttgcttttcatgtatgt

SEQ ID NO: 6933 - DNA, 201 bp, Homo sapiens
acggacttctccactgcagagctggtggatttcatcctggccttcatcatcctggtgtttccgctcctggccaccatactgtcatattggcacatcacccyggctgtcctgcgcatcccctcggccaccggctgctggagagccttctctacctgcgcctctcacctcaccgtggtcaccgtcttctatacagccttgctt

SEQ ID NO: 6934 - DNA, 201 bp, Homo sapiens
catcctcaagctggcctgcacggacttctccactgcagagctggtggatttcatcctggccttcatcatcctggtgtttccgctcctggccaccatactgycatattggcacatcaccctggctgtcctgcgcatcccctcggccaccggctgctggagagccttctctacctgcgcctctcacctcaccgtggtcaccgt

SEQ ID NO: 6935 - DNA, 201 bp, Homo sapiens
gggtgcatgacgcagctctacttcttcagctccctggtgtgcaccgagtgtgtgcttctggcctccatggcctacgaccgctacgtggccatctgccaccygctgcgctaccacgtccttgtgaccccggggctgtgcctccagctggtgggcttctcctttgtgagtggcttcaccatctccatgatcaaggtctgtttt

SEQ ID NO: 6936 - DNA, 201 bp, Homo sapiens
gcagaaacgcatctctttcgtcgggtgcatgacgcagctctacttcttcagctccctggtgtgcaccgagtgtgtgcttctggcctccatggcctacgacygctacgtggccatctgccacccgctgcgctaccacgtccttgtgaccccggggctgtgcctccagctggtgggcttctcctttgtgagtggcttcaccat

SEQ ID NO: 6937 - DNA, 201 bp, Homo sapiens
tggagagccttctctacctgcgcctctcacctcaccgtggtcaccgtcttctatacagccttgcttttcatgtatgtccggccccaagccattgattcccwgagctccaacaagctcatctctgccgtgtacactgttgtcacgccaataattaaccctttgatttactgcctgaggaacaaggaatttaaggacgccttg

SEQ ID NO: 6938 - DNA, 110 bp, Homo sapiens
atgagtgggragaatgtcaccaaggtcagcaccttcatcctggtgggcctccccacggccccagggctgcagtacctgctcttcctcctcttcctgctcacctacctctt

SEQ ID NO: 6939 - DNA, 201 bp, Homo sapiens
tctgtggctccaacgtcttgaaccacttcttctgtgacatttcccccatcctcaagctggcctgcacggacttctccactgcagagctggtggatttcatyctggccttcatcatcctggtgtttccgctcctggccaccatactgtcatattggcacatcaccctggctgtcctgcgcatcccctcggccaccggctgct

SEQ ID NO: 6940 - DNA, 201 bp, Homo sapiens
gtgggcctccccacggccccagggctgcagtacctgctcttcctcctcttcctgctcacctacctctttgtcctggtggagaacctggccatcatcctcaycgtctggagcagcacctccctccacaggcccatgtactactttctgagctccatgtctttcctggagatctggtacgtgtctgacatcacccccaagatg

SEQ ID NO: 6941 - DNA, 201 bp, Homo sapiens
caccgtggtcaccgtcttctatacagccttgcttttcatgtatgtccggccccaagccattgattcccagagctccaacaagctcatctctgccgtgtacrctgttgtcacgccaataattaaccctttgatttactgcctgaggaacaaggaatttaaggacgccttgaaaaaggccttgggcttgggtcaaacttcaca

SEQ ID NO: 6942 - DNA, 105 bp, Homo sapiens
gcgatggctcacgcctgtgatcccagcactttggcaggccgaggtgggcagatcacgaggtcaggagatcgaaacacagtgaaaccccgtctctactaaamatac

SEQ ID NO: 6943 - DNA, 201 bp, Homo sapiens
ttaccagaaaggggaccggatccagaccccaagagagggttcttggatctcatgcaaaaaaagaattcagggattggctgtcaacatttaaatatcaagayttcggagcggggcgcgatggctcacgcctgtgatcccagcactttggcaggccgaggtgggcagatcacgaggtcaggagatcgaaacacagtgaaaccc

SEQ ID NO: 6944 - DNA, 201 bp, Homo sapiens
ccagaaaggggaccggatccagaccccaagagagggttcttggatctcatgcaaaaaaagaattcagggattggctgtcaacatttaaatatcaagatttyggagcggggcgcgatggctcacgcctgtgatcccagcactttggcaggccgaggtgggcagatcacgaggtcaggagatcgaaacacagtgaaaccccgt

SEQ ID NO: 6945 - DNA, 196 bp, Homo sapiens
agcaccacacctagttaattttttgtatttttgatagagatggagtttcgtcatgtagcccaggctggctgttgctataacgtttttgcaatggtragacagctctgggaaccctcggtcagtaccgaggcagcagctgtagagctctaggtcagggaagggggaaggtatccagcggacgcctcctgcgacggtc

SEQ ID NO: 6946 - DNA, 153 bp, Homo sapiens
ctaggtcagggaagggggaaggtatccagcggacgcctcctgcgacggtccggcccctagttgtcagctgcgctcagctcttaagatgctccggggatgckctgagctaaggatgcaggtgcagtcagactggtcctgatgagaggtaggctc

SEQ ID NO: 6947 - DNA, 201 bp, Homo sapiens
ttttgatagagatggagtttcgtcatgtagcccaggctggctgttgctataacgtttttgcaatggtgagacagctctgggaaccctcggtcagtaccgasgcagcagctgtagagctctaggtcagggaagggggaaggtatccagcggacgcctcctgcgacggtccggcccctagttgtcagctgcgctcagctctta

SEQ ID NO: 6948 - DNA, 121 bp, Homo sapiens
aggattctcccgagcccctgaaaaaaaaaaaaggtggagagactttgaaaacttttctctcgaaaagtctgaggaggcagaggacggcccggagtctcgtagcgcaccgccctggtcccac

SEQ ID NO: 6949 - DNA, 201 bp, Homo sapiens
agccactttcgcgcgagcagcagaaaacctgagccgcggcccggcgagtgtcggcggcgctctggggaggagaggctgggaaggggctgcgagagatgctrcttaagaacgtgaggctgagaggcggacttggtcagatctgcctgcgtgacaagctcaggacaggacgcttctgcccttgcattactgttgtaaaagttt

SEQ ID NO: 6950 - DNA, 201 bp, Homo sapiens
agaaggaggcagaatgaacaaacaacagacccctgacttctgggattttgtgagtttgccaaaaaaaaaaaaaaaagaagtatattgtgtctacccagcamaacaaaacgggggacttggcattcccccccttctcccgcctccacccacactaatttatgcattctttaaagccaaaggaatcaaagtgaaatttcacac

SEQ ID NO: 6951 - DNA, 201 bp, Homo sapiens
tttgtgagtttgccaaaaaaaaaaaaaaaagaagtatattgtgtctacccagcacaacaaaacgggggacttggcattcccccccttctcccgcctccacmcacactaatttatgcattctttaaagccaaaggaatcaaagtgaaatttcacacctagtctgtatcaagcatgtgctaggttaatttaaccttactgctc

SEQ ID NO: 6952 - DNA, 201 bp, Homo sapiens
gatgtttgtcgcccgcgggcccccgcgctgcttctgcgaccaagcgtgcggcgcggcgcggcgcgggactgctgcgcagactatacgcgggtctgcccagscagctacgggaaagagtgggaaaagtgagatagtcccaagaaacaggcaacagcaggaactcagagaagttattgacgatgatggggatgggaagagcaa

SEQ ID NO: 6953 - DNA, 201 bp, Homo sapiens
gtccgaaaacgcttcctattcagacgcgctcctgcgcggactccgggaagctgagcggtaaagaccgtgaagcgaggcgaggaccacggagcctgcccggratcgcgagttcagactgcgggcgccgctctatgaggtcacagggctgcgcccatcgcagcgtttctgacaggagcggccataatggctgtgggaatcact

SEQ ID NO: 6954 - DNA, 201 bp, Homo sapiens
ggaagctgagcggtaaagaccgtgaagcgaggcgaggaccacggagcctgcccgggatcgcgagttcagactgcgggcgccgctctatgaggtcacagggytgcgcccatcgcagcgtttctgacaggagcggccataatggctgtgggaatcactcttagtcacctcagtgcctttctctcttcgttgcaagggacactc

SEQ ID NO: 6955 - DNA, 201 bp, Homo sapiens
tgctccattaaatgctaatacccacatggggcttgctattaaaaccactgccagtggggaaggggatgaggaggtgaaggtgcaactgtgttaatatctayatgtttccttccagaagtaaaggaagatgacagtggggcacttaagaatatgaaattattagaatgcgatcatcctactttgcaatgtttccagattttt

SEQ ID NO: 6956 - DNA, 201 bp, Homo sapiens
cgccctcacccccagtagccaggctcaggaaggaagaggcacagcggtgtgaatggatggagaagaggaggccggtaggctgagcccctggctcctggaaygaacacacagccatggcagaggagaatgtggcttgaataggttccatgacttgtacaagaccacagctggtacatgatgaagcaaggacaagacacgggc

SEQ ID NO: 6957 - DNA, 201 bp, Homo sapiens
gtaggggagctaaggaagctacctacaccgccctcacccccagtagccaggctcaggaaggaagaggcacagcggtgtgaatggatggagaagaggaggcyggtaggctgagcccctggctcctggaacgaacacacagccatggcagaggagaatgtggcttgaataggttccatgacttgtacaagaccacagctggta

SEQ ID NO: 6958 - DNA, 195 bp, Homo sapiens
caaggagtaatgctgcttttcacacagaaagggcttctactgtgcctgaccttaagacaggaaaagtaggggagctaaggaagctacctacaccrccctcacccccagtagccaggctcaggaaggaagaggcacagcggtgtgaatggatggagaagaggaggccggtaggctgagcccctggctcctggaacg

SEQ ID NO: 6959 - DNA, 201 bp, Homo sapiens
ggctctaagcaaaagggttcatctctcctcaagcccttaaaatcactttagaaactcttcaacttctaattcaacatattctgacactaaacacaaatagscagtcttaacttgcttggaaaaccacatggtttaaatgtactataaccctttcccaaataagagctgctattatgaggcattaatgtacagaccgtttca

SEQ ID NO: 6960 - DNA, 201 bp, Homo sapiens
tttcccaaataagagctgctattatgaggcattaatgtacagaccgtttcatatgtatacttggttgcttaggaacaaagataattccagttccagaatayatgaattgcagaattagtaacttctgttaaagataattggaggttaagagaattagtcagggaagctgaaaaaggaaactaaagttagagacagaaacta

SEQ ID NO: 6961 - DNA, 201 bp, Homo sapiens
atatgtatacttggttgcttaggaacaaagataattccagttccagaatatatgaattgcagaattagtaacttctgttaaagataattggaggttaagasaattagtcagggaagctgaaaaaggaaactaaagttagagacagaaactaagtaaagataagaaaaatgagctttacaaagctactctagtggcatctgg

SEQ ID NO: 6962 - DNA, 201 bp, Homo sapiens
gttcttaggtgattagcacacttcccctccccatcttcccacttaatttctccatatttcttcttccccttttaggtaaacttactggtccttgctctatraagtttctcctaaaagtcacccctttcaccactgtgtccttttacacactttgtacaagttacttctaacagtgatttgcttacatgtttgtcctcccca

SEQ ID NO: 6963 - DNA, 201 bp, Homo sapiens
ttttgatcccatctcttaatatttcctgttgacttctgttcattcctattgcaaggaacattattgctgcctttgataaggccattatcatttttctctcrtatcttcctaatatgcatttttttaaccagtcttcctgcctccagtcttgcctcctccaatcgatccttgatgctgccaaagtggtatttgtgaaatgca

SEQ ID NO: 6964 - DNA, 201 bp, Homo sapiens
atggtttaaatgtactataaccctttcccaaataagagctgctattatgaggcattaatgtacagaccgtttcatatgtatacttggttgcttaggaacamagataattccagttccagaatatatgaattgcagaattagtaacttctgttaaagataattggaggttaagagaattagtcagggaagctgaaaaaggaa

SEQ ID NO: 6965 - DNA, 201 bp, Homo sapiens
ccataactctaaacagcaatctgcagtcatgtccttttgatcccatctcttaatatttcctgttgacttctgttcattcctattgcaaggaacattattgytgcctttgataaggccattatcatttttctctcgtatcttcctaatatgcatttttttaaccagtcttcctgcctccagtcttgcctcctccaatcgatc

SEQ ID NO: 6966 - DNA, 201 bp, Homo sapiens
cattattgctgcctttgataaggccattatcatttttctctcgtatcttcctaatatgcatttttttaaccagtcttcctgcctccagtcttgcctcctcmaatcgatccttgatgctgccaaagtggtatttgtgaaatgcagtttagcatgctgcttcagctttgtaattgtttctcctaatggtcaaacccaaactcc

SEQ ID NO: 6967 - DNA, 201 bp, Homo sapiens
gtcacccctttcaccactgtgtccttttacacactttgtacaagttacttctaacagtgatttgcttacatgtttgtcctccccacatctagcccagtgaytggttcaaaaaaggcactaaaaaaatggataaaattaaatatattactcttaatgattagtgtaatataaatatttacaccccatatctaagttctggct

SEQ ID NO: 6968 - DNA, 201 bp, Homo sapiens; identical to SEQ ID NO: 6949

SEQ ID NO: 6969 - DNA, 201 bp, Homo sapiens
cgctgagcaccctcaacagctgcgtggatcccttcatctactactacgtgtcggccgagttcagggacaaggtgcgggcagggctcttccaacggtcgccrggggacaccgtggcctccaaggcctctgcggaagggggcagccggggcatgggcacccactcctctttgctccagtgacacaaagtggggaaggctgtac

SEQ ID NO: 6970 - DNA, 201 bp, Homo sapiens
cgctacggccacgcgctgaggctgaccgcagtggtgctggcctccgccgtggccttcttcgtgcccagcaacctgctgctgctgctgcattactcggaccygagccccagcgcctggggcaacctctatggtgcctacgtgcccagcctggcgctgagcaccctcaacagctgcgtggatcccttcatctactactacgtg

SEQ ID NO: 6971 - DNA, 172 bp, Homo sapiens
ctcccacgggctggctggcaagcggccctggtgggtctgcgggggcaggggcagccttcctggtttatctcyaccggcgcgatctgctcgtccgcctcggctccagaagctggggctcagggtccggcgaggcaggaagcctgaggccacagcccagagcagcctgagtgca

SEQ ID NO: 6972 - DNA, 201 bp, Homo sapiens
gtgctacggggccaccctgcacacgctggcggccagcggccggcgctacggccacgcgctgaggctgaccgcagtggtgctggcctccgccgtggccttcktcgtgcccagcaacctgctgctgctgctgcattactcggacccgagccccagcgcctggggcaacctctatggtgcctacgtgcccagcctggcgctgag

SEQ ID NO: 6973 - DNA, 134 bp, Homo sapiens
tgtcaccagggataaggtgggacaatggggggtgggggtggacagtgtgtgctggggggttcgggtgctgcagacctggaactcccttctgccaggatgtyggcagccggttgtaagccttgcacgggacagac

SEQ ID NO: 6974 - DNA, 201 bp, Homo sapiens
cctgggccctgccagcatctctggctcggctttctgggctggatgcagcccacgacgcactggtgtctgagatggggctggagctggggctggggctgcaktccctggagactcactgcaagttcctgcccaggaggctgagggcaccccatcctcagtgcccaatgctgtggccccaccaggcccagagcctggttggcc

SEQ ID NO: 6975 - DNA, 123 bp, Homo sapiens
ctcccacgggctggctggcaagyggccctggtgggtctgcgggggcaggggcagccttcctggtttatctccaccggcgcgatctgctcgtccgcctcggctccagaagctggggctcagggt

SEQ ID NO: 6976 - DNA, 201 bp, Homo sapiens
tggcctccgccgtggccttcttcgtgcccagcaacctgctgctgctgctgcattactcggacccgagccccagcgcctggggcaacctctatggtgcctaygtgcccagcctggcgctgagcaccctcaacagctgcgtggatcccttcatctactactacgtgtcggccgagttcagggacaaggtgcgggcagggctct

SEQ ID NO: 6977 - DNA, 201 bp, Homo sapiens
ggtcctggtggtggggctgccggccaatgggctggcgctgtgggtgctggccacgcaggcacctcggctgccctccaccatgctgctgatgaacctcgcgrctgctgacctcctgctggccctggcgctgcccccgcggatcgcctaccacctgcgtggccagcgctggcccttcggggaggccgcctgccgcctggccac

SEQ ID NO: 6978 - DNA, 110 bp, Homo sapiens
atggggggtgggggtggacagtgtgtgctggggggttcgggtgctgcagacctggaactcccttctgccaggatgttggcagccggttgtaagccttgcaygggacagac

SEQ ID NO: 6979 - DNA, 201 bp, Homo sapiens
ccctggtgggtctgcgggggcaggggcagccttcctggtttatctccaccggcgcgatctgctcgtccgcctcggctccagaagctggggctcagggtccrgcgaggcaggaagcctgaggccacagcccagagcagcctgagtgcagtcatgtgggggcgactgctcctgtggcccctggtgctggggttcagcctgtct

SEQ ID NO: 6980 - DNA, 140 bp, Homo sapiens
ctcccacgggctggctggcaagcggccctggtgggtctgygggggcaggggcagccttcctggtttatctccaccggcgcgatctgctcgtccgcctcggctccagaagctggggctcagggtccggcgaggcaggaagc

SEQ ID NO: 6981 - DNA, 201 bp, Homo sapiens
atcgcgtgctctgccatgacgcgctgcccctggacgcacaggcctcccactggcaaccggccttcacctgcctggcgctgttgggctgtttcctgcccctkctggccatgctgctgtgctacggggccaccctgcacacgctggcggccagcggccggcgctacggccacgcgctgaggctgaccgcagtggtgctggcct

SEQ ID NO: 6982 - DNA, 201 bp, Homo sapiens
gtactgggtcgaacagggtcccttcccccacttcacgtccttcctgggacctcagaatgtgaccttatttggaaatagggttgttacaactgtcactagcrgaggtcactttggagaagggtgggccttacatccagtgtgggtggtgtcctcataagataaggagaggccaggcctggtggctcacgcctgtaatcccag

SEQ ID NO: 6983 - DNA, 201 bp, Homo sapiens
ctgcgggcccgcgccctgcgtggccggcgcctggcccttggactctgcatggctgcttggctcatggcggccgccctggcactgcccctgacactgcagcrgcagaccttccggctggcgcgctccgatcgcgtgctctgccatgacgcgctgcccctggacgcacaggcctcccactggcaaccggccttcacctgcctg

SEQ ID NO: 6984 - DNA, 201 bp, Homo sapiens
ctgaaccaggctctgtgatcacccaggggagtcctgtgaccctcaggtgtcaggggggccaggagacccaggagtaccgtctatatagagaaaagaaaacwgcactctggattacacggatcccacaggagcttgtgaagaagggccagttccccatcccatccatcacctgggaacatgcagggcggtatcgctgttact

SEQ ID NO: 6985 - DNA, 201 bp, Homo sapiens
gattacacggatcccacaggagcttgtgaagaagggccagttccccatcccatccatcacctgggaacatgcagggcggtatcgctgttactatggtagcsacactgcaggccgctcagagagcagtgaccccctggagctggtggtgacaggagcctacatcaaacccaccctctcagcccagcccagccccgtggtgaa

SEQ ID NO: 6986 - DNA, 201 bp, Homo sapiens
gcaccgagggctcatccatccacagagcagggcagtgggaggagacgccatgacccccatcctcacggtcctgatctgtctcgggctgagtctgggccccmggacccacgtgcaggcagggcacctccccaagcccaccctctgggctgaaccaggctctgtgatcacccaggggagtcctgtgaccctcaggtgtcaggg

SEQ ID NO: 6987 - DNA, 201 bp, Homo sapiens
ggagagaacgtgaccctgctgtgtcagtcacagggatggatgcaaactttccttctgaccaaggagggggcagctgatgacccatggcgtctaagatcaaygtaccaatctcaaaaataccaggctgaattccccatgggtcctgtgacctcagcccatgcggggacctacaggtgctacggctcacagagctccaaaccc

SEQ ID NO: 6988 - DNA, 201 bp, Homo sapiens
cccaggccaacttcaccctgggccctgtgagccgctcctacgggggccagtacagatgctacggtgcacacaacctctcctccgagtggtcggcccccagygaccccctggacatcctgatcgcaggacagttctatgacagagtctccctctcggtgcagccgggccccacggtggcctcaggagagaacgtgaccctgc

SEQ ID NO: 6989 - DNA, 201 bp, Homo sapiens
gccctgtgagccgctcctacgggggccagtacagatgctacggtgcacacaacctctcctccgagtggtcggcccccagtgaccccctggacatcctgatsgcaggacagttctatgacagagtctccctctcggtgcagccgggccccacggtggcctcaggagagaacgtgaccctgctgtgtcagtcacagggatgga

SEQ ID NO: 6990 - DNA, 201 bp, Homo sapiens
tgctggctacaacagatttgttctgtataaggacggggaacgtgacttccttcagctcgctggcgcacagccccaggctgggctctcccaggccaacttcrccctgggccctgtgagccgctcctacgggggccagtacagatgctacggtgcacacaacctctcctccgagtggtcggcccccagtgaccccctggacat

SEQ ID NO: 6991 - DNA, 201 bp, Homo sapiens
gggctctcccaggccaacttcaccctgggccctgtgagccgctcctacgggggccagtacagatgctacggtgcacacaacctctcctccgagtggtcggyccccagtgaccccctggacatcctgatcgcaggacagttctatgacagagtctccctctcggtgcagccgggccccacggtggcctcaggagagaacgtg

SEQ ID NO: 6992 - DNA, 201 bp, Homo sapiens
tacatcaaacccaccctctcagcccagcccagccccgtggtgaactcaggagggaatgtaatcctccagtgtgactcacaggtggcatttgatggcttcaktctgtgtaaggaaggagaagatgaacacccacaatgcctgaactcccagccccatgcccgtgggtcgtcccgcgccatcttctccgtgggccccgtgagc

SEQ ID NO: 6993 - DNA, 201 bp, Homo sapiens
gagagcagtgaccccctggagctggtggtgacaggagcctacatcaaacccaccctctcagcccagcccagccccgtggtgaactcaggagggaatgtaaycctccagtgtgactcacaggtggcatttgatggcttcagtctgtgtaaggaaggagaagatgaacacccacaatgcctgaactcccagccccatgcccgt

SEQ ID NO: 6994 - DNA, 201 bp, Homo sapiens
cctgatcgcaggacagttctatgacagagtctccctctcggtgcagccgggccccacggtggcctcaggagagaacgtgaccctgctgtgtcagtcacagrgatggatgcaaactttccttctgaccaaggagggggcagctgatgacccatggcgtctaagatcaacgtaccaatctcaaaaataccaggctgaattccc

SEQ ID NO: 6995 - DNA, 201 bp, Homo sapiens
aggagggggcagctgatgacccatggcgtctaagatcaacgtaccaatctcaaaaataccaggctgaattccccatgggtcctgtgacctcagcccatgcrgggacctacaggtgctacggctcacagagctccaaaccctacctgctgactcaccccagtgaccccctggagctcgtggtctcaggaccgtctgggggcc

SEQ ID NO: 6996 - DNA, 201 bp, Homo sapiens
cagcccatgcggggacctacaggtgctacggctcacagagctccaaaccctacctgctgactcaccccagtgaccccctggagctcgtggtctcaggaccstctgggggccccagctccccgacaacaggccccacctccacatctgcaggccctgaggaccagcccctcacccccaccgggtcggatccccagagtggtc

SEQ ID NO: 6997 - DNA, 201 bp, Homo sapiens
atctgcaggccctgaggaccagcccctcacccccaccgggtcggatccccagagtggtctgggaaggcacctgggggttgtgatcggcatcttggtggccrtcatcctactgctcctcctcctcctcctcctcttcctcatcctccgacatcgacgtcagggcaaacactggacatcgacccagagaaaggctgatttcca

SEQ ID NO: 6998 - DNA, 201 bp, Homo sapiens
ccaggctctgtgatcacccaggggagtcctgtgaccctcaggtgtcaggggggccaggagacccaggagtaccgtctatatagagaaaagaaaacagcacyctggattacacggatcccacaggagcttgtgaagaagggccagttccccatcccatccatcacctgggaacatgcagggcggtatcgctgttactatggt

SEQ ID NO: 6999 - DNA, 201 bp, Homo sapiens
gtctatatagagaaaagaaaacagcactctggattacacggatcccacaggagcttgtgaagaagggccagttccccatcccatccatcacctgggaacaygcagggcggtatcgctgttactatggtagcgacactgcaggccgctcagagagcagtgaccccctggagctggtggtgacaggagcctacatcaaaccca

SEQ ID NO: 7000 - DNA, 201 bp, Homo sapiens
tctatatagagaaaagaaaacagcactctggattacacggatcccacaggagcttgtgaagaagggccagttccccatcccatccatcacctgggaacatrcagggcggtatcgctgttactatggtagcgacactgcaggccgctcagagagcagtgaccccctggagctggtggtgacaggagcctacatcaaacccac

SEQ ID NO: 7001 - DNA, 201 bp, Homo sapiens
ctgactctgcagtgtggctctgatgctggctacaacagatttgttctgtataaggacggggaacgtgacttccttcagctcgctggcgcacagccccaggstgggctctcccaggccaacttcaccctgggccctgtgagccgctcctacgggggccagtacagatgctacggtgcacacaacctctcctccgagtggtcg

SEQ ID NO: 7002 - DNA, 201 bp, Homo sapiens
ataaggacggggaacgtgacttccttcagctcgctggcgcacagccccaggctgggctctcccaggccaacttcaccctgggccctgtgagccgctcctaygggggccagtacagatgctacggtgcacacaacctctcctccgagtggtcggcccccagtgaccccctggacatcctgatcgcaggacagttctatgaca

SEQ ID NO: 7003 - DNA, 201 bp, Homo sapiens
cgaactctccctatgagtggtctctacccagtgatctcctggagctcctggtcctaggtgtttctaagaagccatcactctcagtgcagccaggtcctatsgtggcccctgaggagaccctgactctgcagtgtggctctgatgctggctacaacagatttgttctgtataaggacggggaacgtgacttccttcagctcg

SEQ ID NO: 7004 - DNA, 201 bp, Homo sapiens
cagcccagccccgtggtgaactcaggagggaatgtaatcctccagtgtgactcacaggtggcatttgatggcttcagtctgtgtaaggaaggagaagatgmacacccacaatgcctgaactcccagccccatgcccgtgggtcgtcccgcgccatcttctccgtgggccccgtgagcccgagtcgcaggtggtggtacagg

SEQ ID NO: 7005 - DNA, 201 bp, Homo sapiens
cccagcccagccccgtggtgaactcaggagggaatgtaatcctccagtgtgactcacaggtggcatttgatggcttcagtctgtgtaaggaaggagaagawgaacacccacaatgcctgaactcccagccccatgcccgtgggtcgtcccgcgccatcttctccgtgggccccgtgagcccgagtcgcaggtggtggtaca

SEQ ID NO: 7006 - DNA, 201 bp, Homo sapiens
gtctaagatcaacgtaccaatctcaaaaataccaggctgaattccccatgggtcctgtgacctcagcccatgcggggacctacaggtgctacggctcacasagctccaaaccctacctgctgactcaccccagtgaccccctggagctcgtggtctcaggaccgtctgggggccccagctccccgacaacaggccccacct

SEQ ID NO: 7007 - DNA, 201 bp, Homo sapiens
tacccagtgatctcctggagctcctggtcctaggtgtttctaagaagccatcactctcagtgcagccaggtcctatcgtggcccctgaggagaccctgacyctgcagtgtggctctgatgctggctacaacagatttgttctgtataaggacggggaacgtgacttccttcagctcgctggcgcacagccccaggctgggc

SEQ ID NO: 7008 - DNA, 201 bp, Homo sapiens
caacgtaccaatctcaaaaataccaggctgaattccccatgggtcctgtgacctcagcccatgcggggacctacaggtgctacggctcacagagctccaamccctacctgctgactcaccccagtgaccccctggagctcgtggtctcaggaccgtctgggggccccagctccccgacaacaggccccacctccacatctg

SEQ ID NO: 7009 - DNA, 201 bp, Homo sapiens
cgtctaagatcaacgtaccaatctcaaaaataccaggctgaattccccatgggtcctgtgacctcagcccatgcggggacctacaggtgctacggctcacwgagctccaaaccctacctgctgactcaccccagtgaccccctggagctcgtggtctcaggaccgtctgggggccccagctccccgacaacaggccccacc

SEQ ID NO: 7010 - DNA, 201 bp, Homo sapiens
gtgacttccttcagctcgctggcgcacagccccaggctgggctctcccaggccaacttcaccctgggccctgtgagccgctcctacgggggccagtacagrtgctacggtgcacacaacctctcctccgagtggtcggcccccagtgaccccctggacatcctgatcgcaggacagttctatgacagagtctccctctcgg

SEQ ID NO: 7011 - DNA, 201 bp, Homo sapiens; identical to SEQ ID NO: 6986

SEQ ID NO: 7012 - DNA, 201 bp, Homo sapiens; identical to SEQ ID NO: 6989

SEQ ID NO: 7013 - DNA, 201 bp, Homo sapiens; identical to SEQ ID NO: 6990

SEQ ID NO: 7014 - DNA, 201 bp, Homo sapiens; identical to SEQ ID NO: 6993

SEQ ID NO: 7015 - DNA, 201 bp, Homo sapiens
gaggctgctgcatctgaagccccccaggatgtgacctacgcccagctgcacagcttgaccctcagacgggaggcaactgagcctcctccatcccaggaagygccctctccagctgtgcccagcatctacgccactctggccatccactagcccagggggggacgcagaccccacactccatggagtctggaatgcatggga

SEQ ID NO: 7016 - DNA, 201 bp, Homo sapiens; identical to SEQ ID NO: 6995

SEQ ID NO: 7017 - DNA, 201 bp, Homo sapiens
aggaccgtctgggggccccagctccccgacaacaggccccacctccacatctgcaggccctgaggaccagcccctcacccccaccgggtcggatccccagrgtggtctgggaaggcacctgggggttgtgatcggcatcttggtggccgtcatcctactgctcctcctcctcctcctcctcttcctcatcctccgacatcg

SEQ ID NO: 7018 - DNA, 201 bp, Homo sapiens
ggacatcgacccagagaaaggctgatttccaacatcctgcaggggctgtggggccagagcccacagacagaggcctgcagtggaggtccagcccagctgcrgatgcccaggaagaaaacctctatgctgccgtgaagcacacacagcctgaggatggggtggagatggacactcggagcccacacgatgaagacccccagg

SEQ ID NO: 7019 - DNA, 201 bp, Homo sapiens; identical to SEQ ID NO: 7003

SEQ ID NO: 7020 - DNA, 201 bp, Homo sapiens; identical to SEQ ID NO: 7002

SEQ ID NO: 7021 - DNA, 201 bp, Homo sapiens; identical to SEQ ID NO: 7004

SEQ ID NO: 7022 - DNA, 201 bp, Homo sapiens; identical to SEQ ID NO: 7005

SEQ ID NO: 7023 - DNA, 201 bp, Homo sapiens; identical to SEQ ID NO: 7007

SEQ ID NO: 7024 - DNA, 201 bp, Homo sapiens; identical to SEQ ID NO: 7009

SEQ ID NO: 7025 - DNA, 201 bp, Homo sapiens; identical to SEQ ID NO: 7010

SEQ ID NO: 7026 - DNA, 201 bp, Homo sapiens; identical to SEQ ID NO: 6984

SEQ ID NO: 7027 - DNA, 201 bp, Homo sapiens; identical to SEQ ID NO: 6985

SEQ ID NO: 7028 - DNA, 201 bp, Homo sapiens; identical to SEQ ID NO: 6987

SEQ ID NO: 7029 - DNA, 201 bp, Homo sapiens; identical to SEQ ID NO: 6988

SEQ ID NO: 7030 - DNA, 201 bp, Homo sapiens; identical to SEQ ID NO: 6991

SEQ ID NO: 7031 - DNA, 201 bp, Homo sapiens; identical to SEQ ID NO: 6992

SEQ ID NO: 7032 - DNA, 201 bp, Homo sapiens; identical to SEQ ID NO: 6994

SEQ ID NO: 7033 - DNA, 186 bp, Homo sapiens
tggtgaaaccctgtctctcctaaaaatacaaaaattagctggatgtggtggcagtgcctgtaatcccagctatttgggaggctgaggcaggagaatcgctygaaccagggagtcagaggtttcagtgagccaagatcgcaccactgctctccagcctggcgacagagggagactccatctcaaatt

SEQ ID NO: 7034 - DNA, 201 bp, Homo sapiens
ggtcggatccccagagtggtctgggaaggcacctgggggttgtgatcggcatcttggtggccgtcatcctactgctcctcctcctcctcctcctcttcctratcctccgacatcgacgtcagggcaaacactggacatcgacccagagaaaggctgatttccaacatcctgcaggggctgtggggccagagcccacagaca

SEQ ID NO: 7035 - DNA, 201 bp, Homo sapiens
ggcctctcctccttccccactgtctggggaattcctggacacaaaggacagacaggcggaagaggacaggcagatggacactgaggctgctgcatctgaarccccccaggatgtgacctacgcccagctgcacagcttgaccctcagacgggaggcaactgagcctcctccatcccaggaagggccctctccagctgtgcc

SEQ ID NO: 7036 - DNA, 201 bp, Homo sapiens
gagaaatggcctctcctccttccccactgtctggggaattcctggacacaaaggacagacaggcggaagaggacaggcagatggacactgaggctgctgcytctgaagccccccaggatgtgacctacgcccagctgcacagcttgaccctcagacgggaggcaactgagcctcctccatcccaggaagggccctctccag

SEQ ID NO: 7037 - DNA, 201 bp, Homo sapiens
ctaggagagaaatggcctctcctccttccccactgtctggggaattcctggacacaaaggacagacaggcggaagaggacaggcagatggacactgaggckgctgcatctgaagccccccaggatgtgacctacgcccagctgcacagcttgaccctcagacgggaggcaactgagcctcctccatcccaggaagggccct

SEQ ID NO: 7038 - DNA, 201 bp, Homo sapiens; identical to SEQ ID NO: 6998

SEQ ID NO: 7039 - DNA, 201 bp, Homo sapiens
agagaaaggctgatttccaacatcctgcaggggctgtggggccagagcccacagacagaggcctgcagtggaggtccagcccagctgccgatgcccaggargaaaacctctatgctgccgtgaagcacacacagcctgaggatggggtggagatggacactcggagcccacacgatgaagacccccaggcagtgacgtatg

SEQ ID NO: 7040 - DNA, 201 bp, Homo sapiens; identical to SEQ ID NO: 6999

SEQ ID NO: 7041 - DNA, 201 bp, Homo sapiens; identical to SEQ ID NO: 7000

SEQ ID NO: 7042 - DNA, 201 bp, Homo sapiens; identical to SEQ ID NO: 7001

SEQ ID NO: 7043 - DNA, 201 bp, Homo sapiens; identical to SEQ ID NO: 7006

SEQ ID NO: 7044 - DNA, 201 bp, Homo sapiens; identical to SEQ ID NO: 7008

SEQ ID NO: 7045 - DNA, 201 bp, Homo sapiens
catcgacccagagaaaggctgatttccaacatcctgcaggggctgtggggccagagcccacagacagaggcctgcagtggaggtccagcccagctgccgaygcccaggaagaaaacctctatgctgccgtgaagcacacacagcctgaggatggggtggagatggacactcggagcccacacgatgaagacccccaggcag

SEQ ID NO: 7046 - DNA, 201 bp, Homo sapiens; identical to SEQ ID NO: 6986

SEQ ID NO: 7047 - DNA, 201 bp, Homo sapiens; identical to SEQ ID NO: 6989

SEQ ID NO: 7048 - DNA, 201 bp, Homo sapiens; identical to SEQ ID NO: 6990

SEQ ID NO: 7049 - DNA, 201 bp, Homo sapiens; identical to SEQ ID NO: 6993

SEQ ID NO: 7050 - DNA, 201 bp, Homo sapiens
agcttgaccctcagacgggaggcaactgagcctcctccatcccaggaagggccctctccagctgtgcccagcatctacgccactctggccatccactagcycagggggggacgcagaccccacactccatggagtctggaatgcatgggagctgcccccccagtggacaccattggaccccacccagcctggatctacccc

SEQ ID NO: 7051 - DNA, 201 bp, Homo sapiens; identical to SEQ ID NO: 6995

SEQ ID NO: 7052 - DNA, 201 bp, Homo sapiens
atctggccctgaggaccagcccctcacccccaccgggtcggatccccagagtggtctgggaaggcacctgggggttgtgatcggcatcttggtggccgtcrtcctactgctcctcctcctcctcctcctcttcctcatcctccgacatcgacgtcagggcaaacactggacatcgacccagagaaaggctgatttccaaca

SEQ ID NO: 7053 - DNA, 201 bp, Homo sapiens
cagcccatgcggggacctacaggtgctacggctcacagagctccaaaccctacctgctgactcaccccagtgaccccctggagctcgtggtctcaggaccstctgggggccccagctccccgacaacaggccccacctccacatctggccctgaggaccagcccctcacccccaccgggtcggatccccagagtggtctgg

SEQ ID NO: 7054 - DNA, 201 bp, Homo sapiens
ggccagagcccacagacagaggcctgcagtggaggtccagcccagctgccgatgcccaggaagaaaacctctatgctgccgtgaagcacacacagcctgargatggggtggagatggacactcggcagagcccacacgatgaagacccccaggcagtgacgtatgccgaggtgaaacactccagacctaggagagaaatgg

SEQ ID NO: 7055 - DNA, 201 bp, Homo sapiens; identical to SEQ ID NO: 7003

SEQ ID NO: 7056 - DNA, 201 bp, Homo sapiens; identical to SEQ ID NO: 7002

SEQ ID NO: 7057 - DNA, 201 bp, Homo sapiens; identical to SEQ ID NO: 7004

SEQ ID NO: 7058 - DNA, 201 bp, Homo sapiens; identical to SEQ ID NO: 7005

SEQ ID NO: 7059 - DNA, 201 bp, Homo sapiens; identical to SEQ ID NO: 7007

SEQ ID NO: 7060 - DNA, 201 bp, Homo sapiens; identical to SEQ ID NO: 7009

SEQ ID NO: 7061 - DNA, 201 bp, Homo sapiens; identical to SEQ ID NO: 7010

SEQ ID NO: 7062 - DNA, 201 bp, Homo sapiens; identical to SEQ ID NO: 6985

SEQ ID NO: 7063 - DNA, 201 bp, Homo sapiens; identical to SEQ ID NO: 6984

SEQ ID NO: 7064 - DNA, 201 bp, Homo sapiens; identical to SEQ ID NO: 6987

SEQ ID NO: 7065 - DNA, 201 bp, Homo sapiens; identical to SEQ ID NO: 6988

SEQ ID NO: 7066 - DNA, 201 bp, Homo sapiens; identical to SEQ ID NO: 6991

SEQ ID NO: 7067 - DNA, 201 bp, Homo sapiens; identical to SEQ ID NO: 6992

SEQ ID NO: 7068 - DNA, 201 bp, Homo sapiens; identical to SEQ ID NO: 6994

SEQ ID NO: 7069 - DNA, 135 bp, Homo sapiens
cagtgcctgtaatcccagctatttgggaggctgaggcaggagaatcgcttgaaccagggagtcagaggtttcagtgagccaagatcgcaccactgctctcyagcctggcgacagagggagactccatctcaaatt

SEQ ID NO: 7070 - DNA, 201 bp, Homo sapiens
tcttggtggccgtcatcctactgctcctcctcctcctcctcctcttcctcatcctccgacatcgacgtcagggcaaacactggacatcgacccagagaaargctgatttccaacatcctgcaggggctgtggggccagagcccacagacagaggcctgcagtggaggtccagcccagctgccgatgcccaggaagaaaacc

SEQ ID NO: 7071 - DNA, 201 bp, Homo sapiens
acaggcggaagaggacaggcagatggacactgaggctgctgcatctgaagccccccaggatgtgacctacgcccagctgcacagcttgaccctcagacggraggcaactgagcctcctccatcccaggaagggccctctccagctgtgcccagcatctacgccactctggccatccactagcccagggggggacgcagacc

SEQ ID NO: 7072 - DNA, 201 bp, Homo sapiens
aggacagacaggcggaagaggacaggcagatggacactgaggctgctgcatctgaagccccccaggatgtgacctacgcccagctgcacagcttgaccctyagacgggaggcaactgagcctcctccatcccaggaagggccctctccagctgtgcccagcatctacgccactctggccatccactagcccagggggggac

SEQ ID NO: 7073 - DNA, 201 bp, Homo sapiens
acacaaaggacagacaggcggaagaggacaggcagatggacactgaggctgctgcatctgaagccccccaggatgtgacctacgcccagctgcacagcttkaccctcagacgggaggcaactgagcctcctccatcccaggaagggccctctccagctgtgcccagcatctacgccactctggccatccactagcccaggg

SEQ ID NO: 7074 - DNA, 201 bp, Homo sapiens; identical to SEQ ID NO: 6998

SEQ ID NO: 7075 - DNA, 201 bp, Homo sapiens
cagacagaggcctgcagtggaggtccagcccagctgccgatgcccaggaagaaaacctctatgctgccgtgaagcacacacagcctgaggatggggtggaratggacactcggcagagcccacacgatgaagacccccaggcagtgacgtatgccgaggtgaaacactccagacctaggagagaaatggcctctcctcctt

SEQ ID NO: 7076 - DNA, 201 bp, Homo sapiens; identical to SEQ ID NO: 6999

SEQ ID NO: 7077 - DNA, 201 bp, Homo sapiens; identical to SEQ ID NO: 7000

SEQ ID NO: 7078 - DNA, 201 bp, Homo sapiens; identical to SEQ ID NO: 7001

SEQ ID NO: 7079 - DNA, 201 bp, Homo sapiens; identical to SEQ ID NO: 7006

SEQ ID NO: 7080 - DNA, 201 bp, Homo sapiens; identical to SEQ ID NO: 7008

SEQ ID NO: 7081 - DNA, 201 bp, Homo sapiens
cagagcccacagacagaggcctgcagtggaggtccagcccagctgccgatgcccaggaagaaaacctctatgctgccgtgaagcacacacagcctgaggayggggtggagatggacactcggcagagcccacacgatgaagacccccaggcagtgacgtatgccgaggtgaaacactccagacctaggagagaaatggcct

SEQ ID NO: 7082 - DNA, 201 bp, Homo sapiens; identical to SEQ ID NO: 6986

SEQ ID NO: 7083 - DNA, 201 bp, Homo sapiens; identical to SEQ ID NO: 6989

SEQ ID NO: 7084 - DNA, 201 bp, Homo sapiens; identical to SEQ ID NO: 6990

SEQ ID NO: 7085 - DNA, 201 bp, Homo sapiens; identical to SEQ ID NO: 6993

SEQ ID NO: 7086 - DNA, 201 bp, Homo sapiens; identical to SEQ ID NO: 7050

SEQ ID NO: 7087 - DNA, 201 bp, Homo sapiens; identical to SEQ ID NO: 6995

SEQ ID NO: 7088 - DNA, 201 bp, Homo sapiens; identical to SEQ ID NO: 7052

SEQ ID NO: 7089 - DNA, 201 bp, Homo sapiens; identical to SEQ ID NO: 7053

SEQ ID NO: 7090 - DNA, 201 bp, Homo sapiens
ggccagagcccacagacagaggcctgcagtggaggtccagcccagctgccgatgcccaggaagaaaacctctatgctgccgtgaagcacacacagcctgargatggggtggagatggacactcggagcccacacgatgaagacccccaggcagtgacgtatgccgaggtgaaacactccagacctaggagagaaatggcct

SEQ ID NO: 7091 - DNA, 201 bp, Homo sapiens; identical to SEQ ID NO: 7003

SEQ ID NO: 7092 - DNA, 201 bp, Homo sapiens; identical to SEQ ID NO: 7002

SEQ ID NO: 7093 - DNA, 201 bp, Homo sapiens; identical to SEQ ID NO: 7004

SEQ ID NO: 7094 - DNA, 201 bp, Homo sapiens; identical to SEQ ID NO: 7005

SEQ ID NO: 7095 - DNA, 201 bp, Homo sapiens; identical to SEQ ID NO: 7007

SEQ ID NO: 7096 - DNA, 201 bp, Homo sapiens; identical to SEQ ID NO: 7009

SEQ ID NO: 7097 - DNA, 201 bp, Homo sapiens; identical to SEQ ID NO: 7010

SEQ ID NO: 7098 - DNA, 201 bp, Homo sapiens; identical to SEQ ID NO: 6985

SEQ ID NO: 7099 - DNA, 201 bp, Homo sapiens; identical to SEQ ID NO: 6984

SEQ ID NO: 7100 - DNA, 201 bp, Homo sapiens; identical to SEQ ID NO: 6987

SEQ ID NO: 7101 - DNA, 201 bp, Homo sapiens; identical to SEQ ID NO: 6988

SEQ ID NO: 7102 - DNA, 201 bp, Homo sapiens; identical to SEQ ID NO: 6991

SEQ ID NO: 7103 - DNA, 201 bp, Homo sapiens; identical to SEQ ID NO: 6992

SEQ ID NO: 7104 - DNA, 201 bp, Homo sapiens; identical to SEQ ID NO: 6994

SEQ ID NO: 7105 - DNA, 135 bp, Homo sapiens; identical to SEQ ID NO: 7069

SEQ ID NO: 7106 - DNA, 201 bp, Homo sapiens; identical to SEQ ID NO: 7070

SEQ ID NO: 7107 - DNA, 201 bp, Homo sapiens; identical to SEQ ID NO: 7071

SEQ ID NO: 7108 - DNA, 201 bp, Homo sapiens; identical to SEQ ID NO: 7072

SEQ ID NO: 7109 - DNA, 201 bp, Homo sapiens; identical to SEQ ID NO: 7073

SEQ ID NO: 7110 - DNA, 201 bp, Homo sapiens; identical to SEQ ID NO: 6998

SEQ ID NO: 7111 - DNA, 201 bp, Homo sapiens
cagacagaggcctgcagtggaggtccagcccagctgccgatgcccaggaagaaaacctctatgctgccgtgaagcacacacagcctgaggatggggtggaratggacactcggagcccacacgatgaagacccccaggcagtgacgtatgccgaggtgaaacactccagacctaggagagaaatggcctctcctccttccc

SEQ ID NO: 7112 - DNA, 201 bp, Homo sapiens; identical to SEQ ID NO: 6999

SEQ ID NO: 7113 - DNA, 201 bp, Homo sapiens; identical to SEQ ID NO: 7000

SEQ ID NO: 7114 - DNA, 201 bp, Homo sapiens; identical to SEQ ID NO: 7001

SEQ ID NO: 7115 - DNA, 201 bp, Homo sapiens; identical to SEQ ID NO: 7006

SEQ ID NO: 7116 - DNA, 201 bp, Homo sapiens; identical to SEQ ID NO: 7008

SEQ ID NO: 7117 - DNA, 201 bp, Homo sapiens
cagagcccacagacagaggcctgcagtggaggtccagcccagctgccgatgcccaggaagaaaacctctatgctgccgtgaagcacacacagcctgaggayggggtggagatggacactcggagcccacacgatgaagacccccaggcagtgacgtatgccgaggtgaaacactccagacctaggagagaaatggcctctc

SEQ ID NO: 7118 - DNA, 201 bp, Homo sapiens
acatttttttctctttccttgagctgcctttggcaagggaagagacccccaactctgcgcccctactccatgctgctgatccccacctgcgcactatagckcagggtcagcagtggaatgaagggccttagaacctgcatagaagaaatgaactcactgcatttctgtgctccctcctccctcgcaccaaactcctagctc

SEQ ID NO: 7119 - DNA, 201 bp, Homo sapiens
tctcacttctgcttcctcatctcagcccactctgaaaatgtgcagcaccctcactggttcctccccccaacgcaaggaggatgcccaattgttgccctctraaaatgcacagttctcctggccctaggacttacttattacatttttttctctttccttgagctgcctttggcaagggaagagacccccaactctgcgccc

SEQ ID NO: 7120 - DNA, 201 bp, Homo sapiens
tctgtgctccctcctccctcgcaccaaactcctagctctacaagtatatttatttatttatttatttattcatctatttatttacttatttatttatttawaaatattgctatttattgccgagttgtgcactttggggtagagtgaggggctcccagcagctctagctgggtctctcttgcttcctccctgcttacgcct

SEQ ID NO: 7121 - DNA, 201 bp, Homo sapiens
ggcacaggcagagagcccaccggctggtcatgagggcctcttcctttctctgacccaggcacctcgagggctattctcctgggttccttccggggtttatygctgaggcccagctgtgcagaattgtttgctagtgtggttggtatggaatccttgctggctttactaagccagccacacttggagtctgcccccaagctc

SEQ ID NO: 7122 - DNA, 201 bp, Homo sapiens
ccttccatgtgaatgcacaggaagctgagatgaaccctggcatttggcctcttgtagtcttggctaaggaaattctaacgcaaaaatagctcttgctttgrcttaggtgtgaagacccagacaggactgcagagggccccagagtggagatcccacatatttcaaaaacatgcttttccaaacccaggctattcggcaagg

SEQ ID NO: 7123 - DNA, 201 bp, Homo sapiens
gctgagatgaaccctggcatttggcctcttgtagtcttggctaaggaaattctaacgcaaaaatagctcttgctttgacttaggtgtgaagacccagacakgactgcagagggccccagagtggagatcccacatatttcaaaaacatgcttttccaaacccaggctattcggcaaggaagttagtttttaatctctccac

SEQ ID NO: 7124 - DNA, 201 bp, Homo sapiens
gaccgcctttggaggcagaagagcagttccacccaataactctaatgcagcggaagatgacctgcccacagtggagcttcagggcgtggtgccccggggcrtcaacctgcaagagtttcttaatgtcacgagcgttcacctgttcaaggagagatgggacactaacaaggtggaccaccacactgacaagtatgaaaacaa

SEQ ID NO: 7125 - DNA, 201 bp, Homo sapiens
cagaaggtgtcatgaaatcaaggtccaacgttgacatggactttgaagtggaaaatgctgtgctgggaaaagacttcaagctctccatcaccttccggaavaacagccacaaccgttacaccatcacagcttatctctcagccaacatcaccttctacaccggggtcccgaaggcagaattcaagaaggagacgttcgacg

SEQ ID NO: 7126 - DNA, 201 bp, Homo sapiens
cgaaccagtcgaaacccagaaacagacacgtacattctcttcaatccttggtgtgaagatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacact

SEQ ID NO: 7127 - DNA, 201 bp, Homo sapiens
agaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaagatgatgctgtgtatctggacaatgagaaagaaagagaagagta

SEQ ID NO: 7128 - DNA, 201 bp, Homo sapiens
gtttcttaatgtcacgagcgttcacctgttcaaggagagatgggacactaacaaggtggaccaccacactgacaagtatgaaaacaacaagctgattgtcygcagagggcagtctttctatgtgcagattgacttcagtcgtccatatgaccccagaagggatctcttcagggtggaatacgtcattggtcgctacccaca

SEQ ID NO: 7129 - DNA, 201 bp, Homo sapiens
aggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagct

SEQ ID NO: 7130 - DNA, 201 bp, Homo sapiens
tgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgca

SEQ ID NO: 7131 - DNA, 201 bp, Homo sapiens
gtcagaaacttccaggaccgcctttggaggcagaagagcagttccacccaataactctaatgcagcggaagatgacctgcccacagtggagcttcagggcktggtgccccggggcgtcaacctgcaagagtttcttaatgtcacgagcgttcacctgttcaaggagagatgggacactaacaaggtggaccaccacactga

SEQ ID NO: 7132 - DNA, 201 bp, Homo sapiens
aaccatccctgagatcatcatcaaggtccgtggcactcaggtagttggttctgacatgactgtgacaattcagtttaccaatcctttaaaagaaaccctgygaaatgtctgggtacacctggatggtcctggagtaacaagaccaatgaagaagatgttccgtgaaatccggcccaactccaccgtgcagtgggaagaagt

SEQ ID NO: 7133 - DNA, 201 bp, Homo sapiens
ctaaccatccctgagatcatcatcaaggtccgtggcactcaggtagttggttctgacatgactgtgacaattcagtttaccaatcctttaaaagaaacccygcgaaatgtctgggtacacctggatggtcctggagtaacaagaccaatgaagaagatgttccgtgaaatccggcccaactccaccgtgcagtgggaagaa

SEQ ID NO: 7134 - DNA, 201 bp, Homo sapiens
aatacctggcctcatttaaaacaagacttcagattccccactcagccttttgggaataatagcacatgatttgggctctagaattccagtcccctttctcrgggtcaggttctaccctccatgtgagaatatttttcccaggactagagcacaacataatttttatttttggcaaagccagaaaaagatctttcattttgc

SEQ ID NO: 7135 - DNA, 201 bp, Homo sapiens
acaaattggaggagatggcatgatggatattactgatacttacaaattccaagaaggtcaagaagaagagagattggccctagaaactgccctgatgtacrgagctaaaaagcccctcaacacagaaggtgtcatgaaatcaaggtccaacgttgacatggactttgaagtggaaaatgctgtgctgggaaaagacttcaa

SEQ ID NO: 7136 - DNA, 201 bp, Homo sapiens
tcatttacattacagctaagaaagatggcactcatgtggtggaaaatgtggatgccacccacattgggaaattaattgtgaccaaacaaattggaggagayggcatgatggatattactgatacttacaaattccaagaaggtcaagaagaagagagattggccctagaaactgccctgatgtacggagctaaaaagcccc

SEQ ID NO: 7137 - DNA, 201 bp, Homo sapiens
tatagaaggactgcagccactgattctctcttgtccttcacatcacccatgttgagacctcagcttggcactcaggtgctgaagggtaatatggactcagscttgcaaatagccagtgctagttctgacccaaccacagaggatgctgacatcatttgtattatgttccaaggctactacagagaaggctgcctgctatgt

SEQ ID NO: 7138 - DNA, 201 bp, Homo sapiens
agctctccatcaccttccggaacaacagccacaaccgttacaccatcacagcttatctctcagccaacatcaccttctacaccggggtcccgaaggcagarttcaagaaggagacgttcgacgtgacgctggagcccttgtccttcaagaaagaggcggtgctgatccaagccggcgagtacatgggtcagctgctggaac

SEQ ID NO: 7139 - DNA, 201 bp, Homo sapiens
agggccccagagtggagatcccacatatttcaaaaacatgcttttccaaacccaggctattcggcaaggaagttagtttttaatctctccaccttccaaaragtgctaagcattagctttaattaagctctcatagctcataagagtaacagtcatcatttatcatcacaaatggctacatctccaaatatcagtgggctc

SEQ ID NO: 7140 - DNA, 201 bp, Homo sapiens
gctgggaaaagacttcaagctctccatcaccttccggaacaacagccacaaccgttacaccatcacagcttatctctcagccaacatcaccttctacaccrgggtcccgaaggcagaattcaagaaggagacgttcgacgtgacgctggagcccttgtccttcaagaaagaggcggtgctgatccaagccggcgagtacat

SEQ ID NO: 7141 - DNA, 201 bp, Homo sapiens
gacatcaagaccagaagctggagctatggtcagtttgaagatggcatcctggacacttgcctgtatgtgatggacagagcacaaatggacctctctggaakagggaatcccatcaaagtcagccgtgtggggtctgcaatggtgaatgccaaagatgacgaaggtgtcctcgttggatcctgggacaatatctatgcctat

SEQ ID NO: 7142 - DNA, 201 bp, Homo sapiens
actagagcacaacataatttttatttttggcaaagccagaaaaagatctttcattttgcacctgcagccaagcaaatgcctgccaaattttagatttaccwtgttagaagaggtggccccatattaacaaattgcatttgtgggaaacttaaccacctacaaggagataagaaagcaggtgcaacactcaagtctattgaa

SEQ ID NO: 7143 - DNA, 201 bp, Homo sapiens
tataataagcccaacaagttgaagaagctggcggatctagtgaccagatatatagaaggactgcagccactgattctctcttgtccttcacatcacccatkttgagacctcagcttggcactcaggtgctgaagggtaatatggactcagccttgcaaatagccagtgctagttctgacccaaccacagaggatgctgaca

SEQ ID NO: 7144 - DNA, 201 bp, Homo sapiens
tctggaagagggaatcccatcaaagtcagccgtgtggggtctgcaatggtgaatgccaaagatgacgaaggtgtcctcgttggatcctgggacaatatctrtgcctatggcgtccccccatcggcctggactggaagcgttgacattctattggaataccggagctctgagaatccagtccggtatggccaatgctgggtt

SEQ ID NO: 7145 - DNA, 201 bp, Homo sapiens
aaagacttcaagctctccatcaccttccggaacaacagccacaaccgttacaccatcacagcttatctctcagccaacatcaccttctacaccggggtccygaaggcagaattcaagaaggagacgttcgacgtgacgctggagcccttgtccttcaagaaagaggcggtgctgatccaagccggcgagtacatgggtcag

SEQ ID NO: 7146 - DNA, 201 bp, Homo sapiens
actggaagcgttgacattctattggaataccggagctctgagaatccagtccggtatggccaatgctgggtttttgctggtgtctttaacacatttttacratgccttggaataccagcaagaattgttaccaattatttctctgcccatgataatgatgccaatttgcaaatggacatcttcctggaagaagatgggaac

SEQ ID NO: 7147 - DNA, 201 bp, Homo sapiens
ggattcagtgtggaactaccactgctggaatgaagcatggatgacaaggcctgaccttcctgttggatttggaggctggcaagctgtggacagcacccccyaggaaaatagcgatggcatgtatcggtgtggccccgcctcggttcaagccatcaagcacggccatgtctgcttccaatttgatgcaccttttgtttttgc

SEQ ID NO: 7148 - DNA, 201 bp, Homo sapiens
ccacagtggagcttcagggcgtggtgccccggggcgtcaacctgcaagagtttcttaatgtcacgagcgttcacctgttcaaggagagatgggacactaamaaggtggaccaccacactgacaagtatgaaaacaacaagctgattgtccgcagagggcagtctttctatgtgcagattgacttcagtcgtccatatgacc

SEQ ID NO: 7149 - DNA, 201 bp, Homo sapiens
tggaatgaagcatggatgacaaggcctgaccttcctgttggatttggaggctggcaagctgtggacagcaccccccaggaaaatagcgatggcatgtatcrgtgtggccccgcctcggttcaagccatcaagcacggccatgtctgcttccaatttgatgcaccttttgtttttgcagaggtcaacagcgacctcatttac

SEQ ID NO: 7150 - DNA, 201 bp, Homo sapiens
atcaaggtccgtggcactcaggtagttggttctgacatgactgtgacaattcagtttaccaatcctttaaaagaaaccctgcgaaatgtctgggtacaccyggatggtcctggagtaacaagaccaatgaagaagatgttccgtgaaatccggcccaactccaccgtgcagtgggaagaagtgtgccggccctgggtctct

SEQ ID NO: 7151 - DNA, 201 bp, Homo sapiens
acaaggagataagaaagcaggtgcaacactcaagtctattgaataatgtagttttgtgatgcattttatagaatgtgtcacactgtggcctgatcagcagragccaatatcccttactttaaccctttctgggatgcaatactaggaagtaaagtgaagaatttatctctttagttagtgattatatttcacccatctctc

SEQ ID NO: 7152 - DNA, 201 bp, Homo sapiens
attctaacgcaaaaatagctcttgctttgacttaggtgtgaagacccagacaggactgcagagggccccagagtggagatcccacatatttcaaaaacatrcttttccaaacccaggctattcggcaaggaagttagtttttaatctctccaccttccaaagagtgctaagcattagctttaattaagctctcatagctca

SEQ ID NO: 7153 - DNA, 169 bp, Homo sapiens
ctttcccgagtccgtttgaggaagtccccgaggcgcacagagcaagcccacgcgagggcacctctggasgggagcgcctgcaggaccttgtaaagtcaaaaatgtcagaaacttccaggaccgcctttggaggcagaagagcagttccacccaataactctaatgcagc

SEQ ID NO: 7154 - DNA, 201 bp, Homo sapiens
ggatgttctggccaagcaaaagtccaccgtgctaaccatccctgagatcatcatcaaggtccgtggcactcaggtagttggttctgacatgactgtgacarttcagtttaccaatcctttaaaagaaaccctgcgaaatgtctgggtacacctggatggtcctggagtaacaagaccaatgaagaagatgttccgtgaaat

SEQ ID NO: 7155 - DNA, 201 bp, Homo sapiens
gccaacatcaccttctacaccggggtcccgaaggcagaattcaagaaggagacgttcgacgtgacgctggagcccttgtccttcaagaaagaggcggtgcwgatccaagccggcgagtacatgggtcagctgctggaacaagcgtccctgcacttctttgtcacagctcgcatcaatgagaccagggatgttctggccaag

SEQ ID NO: 7156 - DNA, 201 bp, Homo sapiens
attctctcttgtccttcacatcacccatgttgagacctcagcttggcactcaggtgctgaagggtaatatggactcagccttgcaaatagccagtgctagytctgacccaaccacagaggatgctgacatcatttgtattatgttccaaggctactacagagaaggctgcctgctatgtatttgcaaggctgatttatggt

SEQ ID NO: 7157 - DNA, 201 bp, Homo sapiens
tgttctggccaagcaaaagtccaccgtgctaaccatccctgagatcatcatcaaggtccgtggcactcaggtagttggttctgacatgactgtgacaattsagtttaccaatcctttaaaagaaaccctgcgaaatgtctgggtacacctggatggtcctggagtaacaagaccaatgaagaagatgttccgtgaaatccg

SEQ ID NO: 7158 - DNA, 201 bp, Homo sapiens
tgttggatttggaggctggcaagctgtggacagcaccccccaggaaaatagcgatggcatgtatcggtgtggccccgcctcggttcaagccatcaagcacrgccatgtctgcttccaatttgatgcaccttttgtttttgcagaggtcaacagcgacctcatttacattacagctaagaaagatggcactcatgtggtgga

SEQ ID NO: 7159 - DNA, 201 bp, Homo sapiens
ataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattatta

SEQ ID NO: 7160 - DNA, 201 bp, Homo sapiens
ggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtcgctacccacaggagaacaagggaacctacatcccagtgcctat

SEQ ID NO: 7161 - DNA, 201 bp, Homo sapiens
ggtctgcaatggtgaatgccaaagatgacgaaggtgtcctcgttggatcctgggacaatatctatgcctatggcgtccccccatcggcctggactggaagsgttgacattctattggaataccggagctctgagaatccagtccggtatggccaatgctgggtttttgctggtgtctttaacacatttttacgatgccttg

SEQ ID NO: 7162 - DNA, 201 bp, Homo sapiens
tggcatttggcctcttgtagtcttggctaaggaaattctaacgcaaaaatagctcttgctttgacttaggtgtgaagacccagacaggactgcagagggcyccagagtggagatcccacatatttcaaaaacatgcttttccaaacccaggctattcggcaaggaagttagtttttaatctctccaccttccaaagagtgc

SEQ ID NO: 7163 - DNA, 201 bp, Homo sapiens
ttctattggaataccggagctctgagaatccagtccggtatggccaatgctgggtttttgctggtgtctttaacacatttttacgatgccttggaataccmgcaagaattgttaccaattatttctctgcccatgataatgatgccaatttgcaaatggacatcttcctggaagaagatgggaacgtgaattccaaactca

SEQ ID NO: 7164 - DNA, 201 bp, Homo sapiens
aacgttgacatggactttgaagtggaaaatgctgtgctgggaaaagacttcaagctctccatcaccttccggaacaacagccacaaccgttacaccatcayagcttatctctcagccaacatcaccttctacaccggggtcccgaaggcagaattcaagaaggagacgttcgacgtgacgctggagcccttgtccttcaag

SEQ ID NO: 7165 - DNA, 201 bp, Homo sapiens
caacagccacaaccgttacaccatcacagcttatctctcagccaacatcaccttctacaccggggtcccgaaggcagaattcaagaaggagacgttcgacrtgacgctggagcccttgtccttcaagaaagaggcggtgctgatccaagccggcgagtacatgggtcagctgctggaacaagcgtccctgcacttctttgt

SEQ ID NO: 7166 - DNA, 201 bp, Homo sapiens
tttaacacatttttacgatgccttggaataccagcaagaattgttaccaattatttctctgcccatgataatgatgccaatttgcaaatggacatcttccyggaagaagatgggaacgtgaattccaaactcaccaaggattcagtgtggaactaccactgctggaatgaagcatggatgacaaggcctgaccttcctgtt

SEQ ID NO: 7167 - DNA, 201 bp, Homo sapiens
gacatcaagaccagaagctggagctatggtcagtttgaagatggcatcctggacacttgcctgtatgtgatggacagagcacaaatggacctctctggaakagggaatcccatcaaagtcagccgtgtggggtctgcaatgggctttctcacttacgaagtgggtattgattctttgcaggatcctgtgtgcctggtcata

SEQ ID NO: 7168 - DNA, 201 bp, Homo sapiens; identical to SEQ ID NO: 7163

SEQ ID NO: 7169 - DNA, 201 bp, Homo sapiens; identical to SEQ ID NO: 7146

SEQ ID NO: 7170 - DNA, 141 bp, Homo sapiens
ggagcctcacctcaggggggctacagttttgcacagagcggccccactgttgacgccaacagaggccatggtctgagctccttagctgttcaggagagggmtggggactcaggaacctcagaagggcagagcagggcagag

SEQ ID NO: 7171 - DNA, 201 bp, Homo sapiens
ttaactgcagtttgggatggaggtggtgctcagcttttatataaagggggaagcaagtatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacact

SEQ ID NO: 7172 - DNA, 201 bp, Homo sapiens
agaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaagggatttctgacttcatggctgcctctgcctctaggagtcctac

SEQ ID NO: 7173 - DNA, 201 bp, Homo sapiens
ttcactgtgacacacctacatgtaccacctccatccatatttgctccagtgaatgccaaagatgacgaaggtgtcctcgttggatcctgggacaatatctrtgcctatggcgtccccccatcggcctggactggaagcgttgacattctattggaataccggagctctgagaatccagtccggtatggccaatgctgggtt

SEQ ID NO: 7174 - DNA, 201 bp, Homo sapiens
tttaacacatttttacgatgccttggaataccagcaagaattgttaccaattatttctctgcccatgataatgatgccaatttgcaaatggacatcttccyggaagaagatgggaacgtgaattccaaactcaccaaggattcagtgtgcaaggatctcaggagctattggcctcatacttacctccctccacaggctctg

SEQ ID NO: 7175 - DNA, 201 bp, Homo sapiens
taggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggaggtggtgctcagcttttatataaagggggaagcaagtatgatgctgtgtatctggacaatga

SEQ ID NO: 7176 - DNA, 201 bp, Homo sapiens
gaaatagcacatagatctcagttcatccccaggatctggcagcaactatgggcagagaatttcccccaaggagatgcagctgcttctgcaaaggctgccgytactgcagataaaggctcgttattcactgtgacacacctacatgtaccacctccatccatatttgctccagtgaatgccaaagatgacgaaggtgtcctc

SEQ ID NO: 7177 - DNA, 201 bp, Homo sapiens
tatttgctccagtgaatgccaaagatgacgaaggtgtcctcgttggatcctgggacaatatctatgcctatggcgtccccccatcggcctggactggaagsgttgacattctattggaataccggagctctgagaatccagtccggtatggccaatgctgggtttttgctggtgtctttaacacatttttacgatgccttg

SEQ ID NO: 7178 - DNA, 201 bp, Homo sapiens
cggaactgtgtggatgaaaatgaatgtgcaactggctttcatcgctgtggccccaactctgtatgtatcaacttgcctggaagctacaggtgtgagtgccrgagtggttatgagtttgcagatgaccggcatacttgcatcttgatcaccccacctgccaacccctgtgaggatggcagtcatacctgtgctcctgctggg

SEQ ID NO: 7179 - DNA, 201 bp, Homo sapiens
caccagagcccacccagaggcccccgaccatctgtgagcgctggagggaaaacctgctggagcactacggtggcaccccccgggatgaccagtacgtgccmcagtgcgatgacctgggccacttcatccccctgcagtgccacggaaagagcgacttctgctggtgtgtggacaaagatggcagagaggtgcagggcaccc

SEQ ID NO: 7180 - DNA, 201 bp, Homo sapiens
gggagaggagacggttcgtatcactcaaactgctgagggacttgacccagagaactacctgagcattaagaccaacattcaaggccaggtgccttacgtcycagcaaatttcacagcccacatctctccctacaaggagctgtaccactactccgactccactgtgacctctacaagttccagagactactctctgacttt

SEQ ID NO: 7181 - DNA, 201 bp, Homo sapiens
gctgatacctcaatctttactactgtatttttaaaaatgaaggttgttattgcaagtttaaaaaggtaacagaattttaactgttgcttattaaagcaacwtcttgtaaacatttatcattaatatttaaaagatcaaattcattcaactaagaattagagtttaagactctaaacctgatttttgccatggattccttct

SEQ ID NO: 7182 - DNA, 201 bp, Homo sapiens
aattcattcaactaagaattagagtttaagactctaaacctgatttttgccatggattccttctggccaagaaattaaagcacatgtgatcaatataacawtataatcctaaaccttgacagttggagaagccaatgcagaactgatgggaaaggaccaattatttatagtttcccaacaaaagttctaagattttttacc

SEQ ID NO: 7183 - DNA, 201 bp, Homo sapiens
cgttcagctgtgcctgcctgcctggttatgccggcgatgggcaccagtgcactgatgtagatgaatgctcagaaaacagatgtcaccctgcagctacctgytacaatactcctggttccttctcctgccgttgtcaacccggatattatggggatggatttcagtgcatacctgactccacctcaagcctgacaccctgtg

SEQ ID NO: 7184 - DNA, 201 bp, Homo sapiens
aggccagctgcagttggagacctttccgctgcccactcttctgttcccctgggacgttccttcagccatgctacagccctggaaagtgactataatgaggrcaatttggattactacgatgtgaatgaggaggaagctgaataccttccgggtgaaccagaggaggcattgaatggccacagcagcattgatgtttccttc

SEQ ID NO: 7185 - DNA, 201 bp, Homo sapiens
tctacgaagcccgattcagcaacctctacgtgggcaccaacggcatcatctccactcaggacttccccagggaaacgcagtatgtggactatgatttcccyaccgacttcccggccatcgccccttttctggcggacatcgacacgagccacggcagaggccgagtcctgtaccgagaggacacctcccccgcagtgctgg

SEQ ID NO: 7186 - DNA, 201 bp, Homo sapiens
aatgaggaggaagctgaataccttccgggtgaaccagaggaggcattgaatggccacagcagcattgatgtttccttccaatccaaagtggatacaaagcmtttagaggaatcttccaccttggatcctcacaccaaagaaggaacatctctgggagaggtagggggcccagatttaaaaggccaagttgagccctgggat

SEQ ID NO: 7187 - DNA, 201 bp, Homo sapiens
gacaatgctcccggcatgccttctgcacggactatgccactggcttctgctgccactgccaatccaagttttatggaaatgggaagcactgtctgcctgarggggcacctcaccgagtgaatgggaaagtgagtggccacctccacgtgggccatacacccgtgcacttcactgatgtggacctgcatgcgtatatcgtgg

SEQ ID NO: 7188 - DNA, 201 bp, Homo sapiens
cactcaggacttccccagggaaacgcagtatgtggactatgatttccccaccgacttcccggccatcgccccttttctggcggacatcgacacgagccacsgcagaggccgagtcctgtaccgagaggacacctcccccgcagtgctgggcctggccgcccgctatgtgcgcgctggcttcccgcgctctgcgcgctttac

SEQ ID NO: 7189 - DNA, 201 bp, Homo sapiens
gagacctttccgctgcccactcttctgttcccctgggacgttccttcagccatgctacagccctggaaagtgactataatgaggacaatttggattactaygatgtgaatgaggaggaagctgaataccttccgggtgaaccagaggaggcattgaatggccacagcagcattgatgtttccttccaatccaaagtggata

SEQ ID NO: 7190 - DNA, 201 bp, Homo sapiens
agaacatcacttaccaggtgtgcaggcacgcccccagacacccgtccttccccaccacccagcagctgaacgtggaccgggtctttgccttgtataatgaygaagaaagagtgcttagatttgctgtgaccaatcaaattggcccggtcaaagaggattcagaccccactccggtgaatccttgctatgatgggagccaca

SEQ ID NO: 7191 - DNA, 201 bp, Homo sapiens
tatgagtttgcagatgaccggcatacttgcatcttgatcaccccacctgccaacccctgtgaggatggcagtcatacctgtgctcctgctgggcaggcccrgtgtgttcaccatggaggcagcacgttcagctgtgcctgcctgcctggttatgccggcgatgggcaccagtgcactgatgtagatgaatgctcagaaaac

SEQ ID NO: 7192 - DNA, 201 bp, Homo sapiens
gaccgggtctttgccttgtataatgacgaagaaagagtgcttagatttgctgtgaccaatcaaattggcccggtcaaagaggattcagaccccactccggkgaatccttgctatgatgggagccacatgtgtgacacaacagcacggtgccatccagggacaggtgtagattacacctgtgagtgcgcatctgggtaccag

SEQ ID NO: 7193 - DNA, 201 bp, Homo sapiens
cctctacaagttccagagactactctctgacttttggtgcaatcaaccaaacatggtcctaccgcatccaccagaacatcacttaccaggtgtgcaggcaygcccccagacacccgtccttccccaccacccagcagctgaacgtggaccgggtctttgccttgtataatgacgaagaaagagtgcttagatttgctgtga

SEQ ID NO: 7194 - DNA, 201 bp, Homo sapiens
tgctgtctctgcatggctccataatcgtgggaattgattacgactgccgggagaggatggtgtactggacagatgttgctggacggacaatcagccgtgcyggtctggaactgggagcagagcctgagacgatcgtgaattcaggtctgataagccctgaaggacttgccatagaccacatccgcagaacaatgtactgga

SEQ ID NO: 7195 - DNA, 201 bp, Homo sapiens
cgcctcactgtggaccatcaccagagcccacccagaggcccccgaccatctgtgagcgctggagggaaaacctgctggagcactacggtggcaccccccgrgatgaccagtacgtgccccagtgcgatgacctgggccacttcatccccctgcagtgccacggaaagagcgacttctgctggtgtgtggacaaagatggca

SEQ ID NO: 7196 - DNA, 201 bp, Homo sapiens
atagtttcccaacaaaagttctaagattttttacctctgcatcagtgcatttctatttatatcaaaaggtgctaaaatgattcaatttgcattttctgatyctgtagtgcctctatagaagtacccacagaaagtaaagtatcacatttataaataccaaagatgtaacaattttaaaattttctagattactccaataaa

SEQ ID NO: 7197 - DNA, 201 bp, Homo sapiens
tcctgcccctacagtgtcatggcagcactggtttctgctggtgcgtggaccctgatggtcatgaagttcctggtacccagactccacctggctccaccccrcctcactgtggaccatcaccagagcccacccagaggcccccgaccatctgtgagcgctggagggaaaacctgctggagcactacggtggcaccccccggg

SEQ ID NO: 7198 - DNA, 201 bp, Homo sapiens
caaccaaacatggtcctaccgcatccaccagaacatcacttaccaggtgtgcaggcacgcccccagacacccgtccttccccaccacccagcagctgaacrtggaccgggtctttgccttgtataatgacgaagaaagagtgcttagatttgctgtgaccaatcaaattggcccggtcaaagaggattcagaccccactcc

SEQ ID NO: 7199 - DNA, 201 bp, Homo sapiens
cctcaatctttactactgtatttttaaaaatgaaggttgttattgcaagtttaaaaaggtaacagaattttaactgttgcttattaaagcaacttcttgtwaacatttatcattaatatttaaaagatcaaattcattcaactaagaattagagtttaagactctaaacctgatttttgccatggattccttctggccaag

SEQ ID NO: 7200 - DNA, 201 bp, Homo sapiens
ttatcattaatatttaaaagatcaaattcattcaactaagaattagagtttaagactctaaacctgatttttgccatggattccttctggccaagaaattwaagcacatgtgatcaatataacaatataatcctaaaccttgacagttggagaagccaatgcagaactgatgggaaaggaccaattatttatagtttccca

SEQ ID NO: 7201 - DNA, 201 bp, Homo sapiens
atgatgggagccacatgtgtgacacaacagcacggtgccatccagggacaggtgtagattacacctgtgagtgcgcatctgggtaccagggagatggacgkaactgtgtggatgaaaatgaatgtgcaactggctttcatcgctgtggccccaactctgtatgtatcaacttgcctggaagctacaggtgtgagtgccgga

SEQ ID NO: 7202 - DNA, 201 bp, Homo sapiens
ccacccagcagctgaacgtggaccgggtctttgccttgtataatgacgaagaaagagtgcttagatttgctgtgaccaatcaaattggcccggtcaaagargattcagaccccactccggtgaatccttgctatgatgggagccacatgtgtgacacaacagcacggtgccatccagggacaggtgtagattacacctgtg

SEQ ID NO: 7203 - DNA, 201 bp, Homo sapiens
aagttcctggtacccagactccacctggctccaccccgcctcactgtggaccatcaccagagcccacccagaggcccccgaccatctgtgagcgctggagrgaaaacctgctggagcactacggtggcaccccccgggatgaccagtacgtgccccagtgcgatgacctgggccacttcatccccctgcagtgccacggaa

SEQ ID NO: 7204 - DNA, 201 bp, Homo sapiens
gcgttgtgcagcgggtaagcgcacggccgagcgagcatggagggggaccgggtggccgggcggccggtgctgtcgtcgttaccagtgctactgctgctgcmgttgctaatgttgcgggccgcggcgctgcacccagacgagctcttcccacacggggagtcgtggggggaccagctcctgcaggaaggcgacgacgaaagc

SEQ ID NO: 7205 - DNA, 201 bp, Homo sapiens
atccagccctacccagatggagggccagtgccttcggaaatggatgttcccccagctcatcctgaagaagaaattgttcttcgaagttaccctgcttcagrtcacactacacccttaagtcgagggacgtatgaggtgggactggaagacaacataggttccaacaccgaggtcttcacgtataatgctgccaacaaggaa

SEQ ID NO: 7206 - DNA, 201 bp, Homo sapiens
ggtgctgtcgtcgttaccagtgctactgctgctgccgttgctaatgttgcgggccgcggcgctgcacccagacgagctcttcccacacggggagtcgtggkgggaccagctcctgcaggaaggcgacgacgaaagctcagccgtggtgaagctggcgaatcccctgcacttctacgaagcccgattcagcaacctctacgt

SEQ ID NO: 7207 - DNA, 201 bp, Homo sapiens
tcagccacatcccacagccagcagcccaggccctcctccccctcacaccaattggaggcctgtttggctggctctttgctttagaaaaacctggctctgakaacggcttcagcctcgcaggtgctgcctttacccatgacatggaagttacattctacccgggagaggagacggttcgtatcactcaaactgctgagggac

SEQ ID NO: 7208 - DNA, 201 bp, Homo sapiens
atctggtgaggaagagagggccctcgccagataccggacctgctgacaccttgatcttggacttcccatcttccaggaaggcctgacctcagttgttccarggtaaagaatttgggcagtgcccacacccacgctgttggataacatttcttcaccataccagtgagggtgaatgtgtacacgcccagcttcctgcctgtt

SEQ ID NO: 7209 - DNA, 201 bp, Homo sapiens
ttcttcaccataccagtgagggtgaatgtgtacacgcccagcttcctgcctgttactctccacagtatgcgaagaatatccctgacttctagccctgtgcrccttcttttgtttctgctgttgctactaatagccttggagatcatggttggtggtcactctctttgcttcaacttcactataaaatcattgtccagacct

SEQ ID NO: 7210 - DNA, 150 bp, Homo sapiens
acagagactctgaggaagcagtcacctcaggcctctccatcctagagacrgcagaaggacaaacatctcctgctggcacaaggaagtcataactcatgtgagtggagccatgtgggattaagaagtgataggagagcttgctgtctgtct

SEQ ID NO: 7211 - DNA, 201 bp, Homo sapiens
ctggtgtgaagcgcaggtcttcttgaataaaaatcttttccttcagtacaacagtgacaacaacatggtcaaacctctgggcctcctggggaagaaggtawatgccaccagcacttggggagaattgacccaaacgctgggagaagtggggcgagacctcaggatgctcctttgtgacatcaaaccccagataaagaccag

SEQ ID NO: 7212 - DNA, 201 bp, Homo sapiens
tgaataaaaatcttttccttcagtacaacagtgacaacaacatggtcaaacctctgggcctcctggggaagaaggtaaatgccaccagcacttggggagarttgacccaaacgctgggagaagtggggcgagacctcaggatgctcctttgtgacatcaaaccccagataaagaccagtgatccttccactctgcaagtcg

SEQ ID NO: 7213 - DNA, 201 bp, Homo sapiens
ggagaagtggggcgagacctcaggatgctcctttgtgacatcaaaccccagataaagaccagtgatccttccactctgcaagtcgagatgttttgtcaacrtgaagcagaacggtgcactggtgcatcctggcagttcgccaccaatggagagaaatccctcctctttgacgcaatgaacatgacctggacagtaattaat

SEQ ID NO: 7214 - DNA, 201 bp, Homo sapiens
agtgacaacaacatggtcaaacctctgggcctcctggggaagaaggtaaatgccaccagcacttggggagaattgacccaaacgctgggagaagtggggcragacctcaggatgctcctttgtgacatcaaaccccagataaagaccagtgatccttccactctgcaagtcgagatgttttgtcaacgtgaagcagaacgg

SEQ ID NO: 7215 - DNA, 201 bp, Homo sapiens
cagtgcccacacccacgctgttggataacatttcttcaccataccagtgagggtgaatgtgtacacgcccagcttcctgcctgttactctccacagtatgygaagaatatccctgacttctagccctgtgcgccttcttttgtttctgctgttgctactaatagccttggagatcatggttggtggtcactctctttgctt

SEQ ID NO: 7216 - DNA, 201 bp, Homo sapiens
catcaaaccccagataaagaccagtgatccttccactctgcaagtcgagatgttttgtcaacgtgaagcagaacggtgcactggtgcatcctggcagttcrccaccaatggagagaaatccctcctctttgacgcaatgaacatgacctggacagtaattaatcatgaagccagtaagatcaaggagacatggaagaaaga

SEQ ID NO: 7217 - DNA, 201 bp, Homo sapiens
aaaccccagataaagaccagtgatccttccactctgcaagtcgagatgttttgtcaacgtgaagcagaacggtgcactggtgcatcctggcagttcgccaycaatggagagaaatccctcctctttgacgcaatgaacatgacctggacagtaattaatcatgaagccagtaagatcaaggagacatggaagaaagacaga

SEQ ID NO: 7218 - DNA, 201 bp, Homo sapiens
gccagaaccgacagtgtcaccagtaaatgcttcagatatccactggtcttcttctagtctaccagatagatggatcatcctgggggcattcatcctgttasttttaatgggaattgttctcatctgtgtctggtggcaaaatggcagaagatccacctagaggtgataccacggcggcgcagagttgttcacctgtggtcc

SEQ ID NO: 7219 - DNA, 201 bp, Homo sapiens
taccggacctgctgacaccttgatcttggacttcccatcttccaggaaggcctgacctcagttgttccagggtaaagaatttgggcagtgcccacacccaygctgttggataacatttcttcaccataccagtgagggtgaatgtgtacacgcccagcttcctgcctgttactctccacagtatgcgaagaatatccctga

SEQ ID NO: 7220 - DNA, 201 bp, Homo sapiens; identical to SEQ ID NO: 7208

SEQ ID NO: 7221 - DNA, 201 bp, Homo sapiens; identical to SEQ ID NO: 7209

SEQ ID NO: 7222 - DNA, 150 bp, Homo sapiens; identical to SEQ ID NO: 7210

SEQ ID NO: 7223 - DNA, 201 bp, Homo sapiens; identical to SEQ ID NO: 7211

SEQ ID NO: 7224 - DNA, 201 bp, Homo sapiens; identical to SEQ ID NO: 7212

SEQ ID NO: 7225 - DNA, 201 bp, Homo sapiens; identical to SEQ ID NO: 7213

SEQ ID NO: 7226 - DNA, 201 bp, Homo sapiens; identical to SEQ ID NO: 7214

SEQ ID NO: 7227 - DNA, 201 bp, Homo sapiens; identical to SEQ ID NO: 7215

SEQ ID NO: 7228 - DNA, 201 bp, Homo sapiens; identical to SEQ ID NO: 7216

SEQ ID NO: 7229 - DNA, 201 bp, Homo sapiens; identical to SEQ ID NO: 7217

SEQ ID NO: 7230 - DNA, 201 bp, Homo sapiens
gccagaaccgacagtgtcaccagtaaatgcttcagatatccactggtcttcttctagtctaccagatagatggatcatcctgggggcattcatcctgttasttttaatgggaattgttctcatctgtgtctggtggcaaaatggtgagtggcaggctggtctctggcccttgaggacgtcttagtctggtaaggactcaag

SEQ ID NO: 7231 - DNA, 201 bp, Homo sapiens; identical to SEQ ID NO: 7219

SEQ ID NO: 7232 - DNA, 201 bp, Homo sapiens
caggctgctagcaaggcagtgagaagctcttggcagccaaatgggtgcattcagggctgatttatagagacccttggcttctccttctcctactccctgtytttctggcattttgtagcttgttagattttctgccagaggggtgggtcagagcagtggaggggagacatcgcccatgtgcttctgctactggtccttggg

SEQ ID NO: 7233 - DNA, 201 bp, Homo sapiens
ggcggcatagcgcacagcgcgccttagcagcagcagcagcagcagcagcatcggaggtacccccgccgtcgcagcccccgcgctggtgcagccaccctcgytccctctgctcttcctcccttcgctcgcaccatggctgatcagctgaccgaagaacagattgctgaattcaaggaagccttctccctatttgataaagat

SEQ ID NO: 7234 - DNA, 201 bp, Homo sapiens
gtgtcgtggacgccgtgccgttactcgtagtcaggcggcggcgcaggcggcggcggcggcatagcgcacagcgcgccttagcagcagcagcagcagcagcrgcatcggaggtacccccgccgtcgcagcccccgcgctggtgcagccaccctcgctccctctgctcttcctcccttcgctcgcaccatggctgatcagctg

SEQ ID NO: 7235 - DNA, 201 bp, Homo sapiens
ctagagtgaaacaggtgtcaggctgtcactgttcacacaaatttttaataagaaacatttaccaagggagcatctttggactctctgtttttaaaaccttytgaaccatgacttggagccggcagagtaggctgtggctgtggacttcagcacaaccatcaacattgctgttcaaagaaattacagtttacgtccattcca

SEQ ID NO: 7236 - DNA, 201 bp, Homo sapiens
atgcagcttgacgattgagcacagtcaggcctttgtattaaaaatgaaaaatgaaaaaacaaattcaaaacctattcaaatgggttctagttcaatttgtytagtataaattgtcatagctggtttactgaaaacaaacacatttaaaattggtttacctcaggatgacgtgcagaaaaatgggtgaaggataaaccgttg

SEQ ID NO: 7237 - DNA, 201 bp, Homo sapiens
cagcattgggtttccctcccaaggccccagcaccaacctctgagcccaagaccttgcctgaaaacaagcagataccgattgcttcatcctatttatggacrtgtaggtctagttgcattttcactggggggaggggggaaggtgaattatggtaacttttaatgatctattcaggcagtagagctcttaaggaaaaaaaaa

SEQ ID NO: 7238 - DNA, 201 bp, Homo sapiens
ccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggag

SEQ ID NO: 7239 - DNA, 201 bp, Homo sapiens
ggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccag

SEQ ID NO: 7240 - DNA, 201 bp, Homo sapiens
tctaaccctcaagtctttagaagctgggtggactcttagtggtcctgcagcgtatcctaaaagactacctttgaaacaggattcttgtatggccaggatcstgtctgggaaccagaaaccctacaccctccccctccagggaatgctgagttccagttttgagcagaggtgaggcagaatccactgtagccttccgccctg

SEQ ID NO: 7241 - DNA, 201 bp, Homo sapiens
gtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagt

SEQ ID NO: 7242 - DNA, 187 bp, Homo sapiens
aagttgcccttcaccatggctatttgaaaaggagatgtacttggacgtttctgtaaatcttgagataaactgtttggagatttaaccacctctctgatggrggaccaactctatggaaattgtaaatacgttttatttataaacctggcactgtattcaataaacatttctgcagcctttcatctct

SEQ ID NO: 7243 - DNA, 201 bp, Homo sapiens
tagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtg

SEQ ID NO: 7244 - DNA, 201 bp, Homo sapiens
gtccctgtaaaaccccctttaaaagcatattgcatttagtacagagctcttttttgaaatgaaggctggagatgtgcatttttcacggtgttaactggttrtatcttattagcaaggagattggggttttgagtgtttgcgtgggtggtttcaatttgccagggaacagtggcaggctgctagcaaggcagtgagaagctc

SEQ ID NO: 7245 - DNA, 201 bp, Homo sapiens
ggcatcctgctttagcctgagacttgccataagaaactgctgagtacttggcaaaccctttcatagttttgttctccatctgtttggggtaggtgttgagygaggcaaatggatctcgatatttcagatgggcttttgatgcactgttgccaaggaaggctttttctgattttttgacaaatgaatttttgcacactttca

SEQ ID NO: 7246 - DNA, 201 bp, Homo sapiens
tagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaa

SEQ ID NO: 7247 - DNA, 186 bp, Homo sapiens
cgctccggcagtggtgctgggagtgtcgtggacgccgtgccgttactcgtagtcaggcggcggcgcaggcggcggcggcggcatakcgcacagcgcgccttagcagcagcagcagcagcagcagcatcggaggtacccccgccgtcgcagcccccgcgctggtgcagccaccctcgctccctctgc

SEQ ID NO: 7248 - DNA, 141 bp, Homo sapiens
cgctccggcagtggtgctgggagtgtcgtggacgccgtgcygttactcgtagtcaggcggcggcgcaggcggcggcggcggcatagcgcacagcgcgccttagcagcagcagcagcagcagcagcatcggaggtacccccg

SEQ ID NO: 7249 - DNA, 201 bp, Homo sapiens
ccttctcctactccctgtctttctggcattttgtagcttgttagattttctgccagaggggtgggtcagagcagtggaggggagacatcgcccatgtgctkctgctactggtccttgggctgggtggttggtagaggagatgttgacactatgagctaagggttggcttttgtaattacctgaatctgaaaggaatgccta

SEQ ID NO: 7250 - DNA, 201 bp, Homo sapiens; identical to SEQ ID NO: 7233

SEQ ID NO: 7251 - DNA, 186 bp, Homo sapiens; identical to SEQ ID NO: 7247

SEQ ID NO: 7252 - DNA, 141 bp, Homo sapiens; identical to SEQ ID NO: 7248

SEQ ID NO: 7253 - DNA, 201 bp, Homo sapiens; identical to SEQ ID NO: 7234

SEQ ID NO: 7254 - DNA, 201 bp, Homo sapiens
atgcagcttgacgattgagcacagtcaggcctttgtattaaaaatgaaaaatgaaaaaacaaattcaaaacctattcaaatgggttctagttcaatttgtytagtataaattgtcatagctggtttactgaaaacaaacacatttaaaattggtttacctcaggatgacgtggtcctcttgtacttcgtgtgctccgaccc

SEQ ID NO: 7255 - DNA, 201 bp, Homo sapiens; identical to SEQ ID NO: 7235

SEQ ID NO: 7256 - DNA, 201 bp, Homo sapiens; identical to SEQ ID NO: 7238

SEQ ID NO: 7257 - DNA, 192 bp, Homo sapiens
cagcattgggtttccctcccaaggccccagcaccaacctctgagcccaagaccttgcctgaaaacaagcagataccgattgcttcatcctatttatggacrtgtaggtctagttgcattttcactggggggaggggggaaggtgaattatggtaacttttaatgatctattcaggcagtagagctcttaagg

SEQ ID NO: 7258 - DNA, 201 bp, Homo sapiens
gcctgactgggaaattaaagaaggctgatgctgtacgtgtgattacattcactggctgcatgggagaaacatactttgacaacaaacctataggtttgtgraatttccgagaaaaagaaggtgactgcaaaggatgcactgtcagtcctcaggtggaagatagtgaggggactattcaatttgatggagaaggttatgcat

SEQ ID NO: 7259 - DNA, 201 bp, Homo sapiens
atgtgaccgctgtgcccacggctatttcaacttccaagaaggaggctgcacagcttgtgaatgttctcatctgggtaataattgtgacccaaagactgggygatgcatttgccctcccaataccattggagagaaatgttctaaatgtgcacccaatacctggggccacagcattaccactggttgtaaggcttgtaactg

SEQ ID NO: 7260 - DNA, 201 bp, Homo sapiens
aaggctgggacctttggcctacaatcagcaaggggctgtgttccctgcaactgcaattcttttgggtctaagtcattcgactgtgaagagagtggacaatrttggtgccaacctggagtcacagggaagaaatgtgaccgctgtgcccacggctatttcaacttccaagaaggaggctgcacagcttgtgaatgttctcat

SEQ ID NO: 7261 - DNA, 201 bp, Homo sapiens
ttcagcaccaagaatgagtccggcatcattcttttgggaagtggagggacaccagcaccacctaggagaaaacgaaggcagactggacaggcctattatgyaatactcctcaacaggggccgtctggaagtgcatctctccacaggggcacgaacaatgaggaaaattgtgatcagaccagagccaaatctgtttcatgat

SEQ ID NO: 7262 - DNA, 201 bp, Homo sapiens
tcactgctgtctatgatgctggggttccagggcatttgtgtgatggacaatggcataaagtcactgccaacaagatcaaacaccgcattgagctcacagtygatgggaaccaggtggaagcccaaagcccaaacccagcatctacatcagctgacacaaatgaccctgtgtttgttggaggcttcccagatgacctcaagc

SEQ ID NO: 7263 - DNA, 201 bp, Homo sapiens
aaagttgatgtttcatgtggacaatggtgcgggcagattcactgctgtctatgatgctggggttccagggcatttgtgtgatggacaatggcataaagtcrctgccaacaagatcaaacaccgcattgagctcacagtcgatgggaaccaggtggaagcccaaagcccaaacccagcatctacatcagctgacacaaatga

SEQ ID NO: 7264 - DNA, 201 bp, Homo sapiens
caacgactggagttcttctggggatcagtagtcaaaaaatggatggaatgggtattgaaatgattgatgaaaagttgatgtttcatgtggacaatggtgcrggcagattcactgctgtctatgatgctggggttccagggcatttgtgtgatggacaatggcataaagtcactgccaacaagatcaaacaccgcattgagc

SEQ ID NO: 7265 - DNA, 201 bp, Homo sapiens
aacgaaggcagactggacaggcctattatgcaatactcctcaacaggggccgtctggaagtgcatctctccacaggggcacgaacaatgaggaaaattgtsatcagaccagagccaaatctgtttcatgatggaagagaacattccgttcatgtagagcgaactagaggcatctttacagttcaagtggatgaaaacagaa

SEQ ID NO: 7266 - DNA, 151 bp, Homo sapiens
cagcgactcctctggctcccgagaagtggatccggtcgcggccactacgaygccgggagccgccggggtcctcctccttctgctgctctccggaggcctcgggggcgtacaggcgcagcggccgcagcagcagcggcagtcacaggcacat

SEQ ID NO: 7267 - DNA, 122 bp, Homo sapiens
atttgtgcatgtacatagaattctttctgtattcagatggtgctaattcagactccagactgaattttaattcaagttctttctcaagtctataaataatattaaactgattatttcattct

SEQ ID NO: 7268 - DNA, 201 bp, Homo sapiens
caccaagggcattgtttttcaacatccagagattgttgcccacatggacctgatgagagaagatctccatttggaacctttttattggaaacttccagaayaatttgaaggaaagaagttgatggcctatgggggcaaactcaagtatgcaatctatttcgaggctcgggaagaaacaggtttctctacatataatcctca

SEQ ID NO: 7269 - DNA, 123 bp, Homo sapiens
aatttgtgcatgtacatagaattctttctgtattcagatggtgctaattcagactccagactgaattttaattcaagttctttctcaagtctataaataatattaaactgattatttcattct

SEQ ID NO: 7270 - DNA, 201 bp, Homo sapiens
gacaggcctattatgcaatactcctcaacaggggccgtctggaagtgcatctctccacaggggcacgaacaatgaggaaaattgtgatcagaccagagccraatctgtttcatgatggaagagaacattccgttcatgtagagcgaactagaggcatctttacagttcaagtggatgaaaacagaagatacatgcaaaacc

SEQ ID NO: 7271 - DNA, 124 bp, Homo sapiens
taatttgtgcatgtacatagaattctttctgtattcagatggtgctaattcagactccagactgaattttaattcaagttctttctcaagtctataaataatattaaactgattatttcattct

SEQ ID NO: 7272 - DNA, 201 bp, Homo sapiens
gaaatgacagagaaagaatggaaatattatggggatgatcctcgagtccatagaactgtgacccgagaagacttcttggatatactatatgatattcattrcattcttatcaaagctacttatggaaatttcatgcgacaaagcaggatttctgaaatctcaatggaggtagctgaacaaggacgtggaacaacaatgact

SEQ ID NO: 7273 - DNA, 201 bp, Homo sapiens
ggatccttggatttccaatgcaatgtaaatacaggccaatgcaactgtcatccaaaattctctggtgcaaaatgtacagagtgcagtcgaggtcactggarctaccctcgctgcaatctctgtgactgcttcctccctgggacagatgccacaacctgtgattcagagactaaaaaatgctcctgtagtgatcaaactggg

SEQ ID NO: 7274 - DNA, 199 bp, Homo sapiens
ccaggaagagtctgtcaaaacaagtatatcaagtaaaacaaacaaatatattttacctatatatgttaattaaactaatttgtgcatgtacatagaattcyttctgtattcagatggtgctaattcagactccagactgaattttaattcaagttctttctcaagtctataaataatattaaactgattatttcattct

SEQ ID NO: 7275 - DNA, 201 bp, Homo sapiens
tgaagaagaggaagaagatacagaacgtgttctccagcttatgattatcttagagggtaatgacttgagcatcagcacagcccaagatgaggtgtacctgsacccatctgaagaacatactaatgtattgttacttaaagaagaatcatttaccatacatggcacacattttccagtccgtagaaaggaatttatgacagt

SEQ ID NO: 7276 - DNA, 201 bp, Homo sapiens
gaagatacatgcaaaacctgacagttgaacagcctatcgaagttaaaaagcttttcgttgggggtgctccacctgaatttcaaccttccccactcagaaayattcctccttttgaaggctgcatatggaatcttgttattaactctgtccccatggactttgcaaggcctgtgtccttcaaaaatgctgacattggtcgct

SEQ ID NO: 7277 - DNA, 201 bp, Homo sapiens
ctggacagtgtgagtgcagagccaacgttcagggtcagagatgtgacaaatgcaaggctgggacctttggcctacaatcagcaaggggctgtgttccctgmaactgcaattcttttgggtctaagtcattcgactgtgaagagagtggacaatgttggtgccaacctggagtcacagggaagaaatgtgaccgctgtgccc

SEQ ID NO: 7278 - DNA, 201 bp, Homo sapiens
gggctgtgttccctgcaactgcaattcttttgggtctaagtcattcgactgtgaagagagtggacaatgttggtgccaacctggagtcacagggaagaaaygtgaccgctgtgcccacggctatttcaacttccaagaaggaggctgcacagcttgtgaatgttctcatctgggtaataattgtgacccaaagactgggcg

SEQ ID NO: 7279 - DNA, 201 bp, Homo sapiens
gaattgtcaagggattgccaaatgactgtcagcaatgtgcctgccctctgatttcttccagtaacaatttcagcccctcttgtgtcgcagaaggacttgaygactaccgctgcacggcttgtccacggggatatgaaggccagtactgtgaaaggtgtgcccctggctatactggcagtccaggcaaccctggaggctcct

SEQ ID NO: 7280 - DNA, 201 bp, Homo sapiens
atcaggaggagaatatagcaacttcgtcttctggaaacaactttggtcttgacttgaaagcagatgacaaaatatattttggtggcctgccaacgctgagwaacttgagtattcaataggccagaagtaaatctgaagaaatattccggctgcctcaaagatattgaaatttcaagaactccgtacaatatactcagtagt

SEQ ID NO: 7281 - DNA, 201 bp, Homo sapiens
cggactgcaaagcctgtaactgcagtgggttagggagcaaaaatgaggatccttgttttggcccctgtatctgcaaggaaaatgttgaaggaggagactgyagtcgttgcaaatccggcttcttcaatttgcaagaggataattggaaaggctgcgatgagtgtttctgttcaggggtttcaaacagatgtcagagttcct

SEQ ID NO: 7282 - DNA, 201 bp, Homo sapiens
gcgtacaggcgcagcggccgcagcagcagcggcagtcacaggcacatcagcaaagaggtttattccctgctgtcctgaatcttgcttctaatgctcttatyacgaccaatgcaacatgtggagaaaaaggacctgaaatgtactgcaaattggtagaacatgtccctgggcagcctgtgaggaacccgcagtgtcgaatct

SEQ ID NO: 7283 - DNA, 201 bp, Homo sapiens
cacaagagcaaagtccctgggagaattcattaaggagcttgcccgggatgcagaagctgtaaatgaaaaagctataaaactaaatgaaactctaggaactygagacgaggcctttgagagaaatttggaagggcttcagaaagagattgaccagatgattaaagaactgaggaggaaaaatctagagacacaaaaggaaat

SEQ ID NO: 7284 - DNA, 201 bp, Homo sapiens
gcaaaggatgcactgtcagtcctcaggtggaagatagtgaggggactattcaatttgatggagaaggttatgcattggtcagccgtcccattcgctggtamcccaacatctccactgtcatgttcaagttcagaacattttcttcgagtgctcttctgatgtatcttgccacacgagacctgagagatttcatgagtgtgg

SEQ ID NO: 7285 - DNA, 201 bp, Homo sapiens
ggcacgaacaatgaggaaaattgtgatcagaccagagccaaatctgtttcatgatggaagagaacattccgttcatgtagagcgaactagaggcatctttrcagttcaagtggatgaaaacagaagatacatgcaaaacctgacagttgaacagcctatcgaagttaaaaagcttttcgttgggggtgctccacctgaatt

SEQ ID NO: 7286 - DNA, 201 bp, Homo sapiens
tctgtgctgatggatattttggagatgcagttgatgcgaagaactgtcagccctgtcgctgtaatgccggtggctctttctctgaggtttgccacagtcaractggacagtgtgagtgcagagccaacgttcagggtcagagatgtgacaaatgcaaggctgggacctttggcctacaatcagcaaggggctgtgttccct

SEQ ID NO: 7287 - DNA, 201 bp, Homo sapiens
tgatgaggctaaaaacatctccttcaatgccactgcagccttcaaagcttacagcaatattaaggactatattgatgaagctgagaaagttgccaaagaarccaaagatcttgcacatgaagctacaaaactggcaacaggtcctcggggtttattaaaggaagatgccaaaggctgtcttcagaaaagcttcaggattct

SEQ ID NO: 7288 - DNA, 201 bp, Homo sapiens
tgttccagatcgcgtatgtgattgtgaaggcagctaactccccccggcctggaaactggattttggaacgctctcttgatgatgttgaatacaagccctgrcagtatcatgctgtgacagacacggagtgcctaacgctttacaatatttatccccgcactgggccaccgtcatatgccaaagatgatgaggtcatctgca

SEQ ID NO: 7289 - DNA, 201 bp, Homo sapiens
tgctcctctgattggccaattgacaaggcatgaaattgaaatgacagagaaagaatggaaatattatggggatgatcctcgagtccatagaactgtgaccygagaagacttcttggatatactatatgatattcattacattcttatcaaagctacttatggaaatttcatgcgacaaagcaggatttctgaaatctcaat

SEQ ID NO: 7290 - DNA, 201 bp, Homo sapiens
ttttgagagaagccacagataaaatcagagaagctaatcgcctatttgcagtaaatcagaaaaacatgactgcattggagaaaaagaaggaggctgttgaragcggcaaacgacaaattgagaacactttaaaagagggcaatgacatactcgatgaagccaaccgtcttgcagatgaaatcaactccatcatagactatg

SEQ ID NO: 7291 - DNA, 201 bp, Homo sapiens
tggattgatctgtgatggatgccctgtcgggtacacaggaccacgctgtgagaggtgtgcagaaggctattttggacaaccctctgtacctggaggatcaygtcagccatgccaatgcaatgacaaccttgacttctccatccctggcagctgtgacagcttgtctggctcctgtctgatatgtaaaccaggtacaacagg

SEQ ID NO: 7292 - DNA, 201 bp, Homo sapiens
acacagctaaagatgtactggcacagattacagagctccaccagaacctcgatggcctgaagaagaattacaataaactagcagacagcgtcgccaaaacraatgctgtggttaaagatccttccaagaacattgccgatgcagatgccactgtcaaaaatttagaacaggaagctgaccggctaatagataaactcaaac

SEQ ID NO: 7293 - DNA, 201 bp, Homo sapiens
gatcagcatcagtaacgcggaggcccggcaagccctgccgcacagctactactggagcgcgccggctccctatctgggaaacaaactcccagcagtaggargacagttgacatttaccatatcatatgaccttgaagaagaggaagaagatacagaacgtgttctccagcttatgattatcttagagggtaatgacttgag

SEQ ID NO: 7294 - DNA, 201 bp, Homo sapiens
accagagacacccgattacaaatgctattgatggaaagaacacttggtggcagagtcccagtattaagaatggaatcgaataccattatgtgacaattacmctggatttacagcaggtgttccagatcgcgtatgtgattgtgaaggcagctaactccccccggcctggaaactggattttggaacgctctcttgatgatg

SEQ ID NO: 7295 - DNA, 201 bp, Homo sapiens
agtgtttctgttcaggggtttcaaacagatgtcagagttcctactggacctatggcaaaatacaagatatgagtggctggtatctgactgaccttcctggycgcattcgagtggctccccagcaggacgacttggactcacctcagcagatcagcatcagtaacgcggaggcccggcaagccctgccgcacagctactact

SEQ ID NO: 7296 - DNA, 201 bp, Homo sapiens
gacctttggcctacaatcagcaaggggctgtgttccctgcaactgcaattcttttgggtctaagtcattcgactgtgaagagagtggacaatgttggtgcyaacctggagtcacagggaagaaatgtgaccgctgtgcccacggctatttcaacttccaagaaggaggctgcacagcttgtgaatgttctcatctgggtaa

SEQ ID NO: 7297 - DNA, 201 bp, Homo sapiens
ctgaaatgtactgcaaattggtagaacatgtccctgggcagcctgtgaggaacccgcagtgtcgaatctgcaatcaaaacagcagcaatccaaaccagagmcacccgattacaaatgctattgatggaaagaacacttggtggcagagtcccagtattaagaatggaatcgaataccattatgtgacaattacactggatt

SEQ ID NO: 7298 - DNA, 201 bp, Homo sapiens
tggaactgaggggcgttcaacctgtatcatgcccagccaactaataaaaataagtgtaaccccaggaagagtctgtcaaaacaagtatatcaagtaaaacmaacaaatatattttacctatatatgttaattaaactaatttgtgcatgtacatagaattctttctgtattcagatggtgctaattcagactccagactga

SEQ ID NO: 7299 - DNA, 201 bp, Homo sapiens
atcgcctatttgcagtaaatcagaaaaacatgactgcattggagaaaaagaaggaggctgttgaaagcggcaaacgacaaattgagaacactttaaaagarggcaatgacatactcgatgaagccaaccgtcttgcagatgaaatcaactccatcatagactatgttgaagacatccaaactaaattgccacctatgtctg

SEQ ID NO: 7300 - DNA, 201 bp, Homo sapiens
atactggcagtccaggcaaccctggaggctcctgccaagaatgtgagtgtgatccctatggctcactgcctgtgccctgtgaccctgtcacaggattctgmacgtgccgacctggagccacgggaaggaagtgtgacggctgcaagcactggcatgcacgcgagggctgggagtgtgttttttgtggagatgagtgcactg

SEQ ID NO: 7301 - DNA, 201 bp, Homo sapiens
acaccccttagaaaatggagagattcacatctctttaatcaatgggagaccaagtgccgatgatccttctccagaactgctagaatttacctccgctcgcyatattcgcctgagatttcagaggatccgcacactgaatgctgacttgatgatgtttgctcacaaagacccaagagaaattgaccccattgtcaccagaag

SEQ ID NO: 7302 - DNA, 201 bp, Homo sapiens
ttgaaaatatgactcaggagctaaagcacttgctgtcacctcagcgggccccagagaggcttattcagctggcagagggcaatctgaatacactcgtgacmgaaatgaacgagctgctgaccagggctaccaaagtgacagcagatggcgagcagaccggacaggatgctgagaggaccaacacaagagcaaagtccctgg

SEQ ID NO: 7303 - DNA, 201 bp, Homo sapiens
tctctgtgactgcttcctccctgggacagatgccacaacctgtgattcagagactaaaaaatgctcctgtagtgatcaaactgggcagtgcacttgtaagrtgaatgtggaaggcatccactgtgacagatgccggcctggcaaattcggactcgatgccaagaatccacttggctgcagcagctgctattgcttcggcac

SEQ ID NO: 7304 - DNA, 201 bp, Homo sapiens
gaaatattcctccttttgaaggctgcatatggaatcttgttattaactctgtccccatggactttgcaaggcctgtgtccttcaaaaatgctgacattggwcgctgtgcccatcagaaactccgtgaagatgaagatggagcagctccagctgaaatagttatccagcctgagccagttcccaccccagcctttcctacgc

SEQ ID NO: 7305 - DNA, 201 bp, Homo sapiens
tgtctgatatgtaaaccaggtacaacaggccggtactgtgagctctgtgctgatggatattttggagatgcagttgatgcgaagaactgtcagccctgtckctgtaatgccggtggctctttctctgaggtttgccacagtcaaactggacagtgtgagtgcagagccaacgttcagggtcagagatgtgacaaatgcaag

SEQ ID NO: 7306 - DNA, 201 bp, Homo sapiens
taaagcacttgctgtcacctcagcgggccccagagaggcttattcagctggcagagggcaatctgaatacactcgtgaccgaaatgaacgagctgctgacsagggctaccaaagtgacagcagatggcgagcagaccggacaggatgctgagaggaccaacacaagagcaaagtccctgggagaattcattaaggagcttg

SEQ ID NO: 7307 - DNA, 201 bp, Homo sapiens
aactttagcccaacgtgccatttagaccggagtcttggattgatctgtgatggatgccctgtcgggtacacaggaccacgctgtgagaggtgtgcagaagrctattttggacaaccctctgtacctggaggatcatgtcagccatgccaatgcaatgacaaccttgacttctccatccctggcagctgtgacagcttgtct

SEQ ID NO: 7308 - DNA, 201 bp, Homo sapiens
gcgccggctccctatctgggaaacaaactcccagcagtaggaggacagttgacatttaccatatcatatgaccttgaagaagaggaagaagatacagaacrtgttctccagcttatgattatcttagagggtaatgacttgagcatcagcacagcccaagatgaggtgtacctgcacccatctgaagaacatactaatgta

SEQ ID NO: 7309 - DNA, 201 bp, Homo sapiens
tactacccagtgctctgaagcaaaaggactgatccggacgtgggtgactctgaaggctgagcagaccattctacccctggtagatgaggctctgcagcacrcgaccaccaagggcattgtttttcaacatccagagattgttgcccacatggacctgatgagagaagatctccatttggaacctttttattggaaacttcc

SEQ ID NO: 7310 - DNA, 201 bp, Homo sapiens
aaacccagcatctacatcagctgacacaaatgaccctgtgtttgttggaggcttcccagatgacctcaagcagtttggcctaacaaccagtattccgttcygaggttgcatcagatccctgaagctcaccaaaggcacaggcaagccactggaggttaattttgccaaggccctggaactgaggggcgttcaacctgtatc

SEQ ID NO: 7311 - DNA, 201 bp, Homo sapiens
cagtccaggcaaccctggaggctcctgccaagaatgtgagtgtgatccctatggctcactgcctgtgccctgtgaccctgtcacaggattctgcacgtgcygacctggagccacgggaaggaagtgtgacggctgcaagcactggcatgcacgcgagggctgggagtgtgttttttgtggagatgagtgcactggccttct

SEQ ID NO: 7312 - DNA, 201 bp, Homo sapiens
ctgtgacagatgccggcctggcaaattcggactcgatgccaagaatccacttggctgcagcagctgctattgcttcggcactactacccagtgctctgaarcaaaaggactgatccggacgtgggtgactctgaaggctgagcagaccattctacccctggtagatgaggctctgcagcacacgaccaccaagggcattgt

SEQ ID NO: 7313 - DNA, 201 bp, Homo sapiens
tttcctaagcctggttttgtggagctctcccctgtgccaattgatgtaggaacagaaatcaacctgtcattcagcaccaagaatgagtccggcatcattcytttgggaagtggagggacaccagcaccacctaggagaaaacgaaggcagactggacaggcctattatgcaatactcctcaacaggggccgtctggaagtg

SEQ ID NO: 7314 - DNA, 201 bp, Homo sapiens; identical to SEQ ID NO: 7258

SEQ ID NO: 7315 - DNA, 201 bp, Homo sapiens; identical to SEQ ID NO: 7259

SEQ ID NO: 7316 - DNA, 201 bp, Homo sapiens; identical to SEQ ID NO: 7260

SEQ ID NO: 7317 - DNA, 201 bp, Homo sapiens; identical to SEQ ID NO: 7262

SEQ ID NO: 7318 - DNA, 201 bp, Homo sapiens; identical to SEQ ID NO: 7261

SEQ ID NO: 7319 - DNA, 201 bp, Homo sapiens; identical to SEQ ID NO: 7263

SEQ ID NO: 7320 - DNA, 201 bp, Homo sapiens; identical to SEQ ID NO: 7264

SEQ ID NO: 7321 - DNA, 201 bp, Homo sapiens; identical to SEQ ID NO: 7265

SEQ ID NO: 7322 - DNA, 151 bp, Homo sapiens; identical to SEQ ID NO: 7266

SEQ ID NO: 7323 - DNA, 122 bp, Homo sapiens; identical to SEQ ID NO: 7267

SEQ ID NO: 7324 - DNA, 201 bp, Homo sapiens; identical to SEQ ID NO: 7268

SEQ ID NO: 7325 - DNA, 123 bp, Homo sapiens; identical to SEQ ID NO: 7269

SEQ ID NO: 7326 - DNA, 201 bp, Homo sapiens; identical to SEQ ID NO: 7270

SEQ ID NO: 7327 - DNA, 124 bp, Homo sapiens; identical to SEQ ID NO: 7271

SEQ ID NO: 7328 - DNA, 201 bp, Homo sapiens; identical to SEQ ID NO: 7272

SEQ ID NO: 7329 - DNA, 201 bp, Homo sapiens; identical to SEQ ID NO: 7273

SEQ ID NO: 7330 - DNA, 199 bp, Homo sapiens; identical to SEQ ID NO: 7274

SEQ ID NO: 7331 - DNA, 201 bp, Homo sapiens; identical to SEQ ID NO: 7276

SEQ ID NO: 7332 - DNA, 201 bp, Homo sapiens; identical to SEQ ID NO: 7275

SEQ ID NO: 7333 - DNA, 201 bp, Homo sapiens; identical to SEQ ID NO: 7277

SEQ ID NO: 7334 - DNA, 201 bp, Homo sapiens; identical to SEQ ID NO: 7278

SEQ ID NO: 7335 - DNA, 201 bp, Homo sapiens; identical to SEQ ID NO: 7279

SEQ ID NO: 7336 - DNA, 201 bp, Homo sapiens
atcaggaggagaatatagcaacttcgtcttctggaaacaactttggtcttgacttgaaagcagatgacaaaatatattttggtggcctgccaacgctgagwaacttgaggccagaagtaaatctgaagaaatattccggctgcctcaaagatattgaaatttcaagaactccgtacaatatactcagtagtcccgattatg

SEQ ID NO: 7337 - DNA, 201 bp, Homo sapiens; identical to SEQ ID NO: 7281

SEQ ID NO: 7338 - DNA, 201 bp, Homo sapiens; identical to SEQ ID NO: 7282

SEQ ID NO: 7339 - DNA, 201 bp, Homo sapiens; identical to SEQ ID NO: 7283

SEQ ID NO: 7340 - DNA, 201 bp, Homo sapiens; identical to SEQ ID NO: 7285

SEQ ID NO: 7341 - DNA, 201 bp, Homo sapiens; identical to SEQ ID NO: 7284

SEQ ID NO: 7342 - DNA, 201 bp, Homo sapiens; identical to SEQ ID NO: 7286

SEQ ID NO: 7343 - DNA, 201 bp, Homo sapiens; identical to SEQ ID NO: 7287

SEQ ID NO: 7344 - DNA, 201 bp, Homo sapiens; identical to SEQ ID NO: 7288

SEQ ID NO: 7345 - DNA, 201 bp, Homo sapiens; identical to SEQ ID NO: 7289

SEQ ID NO: 7346 - DNA, 201 bp, Homo sapiens; identical to SEQ ID NO: 7290

SEQ ID NO: 7347 - DNA, 201 bp, Homo sapiens; identical to SEQ ID NO: 7291

SEQ ID NO: 7348 - DNA, 201 bp, Homo sapiens; identical to SEQ ID NO: 7292

SEQ ID NO: 7349 - DNA, 201 bp, Homo sapiens; identical to SEQ ID NO: 7294

SEQ ID NO: 7350 - DNA, 201 bp, Homo sapiens; identical to SEQ ID NO: 7293

SEQ ID NO: 7351 - DNA, 201 bp, Homo sapiens; identical to SEQ ID NO: 7295

SEQ ID NO: 7352 - DNA, 201 bp, Homo sapiens; identical to SEQ ID NO: 7296

SEQ ID NO: 7353 - DNA, 201 bp, Homo sapiens; identical to SEQ ID NO: 7297

SEQ ID NO: 7354 - DNA, 201 bp, Homo sapiens; identical to SEQ ID NO: 7298

SEQ ID NO: 7355 - DNA, 201 bp, Homo sapiens; identical to SEQ ID NO: 7299

SEQ ID NO: 7356 - DNA, 201 bp, Homo sapiens; identical to SEQ ID NO: 7300

SEQ ID NO: 7357 - DNA, 201 bp, Homo sapiens; identical to SEQ ID NO: 7301

SEQ ID NO: 7358 - DNA, 201 bp, Homo sapiens; identical to SEQ ID NO: 7302

SEQ ID NO: 7359 - DNA, 201 bp, Homo sapiens; identical to SEQ ID NO: 7303

SEQ ID NO: 7360 - DNA, 201 bp, Homo sapiens; identical to SEQ ID NO: 7304

SEQ ID NO: 7361 - DNA, 201 bp, Homo sapiens; identical to SEQ ID NO: 7306

SEQ ID NO: 7362 - DNA, 201 bp, Homo sapiens; identical to SEQ ID NO: 7305

SEQ ID NO: 7363 - DNA, 201 bp, Homo sapiens; identical to SEQ ID NO: 7309

SEQ ID NO: 7364 - DNA, 201 bp, Homo sapiens; identical to SEQ ID NO: 7308

SEQ ID NO: 7365 - DNA, 201 bp, Homo sapiens; identical to SEQ ID NO: 7307

SEQ ID NO: 7366 - DNA, 201 bp, Homo sapiens; identical to SEQ ID NO: 7310

SEQ ID NO: 7367 - DNA, 201 bp, Homo sapiens; identical to SEQ ID NO: 7311

SEQ ID NO: 7368 - DNA, 201 bp, Homo sapiens; identical to SEQ ID NO: 7312

SEQ ID NO: 7369 - DNA, 201 bp, Homo sapiens; identical to SEQ ID NO: 7313

SEQ ID NO: 7370 - DNA, 201 bp, Homo sapiens; identical to SEQ ID NO: 7258

SEQ ID NO: 7371 - DNA, 201 bp, Homo sapiens; identical to SEQ ID NO: 7259

SEQ ID NO: 7372 - DNA, 201 bp, Homo sapiens; identical to SEQ ID NO: 7260

SEQ ID NO: 7373 - DNA, 201 bp, Homo sapiens; identical to SEQ ID NO: 7261

SEQ ID NO: 7374 - DNA, 201 bp, Homo sapiens; identical to SEQ ID NO: 7262

SEQ ID NO: 7375 - DNA, 201 bp, Homo sapiens; identical to SEQ ID NO: 7263

SEQ ID NO: 7376 - DNA, 201 bp, Homo sapiens; identical to SEQ ID NO: 7264

SEQ ID NO: 7377 - DNA, 201 bp, Homo sapiens; identical to SEQ ID NO: 7265

SEQ ID NO: 7378 - DNA, 151 bp, Homo sapiens; identical to SEQ ID NO: 7266

SEQ ID NO: 7379 - DNA, 122 bp, Homo sapiens; identical to SEQ ID NO: 7267

SEQ ID NO: 7380 - DNA, 201 bp, Homo sapiens; identical to SEQ ID NO: 7268

SEQ ID NO: 7381 - DNA, 123 bp, Homo sapiens; identical to SEQ ID NO: 7269

SEQ ID NO: 7382 - DNA, 201 bp, Homo sapiens; identical to SEQ ID NO: 7270

SEQ ID NO: 7383 - DNA, 124 bp, Homo sapiens; identical to SEQ ID NO: 7271

SEQ ID NO: 7384 - DNA, 201 bp, Homo sapiens; identical to SEQ ID NO: 7272

SEQ ID NO: 7385 - DNA, 201 bp, Homo sapiens; identical to SEQ ID NO: 7273

SEQ ID NO: 7386 - DNA, 199 bp, Homo sapiens; identical to SEQ ID NO: 7274

SEQ ID NO: 7387 - DNA, 201 bp, Homo sapiens; identical to SEQ ID NO: 7275

SEQ ID NO: 7388 - DNA, 201 bp, Homo sapiens; identical to SEQ ID NO: 7276

SEQ ID NO: 7389 - DNA, 201 bp, Homo sapiens; identical to SEQ ID NO: 7277

SEQ ID NO: 7390 - DNA, 201 bp, Homo sapiens; identical to SEQ ID NO: 7278

SEQ ID NO: 7391 - DNA, 201 bp, Homo sapiens; identical to SEQ ID NO: 7279

SEQ ID NO: 7392 - DNA, 201 bp, Homo sapiens; identical to SEQ ID NO: 7280

SEQ ID NO: 7393 - DNA, 201 bp, Homo sapiens; identical to SEQ ID NO: 7281

SEQ ID NO: 7394 - DNA, 201 bp, Homo sapiens; identical to SEQ ID NO: 7282

SEQ ID NO: 7395 - DNA, 201 bp, Homo sapiens; identical to SEQ ID NO: 7283

SEQ ID NO: 7396 - DNA, 201 bp, Homo sapiens; identical to SEQ ID NO: 7285

SEQ ID NO: 7397 - DNA, 201 bp, Homo sapiens; identical to SEQ ID NO: 7284

SEQ ID NO: 7398 - DNA, 201 bp, Homo sapiens; identical to SEQ ID NO: 7286

SEQ ID NO: 7399 - DNA, 201 bp, Homo sapiens; identical to SEQ ID NO: 7287

SEQ ID NO: 7400 - DNA, 201 bp, Homo sapiens; identical to SEQ ID NO: 7288

SEQ ID NO: 7401 - DNA, 201 bp, Homo sapiens; identical to SEQ ID NO: 7290

SEQ ID NO: 7402 - DNA, 201 bp, Homo sapiens; identical to SEQ ID NO: 7289

SEQ ID NO: 7403 - DNA, 201 bp, Homo sapiens; identical to SEQ ID NO: 7291

SEQ ID NO: 7404 - DNA, 201 bp, Homo sapiens
acacagctaaagatgtactggcacagattacagagctccaccagaacctcgatggcctgaagaagaattacaataaactagcagacagcgtcgccaaaacraatgctgtggttaaagatccttccaagaacattctatgcagttgccgatgcagatgccactgtcaaaaatttagaacaggaagctgaccggctaatagat

SEQ ID NO: 7405 - DNA, 201 bp, Homo sapiens; identical to SEQ ID NO: 7293

SEQ ID NO: 7406 - DNA, 201 bp, Homo sapiens; identical to SEQ ID NO: 7294

SEQ ID NO: 7407 - DNA, 201 bp, Homo sapiens; identical to SEQ ID NO: 7295

SEQ ID NO: 7408 - DNA, 201 bp, Homo sapiens; identical to SEQ ID NO: 7296

SEQ ID NO: 7409 - DNA, 201 bp, Homo sapiens; identical to SEQ ID NO: 7297

SEQ ID NO: 7410 - DNA, 201 bp, Homo sapiens; identical to SEQ ID NO: 7298

SEQ ID NO: 7411 - DNA, 201 bp, Homo sapiens; identical to SEQ ID NO: 7299

SEQ ID NO: 7412 - DNA, 201 bp, Homo sapiens; identical to SEQ ID NO: 7300

SEQ ID NO: 7413 - DNA, 201 bp, Homo sapiens; identical to SEQ ID NO: 7301

SEQ ID NO: 7414 - DNA, 201 bp, Homo sapiens; identical to SEQ ID NO: 7302

SEQ ID NO: 7415 - DNA, 201 bp, Homo sapiens; identical to SEQ ID NO: 7303

SEQ ID NO: 7416 - DNA, 201 bp, Homo sapiens; identical to SEQ ID NO: 7304

SEQ ID NO: 7417 - DNA, 201 bp, Homo sapiens; identical to SEQ ID NO: 7305

SEQ ID NO: 7418 - DNA, 201 bp, Homo sapiens; identical to SEQ ID NO: 7306

SEQ ID NO: 7419 - DNA, 201 bp, Homo sapiens; identical to SEQ ID NO: 7307

SEQ ID NO: 7420 - DNA, 201 bp, Homo sapiens; identical to SEQ ID NO: 7308

SEQ ID NO: 7421 - DNA, 201 bp, Homo sapiens; identical to SEQ ID NO: 7309

SEQ ID NO: 7422 - DNA, 201 bp, Homo sapiens; identical to SEQ ID NO: 7310

SEQ ID NO: 7423 - DNA, 201 bp, Homo sapiens; identical to SEQ ID NO: 7311

SEQ ID NO: 7424 - DNA, 201 bp, Homo sapiens; identical to SEQ ID NO: 7312

SEQ ID NO: 7425 - DNA, 201 bp, Homo sapiens; identical to SEQ ID NO: 7313

SEQ ID NO: 7426 - DNA, 201 bp, Homo sapiens
ggcaagggtctgctccctgtacggtggatggcaccggagtccctgaaggatggggtcttcaccacttcttctgacatgtggtcctttggcgtggtcctttsggaaatcaccagcttggcagaacagccttaccaaggcctgtctaatgaacaggtgttgaaatttgtcatggatggagggtatctggatcaacccgacaac

SEQ ID NO: 7427 - DNA, 201 bp, Homo sapiens
atatggtgatgaggagctgcatctctgcgtctcccgcaagcacttcgctctggaacggggctgcaggctgcgtgggctgtcaccggggaactacagcgtgygaatccgggccacctcccttgcgggcaacggctcttggacggaacccacctatttctacgtgacagactattacgtcccgtcaaatattgcaaaaattat

SEQ ID NO: 7428 - DNA, 201 bp, Homo sapiens
cctgagaaagaggcagccagatgggccgctgggaccgctttacgcttcttcaaaccctgagtatctcagtgccagtgatgtgtttccatgctctgtgtacrtgccggacgagtgggaggtgtctcgagagaagatcaccctccttcgagagctggggcagggctccttcggcatggtgtatgagggcaatgccagggacat

SEQ ID NO: 7429 - DNA, 201 bp, Homo sapiens
acatcatttatgtccagacagatgccaccaacccctctgtgcccctggatccaatctcagtgtctaactcatcatcccagattattctgaagtggaaaccmccctccgaccccaatggcaacatcacccactacctggttttctgggagaggcaggcggaagacagtgagctgttcgagctggattattgcctcaaagggc

SEQ ID NO: 7430 - DNA, 201 bp, Homo sapiens
ttcttcaaaccctgagtatctcagtgccagtgatgtgtttccatgctctgtgtacgtgccggacgagtgggaggtgtctcgagagaagatcaccctccttygagagctggggcagggctccttcggcatggtgtatgagggcaatgccagggacatcatcaagggtgaggcagagacccgcgtggcggtgaagacggtcaa

SEQ ID NO: 7431 - DNA, 201 bp, Homo sapiens
gccagtgatgtgtttccatgctctgtgtacgtgccggacgagtgggaggtgtctcgagagaagatcaccctccttcgagagctggggcagggctccttcgkcatggtgtatgagggcaatgccagggacatcatcaagggtgaggcagagacccgcgtggcggtgaagacggtcaacgagtcagccagtctccgagagcgg

SEQ ID NO: 7432 - DNA, 201 bp, Homo sapiens
tgtcaaaattggagactttggaatgaccagagacatctatgaaacggattactaccggaaagggggcaagggtctgctccctgtacggtggatggcaccgragtccctgaaggatggggtcttcaccacttcttctgacatgtggtcctttggcgtggtcctttgggaaatcaccagcttggcagaacagccttaccaagg

SEQ ID NO: 7433 - DNA, 201 bp, Homo sapiens
ctttccttcttccggaagttacgtctgattcgaggagagaccttggaaattgggaactactccttctatgccttggacaaccagaacctaaggcagctctsggactggagcaaacacaacctcaccatcactcaggggaaactcttcttccactataaccccaaactctgcttgtcagaaatccacaagatggaagaagtt

SEQ ID NO: 7434 - DNA, 201 bp, Homo sapiens
tgtcatcgaaggacacttgcagatactcttgatgttcaaaacgaggcccgaagatttccgagacctcagtttccccaaactcatcatgatcactgattacytgctgctcttccgggtctatgggctcgagagcctgaaggacctgttccccaacctcacggtcatccggggatcacgactgttctttaactacgcgctggt

SEQ ID NO: 7435 - DNA, 201 bp, Homo sapiens
tcaaaattggagactttggaatgaccagagacatctatgaaacggattactaccggaaagggggcaagggtctgctccctgtacggtggatggcaccggastccctgaaggatggggtcttcaccacttcttctgacatgtggtcctttggcgtggtcctttgggaaatcaccagcttggcagaacagccttaccaaggcc

SEQ ID NO: 7436 - DNA, 201 bp, Homo sapiens
caatctggcagctgagctagaagccaacctcggcctcattgaagaaatttcagggtatctaaaaatccgccgatcctacgctctggtgtcactttccttcktccggaagttacgtctgattcgaggagagaccttggaaattgggaactactccttctatgccttggacaaccagaacctaaggcagctctgggactggag

SEQ ID NO: 7437 - DNA, 201 bp, Homo sapiens
tccgggtacacgatgaattccagcaacttgctgtgcaccccatgcctgggtccctgtcccaaggtgtgccacctcctagaaggcgagaagaccatcgactyggtgacgtctgcccaggagctccgaggatgcaccgtcatcaacgggagtctgatcatcaacattcgaggaggcaacaatctggcagctgagctagaagcc

SEQ ID NO: 7438 - DNA, 201 bp, Homo sapiens
agccgtactggccccccgacttccgagacctcttggggttcatgctgttctacaaagaggccccttatcagaatgtgacggagttcgacgggcaggatgcrtgtggttccaacagttggacggtggtagacattgacccacccctgaggtccaacgaccccaaatcacagaaccacccagggtggctgatgcggggtctca

SEQ ID NO: 7439 - DNA, 201 bp, Homo sapiens
ggctgcaccgccgaaggcctctgttgccacagcgagtgcctgggcaactgttctcagcccgacgaccccaccaagtgcgtggcctgccgcaacttctaccyggacggcaggtgtgtggagacctgcccgcccccgtactaccacttccaggactggcgctgtgtgaacttcagcttctgccaggacctgcaccacaaatgc

SEQ ID NO: 7440 - DNA, 201 bp, Homo sapiens
gggcagtttgtcgaacgatgttggactcatagtcactgccagaaagtttgcccgaccatctgtaagtcacacggctgcaccgccgaaggcctctgttgccrcagcgagtgcctgggcaactgttctcagcccgacgaccccaccaagtgcgtggcctgccgcaacttctacctggacggcaggtgtgtggagacctgcccg

SEQ ID NO: 7441 - DNA, 201 bp, Homo sapiens
tggggccaagagtgacatcatttatgtccagacagatgccaccaacccctctgtgcccctggatccaatctcagtgtctaactcatcatcccagattattytgaagtggaaaccaccctccgaccccaatggcaacatcacccactacctggttttctgggagaggcaggcggaagacagtgagctgttcgagctggatta

SEQ ID NO: 7442 - DNA, 201 bp, Homo sapiens
cagtgtctaactcatcatcccagattattctgaagtggaaaccaccctccgaccccaatggcaacatcacccactacctggttttctgggagaggcaggcrgaagacagtgagctgttcgagctggattattgcctcaaagggctgaagctgccctcgaggacctggtctccaccattcgagtctgaagattctcagaagc

SEQ ID NO: 7443 - DNA, 201 bp, Homo sapiens
cccagattattctgaagtggaaaccaccctccgaccccaatggcaacatcacccactacctggttttctgggagaggcaggcggaagacagtgagctgttygagctggattattgcctcaaagggctgaagctgccctcgaggacctggtctccaccattcgagtctgaagattctcagaagcacaaccagagtgagtatg

SEQ ID NO: 7444 - DNA, 201 bp, Homo sapiens
agtcgctggtcatctccggcttgcgacacttcacgggctatcgcatcgagctgcaggcttgcaaccaggacacccctgaggaacggtgcagtgtggcagcytacgtcagtgcgaggaccatgcctgaagccaaggctgatgacattgttggccctgtgacgcatgaaatctttgagaacaacgtcgtccacttgatgtggc

SEQ ID NO: 7445 - DNA, 201 bp, Homo sapiens
agctactcatcccggctggctgcagagtttacagggcccgggatgaaaacacagggcccaggtttcctgtccatgaagccggctctgcccctgatccttcygatgcatccaccgtgcgtctgctcacctgtcttgctttctgttcattttctcttgtagtgtgtcccggcatggatatccggaacaacctcactaggttgc

SEQ ID NO: 7446 - DNA, 201 bp, Homo sapiens
aagatcaccctccttcgagagctggggcagggctccttcggcatggtgtatgagggcaatgccagggacatcatcaagggtgaggcagagacccgcgtggyggtgaagacggtcaacgagtcagccagtctccgagagcggattgagttcctcaatgaggcctcggtcatgaagggcttcacctgccatcacgtggtgcgc

SEQ ID NO: 7447 - DNA, 201 bp, Homo sapiens
gggacatgagttggtctgcctgttgtggggccgggaaggggagggagtcaggcacaagtggcctctttgtttggtcttaaaggcatccatttctgggaatkaagccatgttcgctgctaacacttttggatgttgtgaggccacgtggagtgtgtgagagactaggttttatggatggtctggttcaggtaccaggtctgc

SEQ ID NO: 7448 - DNA, 201 bp, Homo sapiens
aaactcatcatgatcactgattacttgctgctcttccgggtctatgggctcgagagcctgaaggacctgttccccaacctcacggtcatccggggatcacsactgttctttaactacgcgctggtcatcttcgagatggttcacctcaaggaactcggcctctacaacctgatgaacatcacccggggttctgtccgcatc

SEQ ID NO: 7449 - DNA, 201 bp, Homo sapiens
catctcggaaacgcaggtcccttggcgatgttgggaatgtgacggtggccgtgcccacggtggcagctttccccaacacttcctcgaccagcgtgcccacragtccggaggagcacaggccttttgagaaggtggtgaacaaggagtcgctggtcatctccggcttgcgacacttcacgggctatcgcatcgagctgcagg

SEQ ID NO: 7450 - DNA, 201 bp, Homo sapiens
tgctgagatgggagccgtactggccccccgacttccgagacctcttggggttcatgctgttctacaaagaggccccttatcagaatgtgacggagttcgaygggcaggatgcatgtggttccaacagttggacggtggtagacattgacccacccctgaggtccaacgaccccaaatcacagaaccacccagggtggctga

SEQ ID NO: 7451 - DNA, 201 bp, Homo sapiens
gacgaccccaccaagtgcgtggcctgccgcaacttctacctggacggcaggtgtgtggagacctgcccgcccccgtactaccacttccaggactggcgctrtgtgaacttcagcttctgccaggacctgcaccacaaatgcaagaactcgcggaggcagggctgccaccagtacgtcattcacaacaacaagtgcatccct

SEQ ID NO: 7452 - DNA, 201 bp, Homo sapiens
aatcctggccgccctccccctacccttcaagagatgattcagatggcggcagagattgctgacgggatggcctacctgaacgccaagaagtttgtgcatcrggacctggcagcgagaaactgcatggtcgcccatgattttactgtcaaaattggagactttggaatgaccagagacatctatgaaacggattactaccgg

SEQ ID NO: 7453 - DNA, 201 bp, Homo sapiens
ccgccctccccctacccttcaagagatgattcagatggcggcagagattgctgacgggatggcctacctgaacgccaagaagtttgtgcatcgggacctgrcagcgagaaactgcatggtcgcccatgattttactgtcaaaattggagactttggaatgaccagagacatctatgaaacggattactaccggaaaggggg

SEQ ID NO: 7454 - DNA, 201 bp, Homo sapiens
aggtgtcgttcttccacagcgaggagaacaaggctcccgagagtgaggagctggagatggagtttgaggacatggagaatgtgcccctggaccgttcctcwctccttccttcttattgactgggagactgtgctctcgacagattcttcttgtgtcagaagtctagcctcaggtttctaccctcccttcacattggtggcc

SEQ ID NO: 7455 - DNA, 201 bp, Homo sapiens
tttacagggcccgggatgaaaacacagggcccaggtttcctgtccatgaagccggctctgcccctgatccttctgatgcatccaccgtgcgtctgctcacytgtcttgctttctgttcattttctcttgtagtgtgtcccggcatggatatccggaacaacctcactaggttgcatgagctggagaattgctctgtcatcg

SEQ ID NO: 7456 - DNA, 201 bp, Homo sapiens
gcccatgattttactgtcaaaattggagactttggaatgaccagagacatctatgaaacggattactaccggaaagggggcaagggtctgctccctgtacrgtggatggcaccggagtccctgaaggatggggtcttcaccacttcttctgacatgtggtcctttggcgtggtcctttgggaaatcaccagcttggcagaa

SEQ ID NO: 7457 - DNA, 201 bp, Homo sapiens
cgcccatgattttactgtcaaaattggagactttggaatgaccagagacatctatgaaacggattactaccggaaagggggcaagggtctgctccctgtayggtggatggcaccggagtccctgaaggatggggtcttcaccacttcttctgacatgtggtcctttggcgtggtcctttgggaaatcaccagcttggcaga

SEQ ID NO: 7458 - DNA, 201 bp, Homo sapiens
gattacttgctgctcttccgggtctatgggctcgagagcctgaaggacctgttccccaacctcacggtcatccggggatcacgactgttctttaactacgygctggtcatcttcgagatggttcacctcaaggaactcggcctctacaacctgatgaacatcacccggggttctgtccgcatcgagaagaacaatgagctc

SEQ ID NO: 7459 - DNA, 201 bp, Homo sapiens
tctcccgggtgtgaacatcctaaccgttattgtgcaaacccaagaacgtcagatcccaaagcacaacaacctggatggactttgggaacatctaagcaatrtaagagagaggtgcactgagagtacgtcttggtcccctccaccctgagagcatctgacggtcctcagtactgaactcccggaagctgctctgagcccggt

SEQ ID NO: 7460 - DNA, 201 bp, Homo sapiens
ctacgcgctggtcatcttcgagatggttcacctcaaggaactcggcctctacaacctgatgaacatcacccggggttctgtccgcatcgagaagaacaatkagctctgttacttggccactatcgactggtcccgtatcctggattccgtggaggataattacatcgtgttgaacaaagatgacaacgaggagtgtggaga

SEQ ID NO: 7461 - DNA, 201 bp, Homo sapiens
ggtgatgaggagctgcatctctgcgtctcccgcaagcacttcgctctggaacggggctgcaggctgcgtgggctgtcaccggggaactacagcgtgcgaayccgggccacctcccttgcgggcaacggctcttggacggaacccacctatttctacgtgacagactattacgtcccgtcaaatattgcaaaaattatcatc

SEQ ID NO: 7462 - DNA, 201 bp, Homo sapiens
tgatgaggagctgcatctctgcgtctcccgcaagcacttcgctctggaacggggctgcaggctgcgtgggctgtcaccggggaactacagcgtgcgaatcygggccacctcccttgcgggcaacggctcttggacggaacccacctatttctacgtgacagactattacgtcccgtcaaatattgcaaaaattatcatcgg

SEQ ID NO: 7463 - DNA, 201 bp, Homo sapiens
gacctgaagagctacctccgttctctgcggccagaggctgagaataatcctggccgccctccccctacccttcaagagatgattcagatggcggcagagaytgctgacgggatggcctacctgaacgccaagaagtttgtgcatcgggacctggcagcgagaaactgcatggtcgcccatgattttactgtcaaaattgga

SEQ ID NO: 7464 - DNA, 201 bp, Homo sapiens
taatcctggccgccctccccctacccttcaagagatgattcagatggcggcagagattgctgacgggatggcctacctgaacgccaagaagtttgtgcatygggacctggcagcgagaaactgcatggtcgcccatgattttactgtcaaaattggagactttggaatgaccagagacatctatgaaacggattactaccg

SEQ ID NO: 7465 - DNA, 201 bp, Homo sapiens
tgctctgtcatcgaaggacacttgcagatactcttgatgttcaaaacgaggcccgaagatttccgagacctcagtttccccaaactcatcatgatcactgrttacttgctgctcttccgggtctatgggctcgagagcctgaaggacctgttccccaacctcacggtcatccggggatcacgactgttctttaactacgcg

SEQ ID NO: 7466 - DNA, 201 bp, Homo sapiens
aacggtgcagtgtggcagcctacgtcagtgcgaggaccatgcctgaagccaaggctgatgacattgttggccctgtgacgcatgaaatctttgagaacaaygtcgtccacttgatgtggcaggagccgaaggagcccaatggtctgatcgtgctgtatgaagtgagttatcggcgatatggtgatgaggagctgcatctct

SEQ ID NO: 7467 - DNA, 201 bp, Homo sapiens
ccttttgagaaggtggtgaacaaggagtcgctggtcatctccggcttgcgacacttcacgggctatcgcatcgagctgcaggcttgcaaccaggacacccytgaggaacggtgcagtgtggcagcctacgtcagtgcgaggaccatgcctgaagccaaggctgatgacattgttggccctgtgacgcatgaaatctttgag

SEQ ID NO: 7468 - DNA, 201 bp, Homo sapiens
attcgaggagagaccttggaaattgggaactactccttctatgccttggacaaccagaacctaaggcagctctgggactggagcaaacacaacctcaccaycactcaggggaaactcttcttccactataaccccaaactctgcttgtcagaaatccacaagatggaagaagtttcaggaaccaaggggcgccaggagaga

SEQ ID NO: 7469 - DNA, 201 bp, Homo sapiens
gcaccgccgaaggcctctgttgccacagcgagtgcctgggcaactgttctcagcccgacgaccccaccaagtgcgtggcctgccgcaacttctacctggayggcaggtgtgtggagacctgcccgcccccgtactaccacttccaggactggcgctgtgtgaacttcagcttctgccaggacctgcaccacaaatgcaaga

SEQ ID NO: 7470 - DNA, 201 bp, Homo sapiens
atcgaaggacacttgcagatactcttgatgttcaaaacgaggcccgaagatttccgagacctcagtttccccaaactcatcatgatcactgattacttgcygctcttccgggtctatgggctcgagagcctgaaggacctgttccccaacctcacggtcatccggggatcacgactgttctttaactacgcgctggtcatc

SEQ ID NO: 7471 - DNA, 201 bp, Homo sapiens
tcttgctttctgttcattttctcttgtagtgtgtcccggcatggatatccggaacaacctcactaggttgcatgagctggagaattgctctgtcatcgaargacacttgcagatactcttgatgttcaaaacgaggcccgaagatttccgagacctcagtttccccaaactcatcatgatcactgattacttgctgctctt

SEQ ID NO: 7472 - DNA, 201 bp, Homo sapiens
gagtctgatcatcaacattcgaggaggcaacaatctggcagctgagctagaagccaacctcggcctcattgaagaaatttcagggtatctaaaaatccgcygatcctacgctctggtgtcactttccttcttccggaagttacgtctgattcgaggagagaccttggaaattgggaactactccttctatgccttggacaa

SEQ ID NO: 7473 - DNA, 201 bp, Homo sapiens
accgctttacgcttcttcaaaccctgagtatctcagtgccagtgatgtgtttccatgctctgtgtacgtgccggacgagtgggaggtgtctcgagagaagwtcaccctccttcgagagctggggcagggctccttcggcatggtgtatgagggcaatgccagggacatcatcaagggtgaggcagagacccgcgtggcggt

SEQ ID NO: 7474 - DNA, 201 bp, Homo sapiens
cgggacctggcagcgagaaactgcatggtcgcccatgattttactgtcaaaattggagactttggaatgaccagagacatctatgaaacggattactaccrgaaagggggcaagggtctgctccctgtacggtggatggcaccggagtccctgaaggatggggtcttcaccacttcttctgacatgtggtcctttggcgtg

SEQ ID NO: 7475 - DNA, 201 bp, Homo sapiens
actgtcaaaattggagactttggaatgaccagagacatctatgaaacggattactaccggaaagggggcaagggtctgctccctgtacggtggatggcacyggagtccctgaaggatggggtcttcaccacttcttctgacatgtggtcctttggcgtggtcctttgggaaatcaccagcttggcagaacagccttaccaa

SEQ ID NO: 7476 - DNA, 201 bp, Homo sapiens
cagtgagctgttcgagctggattattgcctcaaagggctgaagctgccctcgaggacctggtctccaccattcgagtctgaagattctcagaagcacaacyagagtgagtatgaggattcggccggcgaatgctgctcctgtccaaagacagactctcagatcctgaaggagctggaggagtcctcgtttaggaagacgtt

SEQ ID NO: 7477 - DNA, 201 bp, Homo sapiens
tagacatgaatcccaattgtctattgctatcttatttatatgattcgggaaaatacagcatgtaaaaatattgctgaggagcctcagtgattgggtacaasaagcaagagtacagaaattatttttgccaaatttattttgtaaatatgagggtctgtacctaaatttaaaaaaaaaaacacgtagaactaggtattttgt

SEQ ID NO: 7478 - DNA, 201 bp, Homo sapiens
caaactcatcatgatcactgattacttgctgctcttccgggtctatgggctcgagagcctgaaggacctgttccccaacctcacggtcatccggggatcaygactgttctttaactacgcgctggtcatcttcgagatggttcacctcaaggaactcggcctctacaacctgatgaacatcacccggggttctgtccgcat

SEQ ID NO: 7479 - DNA, 201 bp, Homo sapiens
tttccccaacacttcctcgaccagcgtgcccacgagtccggaggagcacaggccttttgagaaggtggtgaacaaggagtcgctggtcatctccggcttgygacacttcacgggctatcgcatcgagctgcaggcttgcaaccaggacacccctgaggaacggtgcagtgtggcagcctacgtcagtgcgaggaccatgcc

SEQ ID NO: 7480 - DNA, 201 bp, Homo sapiens
gctcccgagagtgaggagctggagatggagtttgaggacatggagaatgtgcccctggaccgttcctctctccttccttcttattgactgggagactgtgstctcgacagattcttcttgtgtcagaagtctagcctcaggtttctaccctcccttcacattggtggccaagggaggagcatttcatttggagtgattatg

SEQ ID NO: 7481 - DNA, 201 bp, Homo sapiens
ctacaacctgatgaacatcacccggggttctgtccgcatcgagaagaacaatgagctctgttacttggccactatcgactggtcccgtatcctggattccktggaggataattacatcgtgttgaacaaagatgacaacgaggagtgtggagacatctgtccgggtaccgcgaagggcaagaccaactgccccgccaccgt

SEQ ID NO: 7482 - DNA, 201 bp, Homo sapiens
gaacatcacccggggttctgtccgcatcgagaagaacaatgagctctgttacttggccactatcgactggtcccgtatcctggattccgtggaggataatyacatcgtgttgaacaaagatgacaacgaggagtgtggagacatctgtccgggtaccgcgaagggcaagaccaactgccccgccaccgtcatcaacgggca

SEQ ID NO: 7483 - DNA, 201 bp, Homo sapiens
tgcccgcccccgtactaccacttccaggactggcgctgtgtgaacttcagcttctgccaggacctgcaccacaaatgcaagaactcgcggaggcagggctrccaccagtacgtcattcacaacaacaagtgcatccctgagtgtccctccgggtacacgatgaattccagcaacttgctgtgcaccccatgcctgggtccc

SEQ ID NO: 7484 - DNA, 201 bp, Homo sapiens
cactataaccccaaactctgcttgtcagaaatccacaagatggaagaagtttcaggaaccaaggggcgccaggagagaaacgacattgccctgaagaccartggggaccaggcatcctgtgaaaatgagttacttaaattttcttacattcggacatcttttgacaagatcttgctgagatgggagccgtactggcccccc

SEQ ID NO: 7485 - DNA, 201 bp, Homo sapiens
cgtggtgcgcctcctgggagtggtgtccaagggccagcccacgctggtggtgatggagctgatggctcacggagacctgaagagctacctccgttctctgyggccagaggctgagaataatcctggccgccctccccctacccttcaagagatgattcagatggcggcagagattgctgacgggatggcctacctgaacgc

SEQ ID NO: 7486 - DNA, 201 bp, Homo sapiens
tggcctacctgaacgccaagaagtttgtgcatcgggacctggcagcgagaaactgcatggtcgcccatgattttactgtcaaaattggagactttggaatraccagagacatctatgaaacggattactaccggaaagggggcaagggtctgctccctgtacggtggatggcaccggagtccctgaaggatggggtcttca

SEQ ID NO: 7487 - DNA, 201 bp, Homo sapiens
ccgctgggaccgctttacgcttcttcaaaccctgagtatctcagtgccagtgatgtgtttccatgctctgtgtacgtgccggacgagtgggaggtgtctcragagaagatcaccctccttcgagagctggggcagggctccttcggcatggtgtatgagggcaatgccagggacatcatcaagggtgaggcagagacccgc

SEQ ID NO: 7488 - DNA, 201 bp, Homo sapiens
cttcctcgaccagcgtgcccacgagtccggaggagcacaggccttttgagaaggtggtgaacaaggagtcgctggtcatctccggcttgcgacacttcacrggctatcgcatcgagctgcaggcttgcaaccaggacacccctgaggaacggtgcagtgtggcagcctacgtcagtgcgaggaccatgcctgaagccaagg

SEQ ID NO: 7489 - DNA, 201 bp, Homo sapiens
acggattactaccggaaagggggcaagggtctgctccctgtacggtggatggcaccggagtccctgaaggatggggtcttcaccacttcttctgacatgtkgtcctttggcgtggtcctttgggaaatcaccagcttggcagaacagccttaccaaggcctgtctaatgaacaggtgttgaaatttgtcatggatggaggg

SEQ ID NO: 7490 - DNA, 201 bp, Homo sapiens
tctccggcttgcgacacttcacgggctatcgcatcgagctgcaggcttgcaaccaggacacccctgaggaacggtgcagtgtggcagcctacgtcagtgcsaggaccatgcctgaagccaaggctgatgacattgttggccctgtgacgcatgaaatctttgagaacaacgtcgtccacttgatgtggcaggagccgaagg

SEQ ID NO: 7491 - DNA, 201 bp, Homo sapiens
ccaaggctgatgacattgttggccctgtgacgcatgaaatctttgagaacaacgtcgtccacttgatgtggcaggagccgaaggagcccaatggtctgatygtgctgtatgaagtgagttatcggcgatatggtgatgaggagctgcatctctgcgtctcccgcaagcacttcgctctggaacggggctgcaggctgcgtg

SEQ ID NO: 7492 - DNA, 201 bp, Homo sapiens
agccgaaggagcccaatggtctgatcgtgctgtatgaagtgagttatcggcgatatggtgatgaggagctgcatctctgcgtctcccgcaagcacttcgcyctggaacggggctgcaggctgcgtgggctgtcaccggggaactacagcgtgcgaatccgggccacctcccttgcgggcaacggctcttggacggaaccca

SEQ ID NO: 7493 - DNA, 201 bp, Homo sapiens
gactgttctttaactacgcgctggtcatcttcgagatggttcacctcaaggaactcggcctctacaacctgatgaacatcacccggggttctgtccgcatsgagaagaacaatgagctctgttacttggccactatcgactggtcccgtatcctggattccgtggaggataattacatcgtgttgaacaaagatgacaacg

SEQ ID NO: 7494 - DNA, 201 bp, Homo sapiens
cacctcaaggaactcggcctctacaacctgatgaacatcacccggggttctgtccgcatcgagaagaacaatgagctctgttacttggccactatcgactrgtcccgtatcctggattccgtggaggataattacatcgtgttgaacaaagatgacaacgaggagtgtggagacatctgtccgggtaccgcgaagggcaag

SEQ ID NO: 7495 - DNA, 201 bp, Homo sapiens
cccgcgtggcggtgaagacggtcaacgagtcagccagtctccgagagcggattgagttcctcaatgaggcctcggtcatgaagggcttcacctgccatcaygtggtgcgcctcctgggagtggtgtccaagggccagcccacgctggtggtgatggagctgatggctcacggagacctgaagagctacctccgttctctgc

SEQ ID NO: 7496 - DNA, 201 bp, Homo sapiens
ctcacctgtcttgctttctgttcattttctcttgtagtgtgtcccggcatggatatccggaacaacctcactaggttgcatgagctggagaattgctctgycatcgaaggacacttgcagatactcttgatgttcaaaacgaggcccgaagatttccgagacctcagtttccccaaactcatcatgatcactgattacttg

SEQ ID NO: 7497 - DNA, 201 bp, Homo sapiens
tcctgagaaagaggcagccagatgggccgctgggaccgctttacgcttcttcaaaccctgagtatctcagtgccagtgatgtgtttccatgctctgtgtaygtgccggacgagtgggaggtgtctcgagagaagatcaccctccttcgagagctggggcagggctccttcggcatggtgtatgagggcaatgccagggaca

SEQ ID NO: 7498 - DNA, 201 bp, Homo sapiens
atgcaccgtcatcaacgggagtctgatcatcaacattcgaggaggcaacaatctggcagctgagctagaagccaacctcggcctcattgaagaaatttcarggtatctaaaaatccgccgatcctacgctctggtgtcactttccttcttccggaagttacgtctgattcgaggagagaccttggaaattgggaactactc

SEQ ID NO: 7499 - DNA, 201 bp, Homo sapiens
gttctttaactacgcgctggtcatcttcgagatggttcacctcaaggaactcggcctctacaacctgatgaacatcacccggggttctgtccgcatcgagwagaacaatgagctctgttacttggccactatcgactggtcccgtatcctggattccgtggaggataattacatcgtgttgaacaaagatgacaacgagga

SEQ ID NO: 7500 - DNA, 201 bp, Homo sapiens
cctccccctacccttcaagagatgattcagatggcggcagagattgctgacgggatggcctacctgaacgccaagaagtttgtgcatcgggacctggcagmgagaaactgcatggtcgcccatgattttactgtcaaaattggagactttggaatgaccagagacatctatgaaacggattactaccggaaagggggcaag

SEQ ID NO: 7501 - DNA, 201 bp, Homo sapiens; identical to SEQ ID NO: 7426

SEQ ID NO: 7502 - DNA, 201 bp, Homo sapiens
atatggtgatgaggagctgcatctctgcgtctcccgcaagcacttcgctctggaacggggctgcaggctgcgtgggctgtcaccggggaactacagcgtgygaatccgggccacctcccttgcgggcaacggctcttggacggaacccacctatttctacgtgacagactatttagacgtcccgtcaaatattgcaaaaat

SEQ ID NO: 7503 - DNA, 201 bp, Homo sapiens; identical to SEQ ID NO: 7428

SEQ ID NO: 7504 - DNA, 201 bp, Homo sapiens; identical to SEQ ID NO: 7429

SEQ ID NO: 7505 - DNA, 201 bp, Homo sapiens; identical to SEQ ID NO: 7430

SEQ ID NO: 7506 - DNA, 201 bp, Homo sapiens; identical to SEQ ID NO: 7431

SEQ ID NO: 7507 - DNA, 201 bp, Homo sapiens; identical to SEQ ID NO: 7432

SEQ ID NO: 7508 - DNA, 201 bp, Homo sapiens; identical to SEQ ID NO: 7433

SEQ ID NO: 7509 - DNA, 201 bp, Homo sapiens; identical to SEQ ID NO: 7434

SEQ ID NO: 7510 - DNA, 201 bp, Homo sapiens; identical to SEQ ID NO: 7435

SEQ ID NO: 7511 - DNA, 201 bp, Homo sapiens; identical to SEQ ID NO: 7436

SEQ ID NO: 7512 - DNA, 201 bp, Homo sapiens; identical to SEQ ID NO: 7437

SEQ ID NO: 7513 - DNA, 201 bp, Homo sapiens; identical to SEQ ID NO: 7438

SEQ ID NO: 7514 - DNA, 201 bp, Homo sapiens; identical to SEQ ID NO: 7439

SEQ ID NO: 7515 - DNA, 201 bp, Homo sapiens; identical to SEQ ID NO: 7440

SEQ ID NO: 7516 - DNA, 201 bp, Homo sapiens; identical to SEQ ID NO: 7441

SEQ ID NO: 7517 - DNA, 201 bp, Homo sapiens; identical to SEQ ID NO: 7442

SEQ ID NO: 7518 - DNA, 201 bp, Homo sapiens; identical to SEQ ID NO: 7443

SEQ ID NO: 7519 - DNA, 201 bp, Homo sapiens; identical to SEQ ID NO: 7444

SEQ ID NO: 7520 - DNA, 201 bp, Homo sapiens; identical to SEQ ID NO: 7445

SEQ ID NO: 7521 - DNA, 201 bp, Homo sapiens; identical to SEQ ID NO: 7446

SEQ ID NO: 7522 - DNA, 201 bp, Homo sapiens; identical to SEQ ID NO: 7447

SEQ ID NO: 7523 - DNA, 201 bp, Homo sapiens; identical to SEQ ID NO: 7448

SEQ ID NO: 7524 - DNA, 201 bp, Homo sapiens; identical to SEQ ID NO: 7449

SEQ ID NO: 7525 - DNA, 201 bp, Homo sapiens; identical to SEQ ID NO: 7450

SEQ ID NO: 7526 - DNA, 201 bp, Homo sapiens; identical to SEQ ID NO: 7451

SEQ ID NO: 7527 - DNA, 201 bp, Homo sapiens; identical to SEQ ID NO: 7452

SEQ ID NO: 7528 - DNA, 201 bp, Homo sapiens; identical to SEQ ID NO: 7453

SEQ ID NO: 7529 - DNA, 201 bp, Homo sapiens
ttagacacggctgatgtgtgtgcaaagtatccatgcggagttgatgctttgggaattggctcatgaaggttcttctcaagggtgcgagctcatccccctcwctccttccttcttattgactgggagactgtgctctcgacagattcttcttgtgtcagaagtctagcctcaggtttctaccctcccttcacattggtggcc

SEQ ID NO: 7530 - DNA, 201 bp, Homo sapiens; identical to SEQ ID NO: 7455

SEQ ID NO: 7531 - DNA, 201 bp, Homo sapiens; identical to SEQ ID NO: 7456

SEQ ID NO: 7532 - DNA, 201 bp, Homo sapiens; identical to SEQ ID NO: 7457

SEQ ID NO: 7533 - DNA, 201 bp, Homo sapiens
cccctggaccgttcctcgcactgtcagagggaggaggcggggggccgggatggagggtcctcgctgggtttcaagcggagctacgaggaacacatcccttrcacacacatgaacggaggcaagaaaaacgggcggattctgaccttgcctcggtccaatccttcctaacagtgcctaccgtggcgggggcgggcaggggtt

SEQ ID NO: 7534 - DNA, 201 bp, Homo sapiens; identical to SEQ ID NO: 7458

SEQ ID NO: 7535 - DNA, 201 bp, Homo sapiens; identical to SEQ ID NO: 7459

SEQ ID NO: 7536 - DNA, 201 bp, Homo sapiens; identical to SEQ ID NO: 7460

SEQ ID NO: 7537 - DNA, 201 bp, Homo sapiens
ggtgatgaggagctgcatctctgcgtctcccgcaagcacttcgctctggaacggggctgcaggctgcgtgggctgtcaccggggaactacagcgtgcgaayccgggccacctcccttgcgggcaacggctcttggacggaacccacctatttctacgtgacagactatttagacgtcccgtcaaatattgcaaaaattatc

SEQ ID NO: 7538 - DNA, 201 bp, Homo sapiens
tgatgaggagctgcatctctgcgtctcccgcaagcacttcgctctggaacggggctgcaggctgcgtgggctgtcaccggggaactacagcgtgcgaatcygggccacctcccttgcgggcaacggctcttggacggaacccacctatttctacgtgacagactatttagacgtcccgtcaaatattgcaaaaattatcat

SEQ ID NO: 7539 - DNA, 201 bp, Homo sapiens; identical to SEQ ID NO: 7463

SEQ ID NO: 7540 - DNA, 201 bp, Homo sapiens; identical to SEQ ID NO: 7464

SEQ ID NO: 7541 - DNA, 201 bp, Homo sapiens
cgaggaacacatcccttacacacacatgaacggaggcaagaaaaacgggcggattctgaccttgcctcggtccaatccttcctaacagtgcctaccgtggygggggcgggcaggggttcccattttcgctttcctctggtttgaaagcctctggaaaactcaggattctcacgactctaccatgtccaatggagttcagag

SEQ ID NO: 7542 - DNA, 201 bp, Homo sapiens; identical to SEQ ID NO: 7465

SEQ ID NO: 7543 - DNA, 201 bp, Homo sapiens; identical to SEQ ID NO: 7466

SEQ ID NO: 7544 - DNA, 201 bp, Homo sapiens; identical to SEQ ID NO: 7467

SEQ ID NO: 7545 - DNA, 201 bp, Homo sapiens; identical to SEQ ID NO: 7468

SEQ ID NO: 7546 - DNA, 201 bp, Homo sapiens; identical to SEQ ID NO: 7469

SEQ ID NO: 7547 - DNA, 201 bp, Homo sapiens; identical to SEQ ID NO: 7470

SEQ ID NO: 7548 - DNA, 201 bp, Homo sapiens; identical to SEQ ID NO: 7471

SEQ ID NO: 7549 - DNA, 201 bp, Homo sapiens; identical to SEQ ID NO: 7472

SEQ ID NO: 7550 - DNA, 201 bp, Homo sapiens; identical to SEQ ID NO: 7473

SEQ ID NO: 7551 - DNA, 201 bp, Homo sapiens; identical to SEQ ID NO: 7474

SEQ ID NO: 7552 - DNA, 201 bp, Homo sapiens; identical to SEQ ID NO: 7475

SEQ ID NO: 7553 - DNA, 201 bp, Homo sapiens
ggagggtcctcgctgggtttcaagcggagctacgaggaacacatcccttacacacacatgaacggaggcaagaaaaacgggcggattctgaccttgcctcrgtccaatccttcctaacagtgcctaccgtggcgggggcgggcaggggttcccattttcgctttcctctggtttgaaagcctctggaaaactcaggattct

SEQ ID NO: 7554 - DNA, 201 bp, Homo sapiens; identical to SEQ ID NO: 7476

SEQ ID NO: 7555 - DNA, 201 bp, Homo sapiens; identical to SEQ ID NO: 7478

SEQ ID NO: 7556 - DNA, 201 bp, Homo sapiens; identical to SEQ ID NO: 7479

SEQ ID NO: 7557 - DNA, 201 bp, Homo sapiens
atgcggagttgatgctttgggaattggctcatgaaggttcttctcaagggtgcgagctcatccccctctctccttccttcttattgactgggagactgtgstctcgacagattcttcttgtgtcagaagtctagcctcaggtttctaccctcccttcacattggtggccaagggaggagcatttcatttggagtgattatg

SEQ ID NO: 7558 - DNA, 201 bp, Homo sapiens; identical to SEQ ID NO: 7481

SEQ ID NO: 7559 - DNA, 201 bp, Homo sapiens
agaaagcacctgtttttacaaattctttttttttttttttttttttgctggtgtctgagcttcagtataaaagacaaaacttcctgtttgtggaacaaaakttcgaaagaaaaaacaaaacaaaaacacccagccctgttccaggagaatttcaagttttacaggttgagcttcaagatggtttttttggttttttttttt

SEQ ID NO: 7560 - DNA, 201 bp, Homo sapiens; identical to SEQ ID NO: 7482

SEQ ID NO: 7561 - DNA, 201 bp, Homo sapiens; identical to SEQ ID NO: 7483

SEQ ID NO: 7562 - DNA, 201 bp, Homo sapiens; identical to SEQ ID NO: 7484

SEQ ID NO: 7563 - DNA, 201 bp, Homo sapiens; identical to SEQ ID NO: 7485

SEQ ID NO: 7564 - DNA, 201 bp, Homo sapiens; identical to SEQ ID NO: 7486

SEQ ID NO: 7565 - DNA, 201 bp, Homo sapiens; identical to SEQ ID NO: 7489

SEQ ID NO: 7566 - DNA, 201 bp, Homo sapiens; identical to SEQ ID NO: 7488

SEQ ID NO: 7567 - DNA, 201 bp, Homo sapiens; identical to SEQ ID NO: 7487

SEQ ID NO: 7568 - DNA, 201 bp, Homo sapiens; identical to SEQ ID NO: 7490

SEQ ID NO: 7569 - DNA, 201 bp, Homo sapiens; identical to SEQ ID NO: 7491

SEQ ID NO: 7570 - DNA, 201 bp, Homo sapiens; identical to SEQ ID NO: 7492

SEQ ID NO: 7571 - DNA, 201 bp, Homo sapiens
tgcctaccgtggcgggggcgggcaggggttcccattttcgctttcctctggtttgaaagcctctggaaaactcaggattctcacgactctaccatgtccartggagttcagagatcgttcctatacatttctgttcatcttaaggtggactcgtttggttaccaatttaactagtcctgcagaggatttaactgtgaacct

SEQ ID NO: 7572 - DNA, 201 bp, Homo sapiens; identical to SEQ ID NO: 7493

SEQ ID NO: 7573 - DNA, 201 bp, Homo sapiens; identical to SEQ ID NO: 7494

SEQ ID NO: 7574 - DNA, 201 bp, Homo sapiens; identical to SEQ ID NO: 7495

SEQ ID NO: 7575 - DNA, 201 bp, Homo sapiens; identical to SEQ ID NO: 7496

SEQ ID NO: 7576 - DNA, 201 bp, Homo sapiens; identical to SEQ ID NO: 7497

SEQ ID NO: 7577 - DNA, 201 bp, Homo sapiens; identical to SEQ ID NO: 7498

SEQ ID NO: 7578 - DNA, 201 bp, Homo sapiens
ctatacatttctgttcatcttaaggtggactcgtttggttaccaatttaactagtcctgcagaggatttaactgtgaacctggagggcaaggggtttccayagttgctgctcctttggggcaacgacggtttcaaaccaggattttgtgttttttcgttccccccacccgcccccagcagatggaaagaaagcacctgttt

SEQ ID NO: 7579 - DNA, 201 bp, Homo sapiens; identical to SEQ ID NO: 7499

SEQ ID NO: 7580 - DNA, 201 bp, Homo sapiens; identical to SEQ ID NO: 7500

SEQ ID NO: 7581 - DNA, 201 bp, Homo sapiens; identical to SEQ ID NO: 7426

SEQ ID NO: 7582 - DNA, 201 bp, Homo sapiens; identical to SEQ ID NO: 7502

SEQ ID NO: 7583 - DNA, 201 bp, Homo sapiens
gagaaagaggcagccagatgggccgctgggaccgctttacgcttcttcaaaccctgagtatctcagtgccagtgatgtagtgtttccatgctctgtgtacrtgccggacgagtgggaggtgtctcgagagaagatcaccctccttcgagagctggggcagggctccttcggcatggtgtatgagggcaatgccagggacat

SEQ ID NO: 7584 - DNA, 201 bp, Homo sapiens; identical to SEQ ID NO: 7429

SEQ ID NO: 7585 - DNA, 201 bp, Homo sapiens
ttcaaaccctgagtatctcagtgccagtgatgtagtgtttccatgctctgtgtacgtgccggacgagtgggaggtgtctcgagagaagatcaccctccttygagagctggggcagggctccttcggcatggtgtatgagggcaatgccagggacatcatcaagggtgaggcagagacccgcgtggcggtgaagacggtcaa

SEQ ID NO: 7586 - DNA, 201 bp, Homo sapiens
agtgatgtagtgtttccatgctctgtgtacgtgccggacgagtgggaggtgtctcgagagaagatcaccctccttcgagagctggggcagggctccttcgkcatggtgtatgagggcaatgccagggacatcatcaagggtgaggcagagacccgcgtggcggtgaagacggtcaacgagtcagccagtctccgagagcgg

SEQ ID NO: 7587 - DNA, 201 bp, Homo sapiens; identical to SEQ ID NO: 7432

SEQ ID NO: 7588 - DNA, 201 bp, Homo sapiens; identical to SEQ ID NO: 7433

SEQ ID NO: 7589 - DNA, 201 bp, Homo sapiens; identical to SEQ ID NO: 7434

SEQ ID NO: 7590 - DNA, 201 bp, Homo sapiens; identical to SEQ ID NO: 7435

SEQ ID NO: 7591 - DNA, 201 bp, Homo sapiens; identical to SEQ ID NO: 7436

SEQ ID NO: 7592 - DNA, 201 bp, Homo sapiens; identical to SEQ ID NO: 7437

SEQ ID NO: 7593 - DNA, 201 bp, Homo sapiens; identical to SEQ ID NO: 7438

SEQ ID NO: 7594 - DNA, 201 bp, Homo sapiens; identical to SEQ ID NO: 7439

SEQ ID NO: 7595 - DNA, 201 bp, Homo sapiens; identical to SEQ ID NO: 7440

SEQ ID NO: 7596 - DNA, 201 bp, Homo sapiens; identical to SEQ ID NO: 7441

SEQ ID NO: 7597 - DNA, 201 bp, Homo sapiens; identical to SEQ ID NO: 7442

SEQ ID NO: 7598 - DNA, 201 bp, Homo sapiens; identical to SEQ ID NO: 7443

SEQ ID NO: 7599 - DNA, 201 bp, Homo sapiens; identical to SEQ ID NO: 7444

SEQ ID NO: 7600 - DNA, 201 bp, Homo sapiens; identical to SEQ ID NO: 7445

SEQ ID NO: 7601 - DNA, 201 bp, Homo sapiens; identical to SEQ ID NO: 7446

SEQ ID NO: 7602 - DNA, 201 bp, Homo sapiens; identical to SEQ ID NO: 7447

SEQ ID NO: 7603 - DNA, 201 bp, Homo sapiens; identical to SEQ ID NO: 7448

SEQ ID NO: 7604 - DNA, 201 bp, Homo sapiens; identical to SEQ ID NO: 7449

SEQ ID NO: 7605 - DNA, 201 bp, Homo sapiens; identical to SEQ ID NO: 7450

SEQ ID NO: 7606 - DNA, 201 bp, Homo sapiens; identical to SEQ ID NO: 7451

SEQ ID NO: 7607 - DNA, 201 bp, Homo sapiens; identical to SEQ ID NO: 7452

SEQ ID NO: 7608 - DNA, 201 bp, Homo sapiens; identical to SEQ ID NO: 7453

SEQ ID NO: 7609 - DNA, 201 bp, Homo sapiens; identical to SEQ ID NO: 7529

SEQ ID NO: 7610 - DNA, 201 bp, Homo sapiens; identical to SEQ ID NO: 7455

SEQ ID NO: 7611 - DNA, 201 bp, Homo sapiens; identical to SEQ ID NO: 7456

SEQ ID NO: 7612 - DNA, 201 bp, Homo sapiens; identical to SEQ ID NO: 7457

SEQ ID NO: 7613 - DNA, 201 bp, Homo sapiens; identical to SEQ ID NO: 7533

SEQ ID NO: 7614 - DNA, 201 bp, Homo sapiens; identical to SEQ ID NO: 7458

SEQ ID NO: 7615 - DNA, 201 bp, Homo sapiens; identical to SEQ ID NO: 7459

SEQ ID NO: 7616 - DNA, 201 bp, Homo sapiens; identical to SEQ ID NO: 7460

SEQ ID NO: 7617 - DNA, 201 bp, Homo sapiens; identical to SEQ ID NO: 7537

SEQ ID NO: 7618 - DNA, 201 bp, Homo sapiens; identical to SEQ ID NO: 7538

SEQ ID NO: 7619 - DNA, 201 bp, Homo sapiens; identical to SEQ ID NO: 7463

SEQ ID NO: 7620 - DNA, 201 bp, Homo sapiens; identical to SEQ ID NO: 7464

SEQ ID NO: 7621 - DNA, 201 bp, Homo sapiens; identical to SEQ ID NO: 7541

SEQ ID NO: 7622 - DNA, 201 bp, Homo sapiens; identical to SEQ ID NO: 7465

SEQ ID NO: 7623 - DNA, 201 bp, Homo sapiens; identical to SEQ ID NO: 7466

SEQ ID NO: 7624 - DNA, 201 bp, Homo sapiens; identical to SEQ ID NO: 7467

SEQ ID NO: 7625 - DNA, 201 bp, Homo sapiens; identical to SEQ ID NO: 7468

SEQ ID NO: 7626 - DNA, 201 bp, Homo sapiens; identical to SEQ ID NO: 7469

SEQ ID NO: 7627 - DNA, 201 bp, Homo sapiens; identical to SEQ ID NO: 7470

SEQ ID NO: 7628 - DNA, 201 bp, Homo sapiens; identical to SEQ ID NO: 7471

SEQ ID NO: 7629 - DNA, 201 bp, Homo sapiens; identical to SEQ ID NO: 7472

SEQ ID NO: 7630 - DNA, 201 bp, Homo sapiens
gctttacgcttcttcaaaccctgagtatctcagtgccagtgatgtagtgtttccatgctctgtgtacgtgccggacgagtgggaggtgtctcgagagaagwtcaccctccttcgagagctggggcagggctccttcggcatggtgtatgagggcaatgccagggacatcatcaagggtgaggcagagacccgcgtggcggt

SEQ ID NO: 7631 - DNA, 201 bp, Homo sapiens; identical to SEQ ID NO: 7474

SEQ ID NO: 7632 - DNA, 201 bp, Homo sapiens; identical to SEQ ID NO: 7475

SEQ ID NO: 7633 - DNA, 201 bp, Homo sapiens; identical to SEQ ID NO: 7553

SEQ ID NO: 7634 - DNA, 201 bp, Homo sapiens; identical to SEQ ID NO: 7476

SEQ ID NO: 7635 - DNA, 201 bp, Homo sapiens; identical to SEQ ID NO: 7478

SEQ ID NO: 7636 - DNA, 201 bp, Homo sapiens; identical to SEQ ID NO: 7479

SEQ ID NO: 7637 - DNA, 201 bp, Homo sapiens; identical to SEQ ID NO: 7557

SEQ ID NO: 7638 - DNA, 201 bp, Homo sapiens; identical to SEQ ID NO: 7481

SEQ ID NO: 7639 - DNA, 201 bp, Homo sapiens; identical to SEQ ID NO: 7559

SEQ ID NO: 7640 - DNA, 201 bp, Homo sapiens; identical to SEQ ID NO: 7482

SEQ ID NO: 7641 - DNA, 201 bp, Homo sapiens; identical to SEQ ID NO: 7483

SEQ ID NO: 7642 - DNA, 201 bp, Homo sapiens; identical to SEQ ID NO: 7484

SEQ ID NO: 7643 - DNA, 201 bp, Homo sapiens; identical to SEQ ID NO: 7485

SEQ ID NO: 7644 - DNA, 201 bp, Homo sapiens; identical to SEQ ID NO: 7486

SEQ ID NO: 7645 - DNA, 201 bp, Homo sapiens; identical to SEQ ID NO: 7489

SEQ ID NO: 7646 - DNA, 201 bp, Homo sapiens; identical to SEQ ID NO: 7488

SEQ ID NO: 7647 - DNA, 201 bp, Homo sapiens
ctgggaccgctttacgcttcttcaaaccctgagtatctcagtgccagtgatgtagtgtttccatgctctgtgtacgtgccggacgagtgggaggtgtctcragagaagatcaccctccttcgagagctggggcagggctccttcggcatggtgtatgagggcaatgccagggacatcatcaagggtgaggcagagacccgc

SEQ ID NO: 7648 - DNA, 201 bp, Homo sapiens; identical to SEQ ID NO: 7490

SEQ ID NO: 7649 - DNA, 201 bp, Homo sapiens; identical to SEQ ID NO: 7491

SEQ ID NO: 7650 - DNA, 201 bp, Homo sapiens; identical to SEQ ID NO: 7492

SEQ ID NO: 7651 - DNA, 201 bp, Homo sapiens; identical to SEQ ID NO: 7571

SEQ ID NO: 7652 - DNA, 201 bp, Homo sapiens; identical to SEQ ID NO: 7493

SEQ ID NO: 7653 - DNA, 201 bp, Homo sapiens; identical to SEQ ID NO: 7494

SEQ ID NO: 7654 - DNA, 201 bp, Homo sapiens; identical to SEQ ID NO: 7495

SEQ ID NO: 7655 - DNA, 201 bp, Homo sapiens; identical to SEQ ID NO: 7496

SEQ ID NO: 7656 - DNA, 201 bp, Homo sapiens
tgagaaagaggcagccagatgggccgctgggaccgctttacgcttcttcaaaccctgagtatctcagtgccagtgatgtagtgtttccatgctctgtgtaygtgccggacgagtgggaggtgtctcgagagaagatcaccctccttcgagagctggggcagggctccttcggcatggtgtatgagggcaatgccagggaca

SEQ ID NO: 7657 - DNA, 201 bp, Homo sapiens; identical to SEQ ID NO: 7498

SEQ ID NO: 7658 - DNA, 201 bp, Homo sapiens; identical to SEQ ID NO: 7578

SEQ ID NO: 7659 - DNA, 201 bp, Homo sapiens; identical to SEQ ID NO: 7499

SEQ ID NO: 7660 - DNA, 201 bp, Homo sapiens; identical to SEQ ID NO: 7500

SEQ ID NO: 7661 - DNA, 201 bp, Homo sapiens; identical to SEQ ID NO: 7426

SEQ ID NO: 7662 - DNA, 201 bp, Homo sapiens; identical to SEQ ID NO: 7427

SEQ ID NO: 7663 - DNA, 201 bp, Homo sapiens; identical to SEQ ID NO: 7583

SEQ ID NO: 7664 - DNA, 201 bp, Homo sapiens; identical to SEQ ID NO: 7429

SEQ ID NO: 7665 - DNA, 201 bp, Homo sapiens; identical to SEQ ID NO: 7585

SEQ ID NO: 7666 - DNA, 201 bp, Homo sapiens; identical to SEQ ID NO: 7586

SEQ ID NO: 7667 - DNA, 201 bp, Homo sapiens; identical to SEQ ID NO: 7432

SEQ ID NO: 7668 - DNA, 201 bp, Homo sapiens; identical to SEQ ID NO: 7433

SEQ ID NO: 7669 - DNA, 201 bp, Homo sapiens; identical to SEQ ID NO: 7434

SEQ ID NO: 7670 - DNA, 201 bp, Homo sapiens; identical to SEQ ID NO: 7435

SEQ ID NO: 7671 - DNA, 201 bp, Homo sapiens; identical to SEQ ID NO: 7436

SEQ ID NO: 7672 - DNA, 201 bp, Homo sapiens; identical to SEQ ID NO: 7437

SEQ ID NO: 7673 - DNA, 201 bp, Homo sapiens; identical to SEQ ID NO: 7438

SEQ ID NO: 7674 - DNA, 201 bp, Homo sapiens; identical to SEQ ID NO: 7439

SEQ ID NO: 7675 - DNA, 201 bp, Homo sapiens; identical to SEQ ID NO: 7440

SEQ ID NO: 7676 - DNA, 201 bp, Homo sapiens; identical to SEQ ID NO: 7441

SEQ ID NO: 7677 - DNA, 201 bp, Homo sapiens; identical to SEQ ID NO: 7442

SEQ ID NO: 7678 - DNA, 201 bp, Homo sapiens; identical to SEQ ID NO: 7443

SEQ ID NO: 7679 - DNA, 201 bp, Homo sapiens; identical to SEQ ID NO: 7444

SEQ ID NO: 7680 - DNA, 201 bp, Homo sapiens; identical to SEQ ID NO: 7445

SEQ ID NO: 7681 - DNA, 201 bp, Homo sapiens; identical to SEQ ID NO: 7446

SEQ ID NO: 7682 - DNA, 201 bp, Homo sapiens; identical to SEQ ID NO: 7447

SEQ ID NO: 7683 - DNA, 201 bp, Homo sapiens; identical to SEQ ID NO: 7448

SEQ ID NO: 7684 - DNA, 201 bp, Homo sapiens; identical to SEQ ID NO: 7449

SEQ ID NO: 7685 - DNA, 201 bp, Homo sapiens; identical to SEQ ID NO: 7450

SEQ ID NO: 7686 - DNA, 201 bp, Homo sapiens; identical to SEQ ID NO: 7451

SEQ ID NO: 7687 - DNA, 201 bp, Homo sapiens; identical to SEQ ID NO: 7452

SEQ ID NO: 7688 - DNA, 201 bp, Homo sapiens; identical to SEQ ID NO: 7453

SEQ ID NO: 7689 - DNA, 201 bp, Homo sapiens; identical to SEQ ID NO: 7454

SEQ ID NO: 7690 - DNA, 201 bp, Homo sapiens; identical to SEQ ID NO: 7455

SEQ ID NO: 7691 - DNA, 201 bp, Homo sapiens; identical to SEQ ID NO: 7456

SEQ ID NO: 7692 - DNA, 201 bp, Homo sapiens; identical to SEQ ID NO: 7457

SEQ ID NO: 7693 - DNA, 201 bp, Homo sapiens; identical to SEQ ID NO: 7458

SEQ ID NO: 7694 - DNA, 201 bp, Homo sapiens; identical to SEQ ID NO: 7459

SEQ ID NO: 7695 - DNA, 201 bp, Homo sapiens; identical to SEQ ID NO: 7460

SEQ ID NO: 7696 - DNA, 201 bp, Homo sapiens; identical to SEQ ID NO: 7461

SEQ ID NO: 7697 - DNA, 201 bp, Homo sapiens; identical to SEQ ID NO: 7462

SEQ ID NO: 7698 - DNA, 201 bp, Homo sapiens; identical to SEQ ID NO: 7463

SEQ ID NO: 7699 - DNA, 201 bp, Homo sapiens; identical to SEQ ID NO: 7464

SEQ ID NO: 7700 - DNA, 201 bp, Homo sapiens; identical to SEQ ID NO: 7465

SEQ ID NO: 7701 - DNA, 201 bp, Homo sapiens; identical to SEQ ID NO: 7466

SEQ ID NO: 7702 - DNA, 201 bp, Homo sapiens; identical to SEQ ID NO: 7467

SEQ ID NO: 7703 - DNA, 201 bp, Homo sapiens; identical to SEQ ID NO: 7468

SEQ ID NO: 7704 - DNA, 201 bp, Homo sapiens; identical to SEQ ID NO: 7469

SEQ ID NO: 7705 - DNA, 201 bp, Homo sapiens; identical to SEQ ID NO: 7470

SEQ ID NO: 7706 - DNA, 201 bp, Homo sapiens; identical to SEQ ID NO: 7471

SEQ ID NO: 7707 - DNA, 201 bp, Homo sapiens; identical to SEQ ID NO: 7472

SEQ ID NO: 7708 - DNA, 201 bp, Homo sapiens; identical to SEQ ID NO: 7630

SEQ ID NO: 7709 - DNA, 201 bp, Homo sapiens; identical to SEQ ID NO: 7474

SEQ ID NO: 7710 - DNA, 201 bp, Homo sapiens; identical to SEQ ID NO: 7475

SEQ ID NO: 7711 - DNA, 201 bp, Homo sapiens; identical to SEQ ID NO: 7476

SEQ ID NO: 7712 - DNA, 201 bp, Homo sapiens; identical to SEQ ID NO: 7477

SEQ ID NO: 7713 - DNA, 201 bp, Homo sapiens; identical to SEQ ID NO: 7478

SEQ ID NO: 7714 - DNA, 201 bp, Homo sapiens; identical to SEQ ID NO: 7479

SEQ ID NO: 7715 - DNA, 201 bp, Homo sapiens; identical to SEQ ID NO: 7480

SEQ ID NO: 7716 - DNA, 201 bp, Homo sapiens; identical to SEQ ID NO: 7481

SEQ ID NO: 7717 - DNA, 201 bp, Homo sapiens; identical to SEQ ID NO: 7482

SEQ ID NO: 7718 - DNA, 201 bp, Homo sapiens; identical to SEQ ID NO: 7483

SEQ ID NO: 7719 - DNA, 201 bp, Homo sapiens; identical to SEQ ID NO: 7484

SEQ ID NO: 7720 - DNA, 201 bp, Homo sapiens; identical to SEQ ID NO: 7485

SEQ ID NO: 7721 - DNA, 201 bp, Homo sapiens; identical to SEQ ID NO: 7486

SEQ ID NO: 7722 - DNA, 201 bp, Homo sapiens; identical to SEQ ID NO: 7647

SEQ ID NO: 7723 - DNA, 201 bp, Homo sapiens; identical to SEQ ID NO: 7488

SEQ ID NO: 7724 - DNA, 201 bp, Homo sapiens; identical to SEQ ID NO: 7489

SEQ ID NO: 7725 - DNA, 201 bp, Homo sapiens; identical to SEQ ID NO: 7490

SEQ ID NO: 7726 - DNA, 201 bp, Homo sapiens; identical to SEQ ID NO: 7491

SEQ ID NO: 7727 - DNA, 201 bp, Homo sapiens; identical to SEQ ID NO: 7492

SEQ ID NO: 7728 - DNA, 201 bp, Homo sapiens; identical to SEQ ID NO: 7493

SEQ ID NO: 7729 - DNA, 201 bp, Homo sapiens; identical to SEQ ID NO: 7494

SEQ ID NO: 7730 - DNA, 201 bp, Homo sapiens; identical to SEQ ID NO: 7495

SEQ ID NO: 7731 - DNA, 201 bp, Homo sapiens; identical to SEQ ID NO: 7496

SEQ ID NO: 7732 - DNA, 201 bp, Homo sapiens; identical to SEQ ID NO: 7656

SEQ ID NO: 7733 - DNA, 201 bp, Homo sapiens; identical to SEQ ID NO: 7498

SEQ ID NO: 7734 - DNA, 201 bp, Homo sapiens; identical to SEQ ID NO: 7499

SEQ ID NO: 7735 - DNA, 201 bp, Homo sapiens; identical to SEQ ID NO: 7500

SEQ ID NO: 7736 - DNA, 201 bp, Homo sapiens; identical to SEQ ID NO: 7426

SEQ ID NO: 7737 - DNA, 201 bp, Homo sapiens; identical to SEQ ID NO: 7502

SEQ ID NO: 7738 - DNA, 201 bp, Homo sapiens; identical to SEQ ID NO: 7583

SEQ ID NO: 7739 - DNA, 201 bp, Homo sapiens; identical to SEQ ID NO: 7429

SEQ ID NO: 7740 - DNA, 201 bp, Homo sapiens; identical to SEQ ID NO: 7585

SEQ ID NO: 7741 - DNA, 201 bp, Homo sapiens; identical to SEQ ID NO: 7586

SEQ ID NO: 7742 - DNA, 201 bp, Homo sapiens; identical to SEQ ID NO: 7432

SEQ ID NO: 7743 - DNA, 201 bp, Homo sapiens; identical to SEQ ID NO: 7433

SEQ ID NO: 7744 - DNA, 201 bp, Homo sapiens; identical to SEQ ID NO: 7434

SEQ ID NO: 7745 - DNA, 201 bp, Homo sapiens; identical to SEQ ID NO: 7435

SEQ ID NO: 7746 - DNA, 201 bp, Homo sapiens; identical to SEQ ID NO: 7436

SEQ ID NO: 7747 - DNA, 201 bp, Homo sapiens; identical to SEQ ID NO: 7437

SEQ ID NO: 7748 - DNA, 201 bp, Homo sapiens; identical to SEQ ID NO: 7438

SEQ ID NO: 7749 - DNA, 201 bp, Homo sapiens; identical to SEQ ID NO: 7439

SEQ ID NO: 7750 - DNA, 201 bp, Homo sapiens; identical to SEQ ID NO: 7440

SEQ ID NO: 7751 - DNA, 201 bp, Homo sapiens; identical to SEQ ID NO: 7441

SEQ ID NO: 7752 - DNA, 201 bp, Homo sapiens; identical to SEQ ID NO: 7442

SEQ ID NO: 7753 - DNA, 201 bp, Homo sapiens; identical to SEQ ID NO: 7443

SEQ ID NO: 7754 - DNA, 201 bp, Homo sapiens; identical to SEQ ID NO: 7444

SEQ ID NO: 7755 - DNA, 201 bp, Homo sapiens; identical to SEQ ID NO: 7445

SEQ ID NO: 7756 - DNA, 201 bp, Homo sapiens; identical to SEQ ID NO: 7446

SEQ ID NO: 7757 - DNA, 201 bp, Homo sapiens; identical to SEQ ID NO: 7447

SEQ ID NO: 7758 - DNA, 201 bp, Homo sapiens; identical to SEQ ID NO: 7448

SEQ ID NO: 7759 - DNA, 201 bp, Homo sapiens; identical to SEQ ID NO: 7449

SEQ ID NO: 7760 - DNA, 201 bp, Homo sapiens; identical to SEQ ID NO: 7450

SEQ ID NO: 7761 - DNA, 201 bp, Homo sapiens; identical to SEQ ID NO: 7451

SEQ ID NO: 7762 - DNA, 201 bp, Homo sapiens; identical to SEQ ID NO: 7452

SEQ ID NO: 7763 - DNA, 201 bp, Homo sapiens; identical to SEQ ID NO: 7453

SEQ ID NO: 7764 - DNA, 201 bp, Homo sapiens; identical to SEQ ID NO: 7529

SEQ ID NO: 7765 - DNA, 201 bp, Homo sapiens; identical to SEQ ID NO: 7455

SEQ ID NO: 7766 - DNA, 201 bp, Homo sapiens; identical to SEQ ID NO: 7456

SEQ ID NO: 7767 - DNA, 201 bp, Homo sapiens; identical to SEQ ID NO: 7457

SEQ ID NO: 7768 - DNA, 201 bp, Homo sapiens; identical to SEQ ID NO: 7533

SEQ ID NO: 7769 - DNA, 201 bp, Homo sapiens; identical to SEQ ID NO: 7458

SEQ ID NO: 7770 - DNA, 201 bp, Homo sapiens; identical to SEQ ID NO: 7459

SEQ ID NO: 7771 - DNA, 201 bp, Homo sapiens; identical to SEQ ID NO: 7460

SEQ ID NO: 7772 - DNA, 201 bp, Homo sapiens; identical to SEQ ID NO: 7537

SEQ ID NO: 7773 - DNA, 201 bp, Homo sapiens; identical to SEQ ID NO: 7538

SEQ ID NO: 7774 - DNA, 201 bp, Homo sapiens; identical to SEQ ID NO: 7463

SEQ ID NO: 7775 - DNA, 201 bp, Homo sapiens; identical to SEQ ID NO: 7464

SEQ ID NO: 7776 - DNA, 201 bp, Homo sapiens; identical to SEQ ID NO: 7541

SEQ ID NO: 7777 - DNA, 201 bp, Homo sapiens; identical to SEQ ID NO: 7465

SEQ ID NO: 7778 - DNA, 201 bp, Homo sapiens; identical to SEQ ID NO: 7466

SEQ ID NO: 7779 - DNA, 201 bp, Homo sapiens; identical to SEQ ID NO: 7467

SEQ ID NO: 7780 - DNA, 201 bp, Homo sapiens; identical to SEQ ID NO: 7468

SEQ ID NO: 7781 - DNA, 201 bp, Homo sapiens; identical to SEQ ID NO: 7469

SEQ ID NO: 7782 - DNA, 201 bp, Homo sapiens; identical to SEQ ID NO: 7470

SEQ ID NO: 7783 - DNA, 201 bp, Homo sapiens; identical to SEQ ID NO: 7471

SEQ ID NO: 7784 - DNA, 201 bp, Homo sapiens; identical to SEQ ID NO: 7472

SEQ ID NO: 7785 - DNA, 201 bp, Homo sapiens; identical to SEQ ID NO: 7630

SEQ ID NO: 7786 - DNA, 201 bp, Homo sapiens; identical to SEQ ID NO: 7474

SEQ ID NO: 7787 - DNA, 201 bp, Homo sapiens; identical to SEQ ID NO: 7475

SEQ ID NO: 7788 - DNA, 201 bp, Homo sapiens; identical to SEQ ID NO: 7553

SEQ ID NO: 7789 - DNA, 201 bp, Homo sapiens; identical to SEQ ID NO: 7476

SEQ ID NO: 7790 - DNA, 201 bp, Homo sapiens; identical to SEQ ID NO: 7478

SEQ ID NO: 7791 - DNA, 201 bp, Homo sapiens; identical to SEQ ID NO: 7479

SEQ ID NO: 7792 - DNA, 201 bp, Homo sapiens; identical to SEQ ID NO: 7557

SEQ ID NO: 7793 - DNA, 201 bp, Homo sapiens; identical to SEQ ID NO: 7481

SEQ ID NO: 7794 - DNA, 201 bp, Homo sapiens; identical to SEQ ID NO: 7559

SEQ ID NO: 7795 - DNA, 201 bp, Homo sapiens; identical to SEQ ID NO: 7482

SEQ ID NO: 7796 - DNA, 201 bp, Homo sapiens; identical to SEQ ID NO: 7483

SEQ ID NO: 7797 - DNA, 201 bp, Homo sapiens; identical to SEQ ID NO: 7484

SEQ ID NO: 7798 - DNA, 201 bp, Homo sapiens; identical to SEQ ID NO: 7485

SEQ ID NO: 7799 - DNA, 201 bp, Homo sapiens; identical to SEQ ID NO: 7486

SEQ ID NO: 7800 - DNA, 201 bp, Homo sapiens; identical to SEQ ID NO: 7489

SEQ ID NO: 7801 - DNA, 201 bp, Homo sapiens; identical to SEQ ID NO: 7488

SEQ ID NO: 7802 - DNA, 201 bp, Homo sapiens; identical to SEQ ID NO: 7647

SEQ ID NO: 7803 - DNA, 201 bp, Homo sapiens; identical to SEQ ID NO: 7490

SEQ ID NO: 7804 - DNA, 201 bp, Homo sapiens; identical to SEQ ID NO: 7491

SEQ ID NO: 7805 - DNA, 201 bp, Homo sapiens; identical to SEQ ID NO: 7492

SEQ ID NO: 7806 - DNA, 201 bp, Homo sapiens; identical to SEQ ID NO: 7571

SEQ ID NO: 7807 - DNA, 201 bp, Homo sapiens; identical to SEQ ID NO: 7493

SEQ ID NO: 7808 - DNA, 201 bp, Homo sapiens; identical to SEQ ID NO: 7494

SEQ ID NO: 7809 - DNA, 201 bp, Homo sapiens; identical to SEQ ID NO: 7495

SEQ ID NO: 7810 - DNA, 201 bp, Homo sapiens; identical to SEQ ID NO: 7496

SEQ ID NO: 7811 - DNA, 201 bp, Homo sapiens; identical to SEQ ID NO: 7656

SEQ ID NO: 7812 - DNA, 201 bp, Homo sapiens; identical to SEQ ID NO: 7498

SEQ ID NO: 7813 - DNA, 201 bp, Homo sapiens; identical to SEQ ID NO: 7578

SEQ ID NO: 7814 - DNA, 201 bp, Homo sapiens; identical to SEQ ID NO: 7499

SEQ ID NO: 7815 - DNA, 201 bp, Homo sapiens; identical to SEQ ID NO: 7500

SEQ ID NO: 7816 - DNA, 201 bp, Homo sapiens
catgccaggaagacccataactggttttaacactaactagagggaatgacttctttgcatagtgagtgacttgggccttcacaaacagggtgtggagtggmaggcagaggcctctaaatctcagggcaaacatggtgaatctatctctccggagataatttcatacagagattttaagaaaacatctttatattaaaaaca

SEQ ID NO: 7817 - DNA, 201 bp, Homo sapiens
tagaggctttctcggactgcctgcgctatgagatgtaccccctgggcgtgaaggtcagcgtggtggagcccggcaacttcatcgctgccaccagcctttayagccctgagagcattcaggccatcgccaagaagatgtgggaggagctgcctgaggtcgtgcgcaaggactacggcaagaagtactttgatgaaaagatcg

SEQ ID NO: 7818 - DNA, 201 bp, Homo sapiens
tccggctggtcacttgcctggagaggatcctgcatgctgatagtgctgaggcacctgccagctaagaaccaccgggaggaactgggccattctaacacccrttgctaccatgctggccacccgcctctccagacccctgtcacggctcccaggaaaaaccctaagtgcctgtgatagagaaaatggagcaagacgcccact

SEQ ID NO: 7819 - DNA, 201 bp, Homo sapiens
tcaatgtctgcagcagcgaagaggtggagaaagtggtggagattgtccgctcgagcctgaaggaccctgagaaaggcatgtggggcctcgttaacaatgcyggcatctcaacgttcggggaggtggagttcaccagcctggagacctacaagcaggtggcagaagtgaacctttggggcacagtgcggatgacgaaatcct

SEQ ID NO: 7820 - DNA, 201 bp, Homo sapiens
aactcacagacattttaagcttaaaacaaacagttacaaagctgttgaactttgcctgtgcaaggacaaacacaaaaacatcccaaggcccaccccccgcygacccccactgtacttgtcacacatatgtgagaatttccattctcagctaaaggcaagcattgaaagaatacacagaaagcctggaaaaggtttccaggg

SEQ ID NO: 7821 - DNA, 201 bp, Homo sapiens
tgaatgaaaaggacaggtttttttcttttgtaaatgaagcatttgcagcttaaagaggatgcatgaaataacccttttatcgcttataaatagtgccagtyatgtgttcctgccacggctgtggaaatacttcacatttgcattccaggactgttttggatccatttgcccgagaatcttctgactaactctgtgtcctca

SEQ ID NO: 7822 - DNA, 201 bp, Homo sapiens
ttcacaaacagggtgtggagtggcaggcagaggcctctaaatctcagggcaaacatggtgaatctatctctccggagataatttcatacagagattttaaraaaacatctttatattaaaaacagatctcatttgatccttaagccagtctcatgaatgaaaaggacaggtttttttcttttgtaaatgaagcatttgcag

SEQ ID NO: 7823 - DNA, 201 bp, Homo sapiens
ttttaacactaactagagggaatgacttctttgcatagtgagtgacttgggccttcacaaacagggtgtggagtggcaggcagaggcctctaaatctcagrgcaaacatggtgaatctatctctccggagataatttcatacagagattttaagaaaacatctttatattaaaaacagatctcatttgatccttaagccag

SEQ ID NO: 7824 - DNA, 201 bp, Homo sapiens
cctgtcacggctcccaggaaaaaccctaagtgcctgtgatagagaaaatggagcaagacgcccactattgcttggttctacttcctttatcccgattggcygtcggacttatgccagtgcggcggagccggttggcagcaaagctgtcctggtcacaggctgtgactctggatttgggttctcattggccaagcatctgca

SEQ ID NO: 7825 - DNA, 160 bp, Homo sapiens
tctccagcctcttcttggaaatggccctatctaaaaaccacttggccattttgaaatctytctcaggtcctgattctgggttatgctcagggcagtctctgaagatttctcatcctgttcaggccggttccttgctaatttatgcccacacatacctggc

SEQ ID NO: 7826 - DNA, 201 bp, Homo sapiens
gtgaccgattgagaaccgtccagctcaatgtctgcagcagcgaagaggtggagaaagtggtggagattgtccgctcgagcctgaaggaccctgagaaaggsatgtggggcctcgttaacaatgccggcatctcaacgttcggggaggtggagttcaccagcctggagacctacaagcaggtggcagaagtgaacctttggg

SEQ ID NO: 7827 - DNA, 201 bp, Homo sapiens
ggacaggtttttttcttttgtaaatgaagcatttgcagcttaaagaggatgcatgaaataacccttttatcgcttataaatagtgccagttatgtgttccygccacggctgtggaaatacttcacatttgcattccaggactgttttggatccatttgcccgagaatcttctgactaactctgtgtcctcatctgggcagc

SEQ ID NO: 7828 - DNA, 201 bp, Homo sapiens; identical to SEQ ID NO: 7816

SEQ ID NO: 7829 - DNA, 201 bp, Homo sapiens
ggccgcaggagtgctggtggaggggcttccagaaagaccctgcggcagcgccccccctcggctctccccgcaggagagcgggcacctgcgcggcgccgggygaaggcgagagcctcggcgagccctctgcagcggagccccctgcccatttggttttggtcagcctggaaatctgcctgtagtcagctgatgcagagtcac

SEQ ID NO: 7830 - DNA, 201 bp, Homo sapiens; identical to SEQ ID NO: 7817

SEQ ID NO: 7831 - DNA, 201 bp, Homo sapiens
tcactatggagggccgcctgcaggcctcgcgctgacaggatcttttgtgacgctgcaaatgtcctgaaccaccgggaggaactgggccattctaacacccrttgctaccatgctggccacccgcctctccagacccctgtcacggctcccaggaaaaaccctaagtgcctgtgatagagaaaatggagcaagacgcccact

SEQ ID NO: 7832 - DNA, 201 bp, Homo sapiens; identical to SEQ ID NO: 7819

SEQ ID NO: 7833 - DNA, 201 bp, Homo sapiens; identical to SEQ ID NO: 7821

SEQ ID NO: 7834 - DNA, 201 bp, Homo sapiens; identical to SEQ ID NO: 7822

SEQ ID NO: 7835 - DNA, 201 bp, Homo sapiens; identical to SEQ ID NO: 7823

SEQ ID NO: 7836 - DNA, 201 bp, Homo sapiens; identical to SEQ ID NO: 7824

SEQ ID NO: 7837 - DNA, 201 bp, Homo sapiens; identical to SEQ ID NO: 7826

SEQ ID NO: 7838 - DNA, 201 bp, Homo sapiens; identical to SEQ ID NO: 7827

SEQ ID NO: 7839 - DNA, 201 bp, Homo sapiens; identical to SEQ ID NO: 7816

SEQ ID NO: 7840 - DNA, 201 bp, Homo sapiens
ggccgcaggagtgctggtggaggggcttccagaaagaccctgcggcagcgccccccctcggctctccccgcaggagagcgggcacctgcgcggcgccgggygaaggcgagagcctcggcgagccctctgcagcggagccccctgcccatttggttttggaaccaccgggaggaactgggccattctaacacccgttgctac

SEQ ID NO: 7841 - DNA, 201 bp, Homo sapiens; identical to SEQ ID NO: 7817

SEQ ID NO: 7842 - DNA, 201 bp, Homo sapiens
cgccgggtgaaggcgagagcctcggcgagccctctgcagcggagccccctgcccatttggttttggaaccaccgggaggaactgggccattctaacacccrttgctaccatgctggccacccgcctctccagacccctgtcacggctcccaggaaaaaccctaagtgcctgtgatagagaaaatggagcaagacgcccact

SEQ ID NO: 7843 - DNA, 201 bp, Homo sapiens; identical to SEQ ID NO: 7819

SEQ ID NO: 7844 - DNA, 201 bp, Homo sapiens; identical to SEQ ID NO: 7821

SEQ ID NO: 7845 - DNA, 201 bp, Homo sapiens; identical to SEQ ID NO: 7822

SEQ ID NO: 7846 - DNA, 201 bp, Homo sapiens; identical to SEQ ID NO: 7823

SEQ ID NO: 7847 - DNA, 201 bp, Homo sapiens; identical to SEQ ID NO: 7824

SEQ ID NO: 7848 - DNA, 201 bp, Homo sapiens; identical to SEQ ID NO: 7826

SEQ ID NO: 7849 - DNA, 201 bp, Homo sapiens; identical to SEQ ID NO: 7827

SEQ ID NO: 7850 - DNA, 201 bp, Homo sapiens; identical to SEQ ID NO: 7816

SEQ ID NO: 7851 - DNA, 201 bp, Homo sapiens; identical to SEQ ID NO: 7817

SEQ ID NO: 7852 - DNA, 201 bp, Homo sapiens
gacagctgaacttgaacatgtgggctgtcactgagagcggtcagcagaagaaaatttgagccatggaaccaccgggaggaactgggccattctaacacccrttgctaccatgctggccacccgcctctccagacccctgtcacggctcccaggaaaaaccctaagtgcctgtgatagagaaaatggagcaagacgcccact

SEQ ID NO: 7853 - DNA, 201 bp, Homo sapiens; identical to SEQ ID NO: 7819

SEQ ID NO: 7854 - DNA, 201 bp, Homo sapiens
tggtcacttgcctggagaggatcctgcatgctgatagtgctgaggcacctgccagctaaggtgagagacagctgaacttgaacatgtgggctgtcactgaragcggtcagcagaagaaaatttgagccatggaaccaccgggaggaactgggccattctaacacccgttgctaccatgctggccacccgcctctccagacc

SEQ ID NO: 7855 - DNA, 201 bp, Homo sapiens; identical to SEQ ID NO: 7821

SEQ ID NO: 7856 - DNA, 201 bp, Homo sapiens; identical to SEQ ID NO: 7822

SEQ ID NO: 7857 - DNA, 201 bp, Homo sapiens; identical to SEQ ID NO: 7823

SEQ ID NO: 7858 - DNA, 201 bp, Homo sapiens; identical to SEQ ID NO: 7824

SEQ ID NO: 7859 - DNA, 201 bp, Homo sapiens; identical to SEQ ID NO: 7826

SEQ ID NO: 7860 - DNA, 201 bp, Homo sapiens; identical to SEQ ID NO: 7827

SEQ ID NO: 7861 - DNA, 201 bp, Homo sapiens
tggcaagcaccagggaggagaacttctatgtggacgagacaactgtggtgaaggtgcccatgatgttgcagtcgagcaccatcagttaccttcatgactcrgagctcccctgccagctggtgcagatgaactacgtgggcaatgggactgtcttcttcatccttccggacaaggggaagatgaacacagtcatcgctgcac

SEQ ID NO: 7862 - DNA, 201 bp, Homo sapiens
tgggtttcaacctcactgagaggtctgagactgagatccaccagggtttccagcacctgcaccaactctttgcaaagtcagacaccagcttagaaatgacyatgggcaatgccttgtttcttgatggcagcctggagttgctggagtcattctcagcagacatcaagcactactatgagtcagaggtcttggctatgaatt

SEQ ID NO: 7863 - DNA, 201 bp, Homo sapiens
cctggcaagcaccagggaggagaacttctatgtggacgagacaactgtggtgaaggtgcccatgatgttgcagtcgagcaccatcagttaccttcatgackcggagctcccctgccagctggtgcagatgaactacgtgggcaatgggactgtcttcttcatccttccggacaaggggaagatgaacacagtcatcgctgc

SEQ ID NO: 7864 - DNA, 102 bp, Homo sapiens
ayccaccgcaggcttactgtacacatgctagggtccaggacagcaggaccaagccagcagaaacagcctgagcccaccgcagactggcctggctatactgga

SEQ ID NO: 7865 - DNA, 201 bp, Homo sapiens
gggtcaccctaaacctgacgtccaagcctatcatcttgcgtttcaaccagcccttcatcatcatgatcttcgaccacttcacctggagcagccttttcctrgcgagggttatgaacccagtgtaagagaccacccacccagagcctcagcactgtctgactttgggaaccagggatcccacagaaatgttttggagagcgg

SEQ ID NO: 7866 - DNA, 201 bp, Homo sapiens
cactgagccgggacacgattaacaggtggtccgcaggcctgaccagcagccaggtggacctgtacattccaaaggtcaccatctctggagtctatgacctyggagatgtgctggaggaaatgggcattgcagacttgttcaccaaccaggcaaatttctcacgcatcacccaggacgcccagctgaagtcatcaaaggtgg

SEQ ID NO: 7867 - DNA, 162 bp, Homo sapiens
cccagagcctcagcactgtctgactttgggaaccagggatcccacagaaatgttttggagagcgggaggtttcccccaatctcctccaagttcttctcccyccaaccagagttgtgtctaactttaggcatcttttaataaatgtcattgcgactctgatga

SEQ ID NO: 7868 - DNA, 201 bp, Homo sapiens
tcaccatctctggagtctatgacctcggagatgtgctggaggaaatgggcattgcagacttgttcaccaaccaggcaaatttctcacgcatcacccaggaygcccagctgaagtcatcaaaggtggtccataaagctgtgctgcaactcaatgaggagggtgtggacacagctggctccactggggtcaccctaaacctga

SEQ ID NO: 7869 - DNA, 201 bp, Homo sapiens
cgagtcggatgccacccgcaggcgtaagctggagcggatgaggtctgtgcgcctgcaggaggccgggggagacttgggccggcgcgggacgagcgtgttgwcgcagcagagcgtccgcacacagcacttgcgggacctacaggtcatcgccgcctaccgggaacgcacgaaggccgagagcatcgccagcctgctgagcct

SEQ ID NO: 7870 - DNA, 201 bp, Homo sapiens
gtccttcgggggacacagacagtgaggaaagtgagagctttcacctctcatccccaggagctgaagacagaccccaaaggtgtcttcgtgctgccgcctcrtggggtgcaggacctgcatgttggcgtgaggccccttagggccggcagccgctttgtccatctcaacctggtggacgtggattgccaccagctggtggcc

SEQ ID NO: 7871 - DNA, 201 bp, Homo sapiens
ccccccagctctacctgcgcccccacgagaccgcccacgtccccttcaagttccagagcttctctgcagggcagctggccatggtgcaggcctctcctggsttgagcaacgagaagggcatggacgccgtgtcaccttggaagtccagcgcagtgcccactaaacacgccaaggtcttgttccgagcgagtggtggcaagc

SEQ ID NO: 7872 - DNA, 201 bp, Homo sapiens
agtcggatgccacccgcaggcgtaagctggagcggatgaggtctgtgcgcctgcaggaggccgggggagacttgggccggcgcgggacgagcgtgttggcrcagcagagcgtccgcacacagcacttgcgggacctacaggtcatcgccgcctaccgggaacgcacgaaggccgagagcatcgccagcctgctgagcctgg

SEQ ID NO: 7873 - DNA, 201 bp, Homo sapiens
gcccgccagcgccagtacctcgagttctcgctgccccgcagaactcacctgtgggaccagggttgtcaatttcccagctggcggcctccccgcggtccccractcagcactgcttggccaggcctacttcacagctaccccatggctctcaggcctccccggcccaggcacaggagttcccgttggaggccggtatctccc

SEQ ID NO: 7874 - DNA, 201 bp, Homo sapiens
tcggccaccctgcatttgcggtcatcttccagctggagtacgtgttcagcagccctgcaggagtggacggcaatgcagcttcggtcacctctctgtccaamctggcatgcatgcacatggtccgctgggctgtttggaaccccttgctggaagctgattctggaagggtgaccctgcctctgcagggtgggatccagccca

SEQ ID NO: 7875 - DNA, 201 bp, Homo sapiens
taccgggaacgcacgaaggccgagagcatcgccagcctgctgagcctggccatcaccacggagcacacgctccacgccacgctgggggtcgccgagttctytgagtttgtgcttaagaacccccacaacacacagcacacggtgactgtggagatcgacaaccccgagctcagcgtcatcgtggacagtcaggagtggagg

SEQ ID NO: 7876 - DNA, 201 bp, Homo sapiens
gggtcatctcaaacgatggagccagccgcttctctggaggcagcctcctcacgactggaagctcaaggcgaaaacacgtggtgcaagcacagaagctggcrgacgtggacagtgagctggctgccatgctactgacccatgcccggcagggcaaggggccccaggacgtcagccgcgagtcggatgccacccgcaggcgta

SEQ ID NO: 7877 - DNA, 201 bp, Homo sapiens
ttctggatgccaataaacagccagccgaggctgtcagcgctacagaacctgtgacgtttaaccctcagaaggaagaatcagattgtctacaaagcaacgaratggtgctacagtttcttgcctttagcagagtggcccaggactgccgaggaacatcatggccaaagactgtgtatttcaccttccagttctaccgcttcc

SEQ ID NO: 7878 - DNA, 201 bp, Homo sapiens
cccaggacgtcagccgcgagtcggatgccacccgcaggcgtaagctggagcggatgaggtctgtgcgcctgcaggaggccgggggagacttgggccggcgygggacgagcgtgttggcgcagcagagcgtccgcacacagcacttgcgggacctacaggtcatcgccgcctaccgggaacgcacgaaggccgagagcatcg

SEQ ID NO: 7879 - DNA, 201 bp, Homo sapiens
agcagagatggcacctttgatgctgggtctcctggcttccagctgaggtacatggtgggccctgggttcctgaagccaggtgagcggcgctgctttgcccrctacctggccgtgcagaccctgcagattgacgtctgggacggagactccctgctgctcatcggatctgctgccgtccagatgaagcatctcctccgccaa

SEQ ID NO: 7880 - DNA, 201 bp, Homo sapiens
agctcaaggcgaaaacacgtggtgcaagcacagaagctggcggacgtggacagtgagctggctgccatgctactgacccatgcccggcagggcaaggggcsccaggacgtcagccgcgagtcggatgccacccgcaggcgtaagctggagcggatgaggtctgtgcgcctgcaggaggccgggggagacttgggccggcgc

SEQ ID NO: 7881 - DNA, 201 bp, Homo sapiens
acctgtgacgtttaaccctcagaaggaagaatcagattgtctacaaagcaacgagatggtgctacagtttcttgcctttagcagagtggcccaggactgcygaggaacatcatggccaaagactgtgtatttcaccttccagttctaccgcttcccacccgcaacgacgccacgactgcagctggtccagctggatgaggc

SEQ ID NO: 7882 - DNA, 201 bp, Homo sapiens
acacgctccacgccacgctgggggtcgccgagttctttgagtttgtgcttaagaacccccacaacacacagcacacggtgactgtggagatcgacaacccygagctcagcgtcatcgtggacagtcaggagtggagggacttcaagggtgctgctggcctgcacacaccggtggaggaggacatgttccacctgcgtggca

SEQ ID NO: 7883 - DNA, 201 bp, Homo sapiens
tgcctttagcagagtggcccaggactgccgaggaacatcatggccaaagactgtgtatttcaccttccagttctaccgcttcccacccgcaacgacgccaygactgcagctggtccagctggatgaggccggccagcccagctctggcgccctgacccacatcctcgtgcctgtgagcagagatggcacctttgatgctgg

SEQ ID NO: 7884 - DNA, 201 bp, Homo sapiens
caggtgctccggtgggaatgcttggtgaggaccccccagtccatgttcgctgcagcgacccgaacgtcatctgtgagacccagaatgtgggccccggggarccacgggacatatttctgaaggtggccagtggtccaagcccggagatcaaagacttctttgtcatcatttactcggatcgctggctggcgacacccacac

SEQ ID NO: 7885 - DNA, 201 bp, Homo sapiens
gctgaggtacatggtgggccctgggttcctgaagccaggtgagcggcgctgctttgcccgctacctggccgtgcagaccctgcagattgacgtctgggacrgagactccctgctgctcatcggatctgctgccgtccagatgaagcatctcctccgccaaggccggccggctgtgcaggcctcccacgagcttgaggtcgt

SEQ ID NO: 7886 - DNA, 201 bp, Homo sapiens
ccgcggtccccgactcagcactgcttggccaggcctacttcacagctaccccatggctctcaggcctccccggcccaggcacaggagttcccgttggaggscggtatctcccacctggaagccgacctgagccagacctccctggtcctggaaacatccattgccgaacagttacaggagctgccgttcacgcctttgcat

SEQ ID NO: 7887 - DNA, 201 bp, Homo sapiens
cctgctgctcatcggatctgctgccgtccagatgaagcatctcctccgccaaggccggccggctgtgcaggcctcccacgagcttgaggtcgtggcaactkaatacgagcaggacaacatggtggtgagtggagacatgctggggtttggccgcgtcaagcccatcggcgtccactcggtggtgaagggccggctgcacct

SEQ ID NO: 7888 - DNA, 201 bp, Homo sapiens
tgcagggcagccctcgagagcctccatggtgctcctgcagtcctccggctttcccgagattctggatgccaataaacagccagccgaggctgtcagcgctrcagaacctgtgacgtttaaccctcagaaggaagaatcagattgtctacaaagcaacgagatggtgctacagtttcttgcctttagcagagtggcccagga

SEQ ID NO: 7889 - DNA, 201 bp, Homo sapiens
catcggatctgctgccgtccagatgaagcatctcctccgccaaggccggccggctgtgcaggcctcccacgagcttgaggtcgtggcaactgaatacgagyaggacaacatggtggtgagtggagacatgctggggtttggccgcgtcaagcccatcggcgtccactcggtggtgaagggccggctgcacctgactttggc

SEQ ID NO: 7890 - DNA, 201 bp, Homo sapiens
ctcggtggtgaagggccggctgcacctgactttggccaacgtgggtcacccgtgtgaacagaaagtgagaggttgtagcacattgccaccgtccagatctygggtcatctcaaacgatggagccagccgcttctctggaggcagcctcctcacgactggaagctcaaggcgaaaacacgtggtgcaagcacagaagctggc

SEQ ID NO: 7891 - DNA, 120 bp, Homo sapiens
ggtaccccggctgctgctamtgccgcaggacgcggtgcagcagtggggtctttgcatcctgggagcagcagcagatcatccgggaagcccacgggaccctcaggcgggcaggatgaacga

SEQ ID NO: 7892 - DNA, 201 bp, Homo sapiens
tgctacagtttcttgcctttagcagagtggcccaggactgccgaggaacatcatggccaaagactgtgtatttcaccttccagttctaccgcttcccaccygcaacgacgccacgactgcagctggtccagctggatgaggccggccagcccagctctggcgccctgacccacatcctcgtgcctgtgagcagagatggca

SEQ ID NO: 7893 - DNA, 201 bp, Homo sapiens
ggacattccacctgcacagcgaccacccggagctgctgcggttcagagaggactccttccaggtcgggggtggagagacctacaccatcggcttgcagttwgcgcctagtcagagagtgggtgaggaggagatcctgatctacatcaatgaccatgaggacaaaaacgaagaggcattttgcgtgaaggtcatctaccagt

SEQ ID NO: 7894 - DNA, 201 bp, Homo sapiens
ccagaccaggagctctgcagggcagccctcgagagcctccatggtgctcctgcagtcctccggctttcccgagattctggatgccaataaacagccagccraggctgtcagcgctacagaacctgtgacgtttaaccctcagaaggaagaatcagattgtctacaaagcaacgagatggtgctacagtttcttgcctttag

SEQ ID NO: 7895 - DNA, 201 bp, Homo sapiens; identical to SEQ ID NO: 7869

SEQ ID NO: 7896 - DNA, 201 bp, Homo sapiens; identical to SEQ ID NO: 7870

SEQ ID NO: 7897 - DNA, 201 bp, Homo sapiens; identical to SEQ ID NO: 7871

SEQ ID NO: 7898 - DNA, 201 bp, Homo sapiens; identical to SEQ ID NO: 7872

SEQ ID NO: 7899 - DNA, 201 bp, Homo sapiens
cacccacggagcctgtcagtggccccaaagtggagcggcggccttccaggaaaccacccacgttgtcaatttcccagctggcggcctccccgcggtccccractcagcactgcttggccaggcctacttcacagctaccccatggctctcaggcctccccggcccaggcacaggagttcccgttggaggccggtatctccc

SEQ ID NO: 7900 - DNA, 201 bp, Homo sapiens; identical to SEQ ID NO: 7874

SEQ ID NO: 7901 - DNA, 201 bp, Homo sapiens; identical to SEQ ID NO: 7875

SEQ ID NO: 7902 - DNA, 201 bp, Homo sapiens; identical to SEQ ID NO: 7876

SEQ ID NO: 7903 - DNA, 201 bp, Homo sapiens; identical to SEQ ID NO: 7880

SEQ ID NO: 7904 - DNA, 201 bp, Homo sapiens; identical to SEQ ID NO: 7879

SEQ ID NO: 7905 - DNA, 201 bp, Homo sapiens; identical to SEQ ID NO: 7877

SEQ ID NO: 7906 - DNA, 201 bp, Homo sapiens; identical to SEQ ID NO: 7878

SEQ ID NO: 7907 - DNA, 201 bp, Homo sapiens; identical to SEQ ID NO: 7881

SEQ ID NO: 7908 - DNA, 201 bp, Homo sapiens; identical to SEQ ID NO: 7882

SEQ ID NO: 7909 - DNA, 201 bp, Homo sapiens; identical to SEQ ID NO: 7884

SEQ ID NO: 7910 - DNA, 201 bp, Homo sapiens; identical to SEQ ID NO: 7883

SEQ ID NO: 7911 - DNA, 201 bp, Homo sapiens; identical to SEQ ID NO: 7885

SEQ ID NO: 7912 - DNA, 201 bp, Homo sapiens; identical to SEQ ID NO: 7886

SEQ ID NO: 7913 - DNA, 201 bp, Homo sapiens; identical to SEQ ID NO: 7887

SEQ ID NO: 7914 - DNA, 201 bp, Homo sapiens; identical to SEQ ID NO: 7888

SEQ ID NO: 7915 - DNA, 201 bp, Homo sapiens; identical to SEQ ID NO: 7889

SEQ ID NO: 7916 - DNA, 120 bp, Homo sapiens; identical to SEQ ID NO: 7891

SEQ ID NO: 7917 - DNA, 201 bp, Homo sapiens; identical to SEQ ID NO: 7892

SEQ ID NO: 7918 - DNA, 201 bp, Homo sapiens; identical to SEQ ID NO: 7890

SEQ ID NO: 7919 - DNA, 201 bp, Homo sapiens; identical to SEQ ID NO: 7894

SEQ ID NO: 7920 - DNA, 201 bp, Homo sapiens
tttattggagtaatctagaaaattttaaaattgttacatctttggtatttataaatgtgatactttactttctgtgggtacttctatagaggcactacagratcagaaaatgcaaattgaatcattttagcaccttttgatataaatagaaatgcactgatgcagaggtaaaaaatcttagaacttttgttgggaaactat

SEQ ID NO: 7921 - DNA, 201 bp, Homo sapiens
tctggcatgtttggaaatcaaaatgtcacattctcgggggaggaagcccagaaaattgggtatgttctagagatttaccaccattgcttattgcttttttytttaataaagtttaggaaagtagaatttttattatgtactgtatgtttgcataaatcacctttctcctttgtggttaaggcatatatgccaacccccagc

SEQ ID NO: 7922 - DNA, 201 bp, Homo sapiens
cttggccagaaggaatccatggcaaaaatcaggtttagagtcttaaactctaattcttagttgaatgaatttgatcttttaaatattaatgataaatgttwacaagaagttgctttaataagcaacagttaaaattctgttacctttttaaacttgcaataacaaccttcatttttaaaaatacagtagtaaagattgagg

SEQ ID NO: 7923 - DNA, 201 bp, Homo sapiens
tgggaaactataaataattggtcctttcccatcagttctgcattggcttctccaactgtcaaggtttaggattatattgttatattgatcacatgtgcttwaatttcttggccagaaggaatccatggcaaaaatcaggtttagagtcttaaactctaattcttagttgaatgaatttgatcttttaaatattaatgataa

SEQ ID NO: 7924 - DNA, 201 bp, Homo sapiens
agaaggaatccatggcaaaaatcaggtttagagtcttaaactctaattcttagttgaatgaatttgatcttttaaatattaatgataaatgtttacaagawgttgctttaataagcaacagttaaaattctgttacctttttaaacttgcaataacaaccttcatttttaaaaatacagtagtaaagattgaggtatcagc

SEQ ID NO: 7925 - DNA, 201 bp, Homo sapiens
atcgacaagaagctattgactggcttcttggtttagctgttagacttgaatatggagataatgctgaaaaatacaaggatttagtacctgataattcaaaractgctgacaatgcaactaaaaatgcagaaccattgatcaatttggatgtaaataatcctgattttaaggctggtgtgatggctttggctaacctgcttc

SEQ ID NO: 7926 - DNA, 201 bp, Homo sapiens
ggtaaaaaatcttagaacttttgttgggaaactataaataattggtcctttcccatcagttctgcattggcttctccaactgtcaaggtttaggattatawtgttatattgatcacatgtgctttaatttcttggccagaaggaatccatggcaaaaatcaggtttagagtcttaaactctaattcttagttgaatgaatt

SEQ ID NO: 7927 - DNA, 201 bp, Homo sapiens
aagaagctattgactggcttcttggtttagctgttagacttgaatatggagataatgctgaaaaatacaaggatttagtacctgataattcaaaaactgcwgacaatgcaactaaaaatgcagaaccattgatcaatttggatgtaaataatcctgattttaaggctggtgtgatggctttggctaacctgcttcagattc

SEQ ID NO: 7928 - DNA, 201 bp, Homo sapiens
tttaagaaacatccacagcagcgactggcccaagttctttgaaaagtatctcagagatgttaactgtcctttcaagattcaagatcgacaagaagctattsactggcttcttggtttagctgttagacttgaatatggagataatgctgaaaaatacaaggatttagtacctgataattcaaaaactgctgacaatgcaac

SEQ ID NO: 7929 - DNA, 201 bp, Homo sapiens
ccagaaaatcaggcactacaagattgaagacagagggaatttaagaaacatccacagcagcgactggcccaagttctttgaaaagtatctcagagatgttmactgtcctttcaagattcaagatcgacaagaagctattgactggcttcttggtttagctgttagacttgaatatggagataatgctgaaaaatacaagga

SEQ ID NO: 7930 - DNA, 201 bp, Homo sapiens
tccacacgctgtttgttggggtagcttccatcggcagtctggcccattgtcagtcatgcttcttctggccggggagattatagagagattgtttgaagatygggttattattgaaagtctttttttttgtttgttttgttttggtttgtttgtttatctacacttgtttatgctgtgagccaaacctctatttaaaaagtt

SEQ ID NO: 7931 - DNA, 201 bp, Homo sapiens
gaattctgatacatcctgccaacactgtgtgtgtgtgtgtgtgtgtgtgtgtgtgtgtgtgtgtgtgtgaaagagagacagaagggaatggtttgagaggktgcttgtgtgcatgtgtgtgcatatgtaaagagatttttgtggtttaagtaactcagaatagctgtagcaaatgactgaatacatgtgaacaaacagaag

SEQ ID NO: 7932 - DNA, 201 bp, Homo sapiens
ttctgggtccatatctcccagatgaaaaactgttaaccaataccatattttatagttggtgtccatttctttccaacactgtttgttatgattcttccttsagtacttatatacagacctgctcattatctaaacaatcttaccttctaagtaaaccttgattgtgatttccagtttttattttctctgacgtagtagaaa

SEQ ID NO: 7933 - DNA, 201 bp, Homo sapiens
catgtgaacaaacagaaggaagttcactctggagtgtctttgggaggcagccattccaaatgccctcctccatttagcttcaataaagggccttttgctgrtggagggcactcaagggctgggtgagagggccacgtgtttggtattacattactgctatgcaccacttgaaggagctctatcaccagcctcaaacccgaa

SEQ ID NO: 7934 - DNA, 201 bp, Homo sapiens
attactgctatgcaccacttgaaggagctctatcaccagcctcaaacccgaaagactgaggcattttccagtctacttgcctaatgaatgtataggaactstctatgagtatggatgtcactcaactaagatcaaatcaccatttaaggggatggcattctttatacctaaacacctaagagctgaagtcaggtcttttaa

SEQ ID NO: 7935 - DNA, 201 bp, Homo sapiens
acctcctggcagacccttctcttccaccaaacgtgtgcacatccttgagagccgtgagcaacttgctcagcacacagctcaccttccaggccattcacaascccagagtgaatcccgttacttcgctcagtgaaaactatacctgttctgactctgaagagagctctgaaaaagacaagcttgctattccaaagcgcctga

SEQ ID NO: 7936 - DNA, 201 bp, Homo sapiens
gcgaggagataccaacccaaaagccagaccagtgacaatggatagaatgggctgtgtttccaaacagattgacttgtcaaagactctcttcaagccagcayaacatttagacacaacactgtagaaatttgagatgggcaaatggctattgcattttgggattcttcgcattttgtgtgtatatttttacagtgaggtaca

SEQ ID NO: 7937 - DNA, 201 bp, Homo sapiens
ctcttccaccaaacgtgtgcacatccttgagagccgtgagcaacttgctcagcacacagctcaccttccaggccattcacaagcccagagtgaatcccgtyacttcgctcagtgaaaactatacctgttctgactctgaagagagctctgaaaaagacaagcttgctattccaaagcgcctgagaaggagtttgcctcctg

SEQ ID NO: 7938 - DNA, 201 bp, Homo sapiens
cctatgctatttctgcagctaaccatgtaaaggctaaaaagcaaagtcgaccaggtgccctcgctaaaatttcacctctttcatcgccctgctcctcacckctccaagggactcctgccagcagcctggtcagcaaaatttctgcagtgcagtttccagaatctgctgacacaactgccaaacaaagcctaggttctcaca

SEQ ID NO: 7939 - DNA, 201 bp, Homo sapiens
acttgcctaatgaatgtataggaactgtctatgagtatggatgtcactcaactaagatcaaatcaccatttaaggggatggcattctttatacctaaacayctaagagctgaagtcaggtcttttaatcaggttagaattctaaatgatgccagagaaggcttgggaaattgtacttcagcgtgatagcctgtgtcttctt

SEQ ID NO: 7940 - DNA, 201 bp, Homo sapiens
tcaactaagatcaaatcaccatttaaggggatggcattctttatacctaaacacctaagagctgaagtcaggtcttttaatcaggttagaattctaaatgrtgccagagaaggcttgggaaattgtacttcagcgtgatagcctgtgtcttcttaatttgctgcaaaatatgtggtagagaaagaaaaggaaacagaaaaa

SEQ ID NO: 7941 - DNA, 156 bp, Homo sapiens
agtgaagagggcaccctataccatggcagtgcccggcgacgctgcacgagtcaggracaagcccgtccacagtggggtgagtcaagcccccacggcgggccgggactgccaccatcgtgcggaccccgcatcgccgcgggactcgggctgccgtgg

SEQ ID NO: 7942 - DNA, 201 bp, Homo sapiens
ccacacgctgtttgttggggtagcttccatcggcagtctggcccattgtcagtcatgcttcttctggccggggagattatagagagattgtttgaagattsggttattattgaaagtctttttttttgtttgttttgttttggtttgtttgtttatctacacttgtttatgctgtgagccaaacctctatttaaaaagttg

SEQ ID NO: 7943 - DNA, 201 bp, Homo sapiens
tattacattactgctatgcaccacttgaaggagctctatcaccagcctcaaacccgaaagactgaggcattttccagtctacttgcctaatgaatgtatargaactgtctatgagtatggatgtcactcaactaagatcaaatcaccatttaaggggatggcattctttatacctaaacacctaagagctgaagtcaggtc

SEQ ID NO: 7944 - DNA, 201 bp, Homo sapiens
cactccccgccgcgggggtggtgctcagctgcttggccgccgcgacatggctggtgctgaggctgaggctgggcgtcctcatgatcgccttgactagcgckgtcaggaccgtgtccctcatttccttagagaggttcaaggtcgcctggagaccttacctggcgtacctggccggcgtgctggggatcctcttggccaggt

SEQ ID NO: 7945 - DNA, 201 bp, Homo sapiens
agaaggacgccaactccgacttctcctcctacgccgactcgctctggtgggggacgattacattgacaaccatcggctatggtgacaagacaccgcacacrtggctgggcagggtcctggctgctggcttcgccttactgggcatctctttctttgccctgcctgccggcatcctaggctccggctttgccctgaaggtcc

SEQ ID NO: 7946 - DNA, 201 bp, Homo sapiens
gcctggtacatcgggttcctggtgctcatcttcgcctccttcctggtctacctggctgagaaggacgccaactccgacttctcctcctacgccgactcgcwctggtgggggacgattacattgacaaccatcggctatggtgacaagacaccgcacacatggctgggcagggtcctggctgctggcttcgccttactgggc

SEQ ID NO: 7947 - DNA, 201 bp, Homo sapiens
tgctgggctcagtggtctacgcgcatagcaaggagctgatcaccgcctggtacatcgggttcctggtgctcatcttcgcctccttcctggtctacctggcygagaaggacgccaactccgacttctcctcctacgccgactcgctctggtgggggacgattacattgacaaccatcggctatggtgacaagacaccgcaca

SEQ ID NO: 7948 - DNA, 201 bp, Homo sapiens
tacatcgggttcctggtgctcatcttcgcctccttcctggtctacctggctgagaaggacgccaactccgacttctcctcctacgccgactcgctctggtsggggacgattacattgacaaccatcggctatggtgacaagacaccgcacacatggctgggcagggtcctggctgctggcttcgccttactgggcatctct

SEQ ID NO: 7949 - DNA, 201 bp, Homo sapiens
gtgctcatcttcgcctccttcctggtctacctggctgagaaggacgccaactccgacttctcctcctacgccgactcgctctggtgggggacgattacatygacaaccatcggctatggtgacaagacaccgcacacatggctgggcagggtcctggctgctggcttcgccttactgggcatctctttctttgccctgcct

SEQ ID NO: 7950 - DNA, 201 bp, Homo sapiens
cgcctccttcctggtctacctggctgagaaggacgccaactccgacttctcctcctacgccgactcgctctggtgggggacgattacattgacaaccatcdgctatggtgacaagacaccgcacacatggctgggcagggtcctggctgctggcttcgccttactgggcatctctttctttgccctgcctgccggcatcct

SEQ ID NO: 7951 - DNA, 201 bp, Homo sapiens
tgacaagacaccgcacacatggctgggcagggtcctggctgctggcttcgccttactgggcatctctttctttgccctgcctgccggcatcctaggctccrgctttgccctgaaggtccaggagcagcaccggcagaagcacttcgagaagcggaggatgccggcagccaacctcatccaggctgcctggcgcctgtactc

SEQ ID NO: 7952 - DNA, 201 bp, Homo sapiens
tgagctcacggtggacgacatcatgcctgctgtgaagacagtcatccgctccatcaggattctcaagttcctggtggccaaaaggaaattcaaggagacaytgcgaccgtacgacgtgaaggacgtcattgagcagtactcagcaggccacctggacatgctgggccggatcaagagcctgcaaactcgggtggaccaaat

SEQ ID NO: 7953 - DNA, 201 bp, Homo sapiens
gcagcacctccttctgccctggggaaagcagccggatgggcatcaaagaccgcatccgcatgggcagctcccagcggcggacgggtccttccaagcagcakctggcacctccaacaatgcccacctccccaagcagcgagcaggtgggtgaggccaccagccccaccaaggtgcaaaagagctggagcttcaatgaccgca

SEQ ID NO: 7954 - DNA, 201 bp, Homo sapiens
ggtgctcatcttcgcctccttcctggtctacctggctgagaaggacgccaactccgacttctcctcctacgccgactcgctctggtgggggacgattacaytgacaaccatcggctatggtgacaagacaccgcacacatggctgggcagggtcctggctgctggcttcgccttactgggcatctctttctttgccctgcc

SEQ ID NO: 7955 - DNA, 201 bp, Homo sapiens
cctgagtgggcgtggtacctgctgtgggtgccagcgccccttccccacctcaggagcgtgagatgccaggtcgcacagagggcagcagcagcggccgtccygcggcctctgggccccccagtgccctgcccactccatcaaggccctatgtggcccacctggcaggggcacagccccgggagtgggagcgggcgctggggc

SEQ ID NO: 7956 - DNA, 201 bp, Homo sapiens
cggtggacgacatcatgcctgctgtgaagacagtcatccgctccatcaggattctcaagttcctggtggccaaaaggaaattcaaggagacactgcgaccrtacgacgtgaaggacgtcattgagcagtactcagcaggccacctggacatgctgggccggatcaagagcctgcaaactcgggtggaccaaattgtgggtc

SEQ ID NO: 7957 - DNA, 201 bp, Homo sapiens
atgcaatgacgtgacacacttggagacatgagtgcagagccactcagccgctcctgggcctctgcagcagatgccagtggactggccttgcagggtgacgwccactaagaggaagacccccaactccatctgagcaggagaaggagctttgaagtaacccgagagctctccaggccccacccagacctttacccgctcccc

SEQ ID NO: 7958 - DNA, 139 bp, Homo sapiens
atgccaggtcgcacagagggcagcagcagcggccgtccygcggcctctgggccccccagtgccctgcccactccatcaaggccctatgtggcccacctggcaggggcacagccccgggagtgggagcgggcgctggggc

SEQ ID NO: 7959 - DNA, 201 bp, Homo sapiens
tatactttctaatactattacctaatactagagagccagagacaccgtaaataaccttgttatcttatatttatgtatttaaaagatggttcataaatgtytttagtgcttaccatgaaagacaatttttacccccatctccaaaaagaagtagaactgattcagctcacagaaggctgttaaaggcgccagagaaatatg

SEQ ID NO: 7960 - DNA, 201 bp, Homo sapiens
ggcttgagggagagggggtgaggcagggggagcttggagccgtcattctctaaccctaagagctgtggacacaaagccgagcccaacctggctgctgcccyggcgggcaaggagagggcaccgaatgcactctccccagagcctcgcactgccaccagttgaggcctgcgcccctctcttccccgcacaccatagcctctt

SEQ ID NO: 7961 - DNA, 201 bp, Homo sapiens
catccttactgcccccaattggggcttccagaagcagtgtgggcaagcgctgccagccttctgcagaatgatgagcactggtcagtcctgtgctgataaakactgtgtgtcacccacgtcttggtttctccaacagcaggtaacaacctcatcttcccaaagagatagatagctacgcctgacctatttttcagggctctt

SEQ ID NO: 7962 - DNA, 201 bp, Homo sapiens
gcttggagccgtcattctctaaccctaagagctgtggacacaaagccgagcccaacctggctgctgcccgggcgggcaaggagagggcaccgaatgcactstccccagagcctcgcactgccaccagttgaggcctgcgcccctctcttccccgcacaccatagcctcttttcttgagtgctctacccaaactactgcctc

SEQ ID NO: 7963 - DNA, 201 bp, Homo sapiens
gtgaggcagggggagcttggagccgtcattctctaaccctaagagctgtggacacaaagccgagcccaacctggctgctgcccgggcgggcaaggagaggrcaccgaatgcactctccccagagcctcgcactgccaccagttgaggcctgcgcccctctcttccccgcacaccatagcctcttttcttgagtgctctacc

SEQ ID NO: 7964 - DNA, 201 bp, Homo sapiens
agctcacagaaggctgttaaaggcgccagagaaatatgtgatgcagtggcttaaagagactgccaggaagagtggggaaagttgctgcactcaagtcaatrtgggaaatttcatgcagaacagccacccaatagcaaggcctctaggtaagtagggagaacgcctctggtcatgttcaggtgtttcgtctgtcaaggtgct

SEQ ID NO: 7965 - DNA, 201 bp, Homo sapiens
tgcactggtgcaggtgactgtccacagggacaccctggcctccctcccctggcgcctgcagacggccctggaggagcacctaatcctcaaggagctggcascccgtgggaaggacctgctattgagtgaggcccaagggcccttcagccacagagagcagatcgtgggcaaggaccagctcttccagggtgccttcctggg

SEQ ID NO: 7966 - DNA, 115 bp, Homo sapiens
tctggccgtccctgygccaagcctccaagttccctgagagctaccggccaggggtcgggaggctatgggagctcagggcaggcacctcccatgctcccgcgggagccaccaggac

SEQ ID NO: 7967 - DNA, 201 bp, Homo sapiens
cagaccctgggagaagcagccagcagtgaggaatcctggaaccccttcccagggagagccttcccatgacccccatgaagagatcagtgcaaacacaggtrtcagagcccttcatggagtcctggggtgaggagtccctgccggagctacccgcagagcagtccctgacggagtactctgacctcgaggaggctccctcgg

SEQ ID NO: 7968 - DNA, 201 bp, Homo sapiens
gcacctcccatgctcccgcgggagccaccaggacatgaagatcccgtcttcccacaggccctgtgtcttgctcagtccacgtgactctgctttctcatccyaggcctcaggagccgggacactccctgagtcctctgggagcccttaagccacactgagaacacagaccctgggagaagcagccagcagtgaggaatcctg

SEQ ID NO: 7969 - DNA, 201 bp, Homo sapiens
ttgaagtggtgaggcggccgcggaaggcctatgcactggtgcaggtgactgtccacagggacaccctggcctccctcccctggcgcctgcagacggccctygaggagcacctaatcctcaaggagctggcagcccgtgggaaggacctgctattgagtgaggcccaagggcccttcagccacagagagcagatcgtgggca

SEQ ID NO: 7970 - DNA, 201 bp, Homo sapiens
gcctgcagacggccctggaggagcacctaatcctcaaggagctggcagcccgtgggaaggacctgctattgagtgaggcccaagggcccttcagccacagmgagcagatcgtgggcaaggaccagctcttccagggtgccttcctgggcagcgagacccgcaatatggagttcaagcggggtagcggcgagtacctcagcc

SEQ ID NO: 7971 - DNA, 120 bp, Homo sapiens
tctggccgtccctgtgccamgcctccaagttccctgagagctaccggccaggggtcgggaggctatgggagctcagggcaggcacctcccatgctcccgcgggagccaccaggacatgaa

SEQ ID NO: 7972 - DNA, 201 bp, Homo sapiens
tcccctagggctaagctataagggattgtccttctccctaaaatgctcatttggcccaggctgaggtctgtgactccagttggctacacagtgccagaaasgaatctgtcatctcaggaaagcccctcaaagatggcgaggcatatttgatgactgtggttacagggcaagaggccaccctgcagcccccacccctgactt

SEQ ID NO: 7973 - DNA, 167 bp, Homo sapiens
tctggccgtccctgtgccaagcctccaagttccctgagagctaccggccaggggtcgggaggctatsggagctcagggcaggcacctcccatgctcccgcgggagccaccaggacatgaagatcccgtcttcccacaggccctgtgtcttgctcagtccacgtgact

SEQ ID NO: 7974 - DNA, 187 bp, Homo sapiens
tctggccgtccctgtgccaagcctccaagttccctgagagctaccggccaggggtcgggaggctatgggagctcagggcaggcaccmcccatgctcccgcgggagccaccaggacatgaagatcccgtcttcccacaggccctgtgtcttgctcagtccacgtgactctgctttctcatcctaggcc

SEQ ID NO: 7975 - DNA, 201 bp, Homo sapiens
ccgcggaaggcctatgcactggtgcaggtgactgtccacagggacaccctggcctccctcccctggcgcctgcagacggccctggaggagcacctaatccrcaaggagctggcagcccgtgggaaggacctgctattgagtgaggcccaagggcccttcagccacagagagcagatcgtgggcaaggaccagctcttccag

SEQ ID NO: 7976 - DNA, 147 bp, Homo sapiens
aagccagcctgcccccatcctgtgcctgccttggtttcctttggaggacctggttgagttccaaaccagtttgaaactttgaagccttgctgcgtagaacrcacacaggaacccgggggcttggatttgaaaccctttccacttctg

SEQ ID NO: 7977 - DNA, 201 bp, Homo sapiens
acaaccagctttcagagtagcctcatcagtgcccttgcagtctgactgtgtacacttggttcagctaatgtctgagagtcctgcactgggttactttatamtagtgaggacgttaaccagccatattggctcaataaatagcttcggtaaggagttaatttccttctagaaatcagtgcctatttttcctggaaactcaat

SEQ ID NO: 7978 - DNA, 201 bp, Homo sapiens
ctgaagcgaggggtgagattctaacattttcagagaaccttttggaaagaacaagcctacttcaataaatgaaggagaataaagaaaattcaagcccttcrgtaacttcagcaaacctggaccacacaaagccatgttggtactgggataagaaagacttggctcatacaccctcacaacttgaaggacttgatccagcca

SEQ ID NO: 7979 - DNA, 201 bp, Homo sapiens
ttggagatgacccaaaggaggaagtaatggttctggagagaatcttactgcagaccatcaagtttgatttacaggtagaacatccataccagttcctactwaaatatgcaaagcaactcaaaggtgataaaaacaaaattcaaaagttggttcaaatggcatggacatttgtaaatgacagtctctgcaccaccttgtcac

SEQ ID NO: 7980 - DNA, 147 bp, Homo sapiens; identical to SEQ ID NO: 7976

SEQ ID NO: 7981 - DNA, 201 bp, Homo sapiens; identical to SEQ ID NO: 7977

SEQ ID NO: 7982 - DNA, 201 bp, Homo sapiens
cctccgctaacctccggattctaacattttcagagaaccttttggaaagaacaagcctacttcaataaatgaaggagaataaagaaaattcaagcccttcrgtaacttcagcaaacctggaccacacaaagccatgttggtactgggataagaaagacttggctcatacaccctcacaacttgaaggacttgatccagcca

SEQ ID NO: 7983 - DNA, 201 bp, Homo sapiens; identical to SEQ ID NO: 7979

SEQ ID NO: 7984 - DNA, 147 bp, Homo sapiens; identical to SEQ ID NO: 7976

SEQ ID NO: 7985 - DNA, 201 bp, Homo sapiens; identical to SEQ ID NO: 7977

SEQ ID NO: 7986 - DNA, 201 bp, Homo sapiens; identical to SEQ ID NO: 7982

SEQ ID NO: 7987 - DNA, 201 bp, Homo sapiens; identical to SEQ ID NO: 7979

SEQ ID NO: 7988 - DNA, 147 bp, Homo sapiens; identical to SEQ ID NO: 7976

SEQ ID NO: 7989 - DNA, 201 bp, Homo sapiens; identical to SEQ ID NO: 7977

SEQ ID NO: 7990 - DNA, 201 bp, Homo sapiens; identical to SEQ ID NO: 7982

SEQ ID NO: 7991 - DNA, 201 bp, Homo sapiens; identical to SEQ ID NO: 7979

SEQ ID NO: 7992 - DNA, 201 bp, Homo sapiens
atgtaaaaatgaaagcactgtcttggatcttagtagcattgactcttcaagaaaaaataaacagagtgtttcagccacagaaaaaaagaacacaatagacrtcctatccagtagaagcagacagcttcttcgagaagataaaaaagtaaacaatggaagcaatgtggaaaatgacattcagcaacgcagcaaattcttgga

SEQ ID NO: 7993 - DNA, 201 bp, Homo sapiens
cacagccctaaaatacatggtttcaaatccaaatgaaaactccttgaactctaatccagtttgtgatttagactcaacaagtgcagggcaaatccatttgrtatcagatagggagaaccaagtagggagaaaagatacaaacaaacaatcaagtattaaatgtgtggaagatgtttcactgtgtaatcctgaaaggacaaa

SEQ ID NO: 7994 - DNA, 201 bp, Homo sapiens
aaacagaaaatgcctcctggacaggttatatcaaaaactcagccttcctcccaaagacctttaaaacatgaaacatctactgtccaaaaaagtatgtttcrtgatgtgcgtgataataacaacaaggacagtgtttctgaacagaagcctcacaaacctctcattaatcttgcatctgaaataagtgatgcagaagcactc

SEQ ID NO: 7995 - DNA, 201 bp, Homo sapiens
aacaagcacctaagagaaaaatggtcaagcaagtacacacagctttgcctaaggttaatgcaaaaatagtggcaatgcctaaaaatctaaatcagtcaaaraaaggtgaaactttgaataataaagattcaaaacagaaaatgcctcctggacaggttatatcaaaaactcagccttcctcccaaagacctttaaaacatg

SEQ ID NO: 7996 - DNA, 201 bp, Homo sapiens
aaagtttaaaaggtcagttttactttcagtcgatgaatgtgaagagctgggatcagatgaaggagaagtccatactccctttcaggcttctgtagattctktttcaccttctgatgtttttgatggcatttctcatgaacatcatggaaggacctgctattccagattctcacgagaaagtgaagataatattttagaatg

SEQ ID NO: 7997 - DNA, 201 bp, Homo sapiens
ctccaatatatgagatggatgtaatagaagcatttgagcagaaagtggaatcagaaacacatgttacagatatggattttgaagatgaccaacattttgcraaacaagattggacactactaaagcaactgctctctgaacaggattcaaacttagatgttacaaattccgttcctgaagacttaagtttagcacagtatc

SEQ ID NO: 7998 - DNA, 201 bp, Homo sapiens
ttaatcttgcatctgaaataagtgatgcagaagcactccagtcatcctgcaggcctgacccacaaaagccattaaacgatcaagaaaaagagaagttggcrttagaatgccaaaatatttcaaagctggataaatcattaaaacacgaactggaatcaaaacagatttgtttagataaaagtgaaacaaaatttcccaatc

SEQ ID NO: 7999 - DNA, 201 bp, Homo sapiens
gaatctgctatggatgaagacaaacatgctacagcagactcagatgtatcttccaagtgtttttcgggacagctatcagaaaaaaattctcctaaaaatayggaaacatcagaatctccagagagccatgaaactccagaaactccatttgtgggtcactggaatttgagtactggtgttctgcatcagcgagagagtcct

SEQ ID NO: 8000 - DNA, 201 bp, Homo sapiens
atgaaaaacagtgtagatagtgtcaaaaattccactgtagccataaaatctcgacctgtttcaagagttaccaatggaacttccaataaaaaaagtattcrtgaacaagacactaatgtaaataacagtgtactaaagaaagtcagtggcaaaggatgtagtgagccagtaccacaggcaattttgaagaaaagaggaact

SEQ ID NO: 8001 - DNA, 201 bp, Homo sapiens
gattttcttggaagaagtagcagtgataccagtactcctgaagaattaaaaatttatgatagtaatttaagaattgaagtaaaaatgaaaaagcaaagtartaatgatcttttccaagttaattcaacgagtgatgatgaaatccctaggaaaaggccagaaatttggtctcgatctgcaatagttcactctagggaaaga

SEQ ID NO: 8002 - DNA, 201 bp, Homo sapiens
ggctagtttttcctctgaagattgttcgcctcaaggcgagtggacaattctggaactggaaactcagcattaagtgttaacattttggaaaaatttatgcyactcctttattttttgatgcctatattatatccaaatgataattgcattagccggatataaactttctttaatattgagtctttccaatttaatgaggta

SEQ ID NO: 8003 - DNA, 201 bp, Homo sapiens
aatttctctatatctaacccagctcctcagcagtttcagggaataattaatttagcttttgaagatgcaactgaaaatgaatgtcgtgaattttctgcaamtaaaaagtttaaaaggtcagttttactttcagtcgatgaatgtgaagagctgggatcagatgaaggagaagtccatactccctttcaggcttctgtagat

SEQ ID NO: 8004 - DNA, 201 bp, Homo sapiens
ttgcgatgcagctaacatatgttgtcattctgttgggagtgataatgtaaattcaaaattttatagcaccacagccctaaaatacatggtttcaaatccawatgaaaactccttgaactctaatccagtttgtgatttagactcaacaagtgcagggcaaatccatttgatatcagatagggagaaccaagtagggagaaa

SEQ ID NO: 8005 - DNA, 201 bp, Homo sapiens
tgaatctcttaaaatcagtgcacaacggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggacca

SEQ ID NO: 8006 - DNA, 201 bp, Homo sapiens
caacattgccgagaaagcttgctgtggggttccctgcaagtgctctgggcagaggggagaccgcgggcccatcggcagcatcgggccaaagggtattcctrgagaagacggctaccgaggctatcctggtgatgagggtggacccggtgagcgtggtccgcctggtgtgaacggcactcaaggtttccagggctgcccggg

SEQ ID NO: 8007 - DNA, 201 bp, Homo sapiens
acggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgt

SEQ ID NO: 8008 - DNA, 201 bp, Homo sapiens
gacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccg

SEQ ID NO: 8009 - DNA, 201 bp, Homo sapiens
agagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacc

SEQ ID NO: 8010 - DNA, 201 bp, Homo sapiens
agacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtccc

SEQ ID NO: 8011 - DNA, 201 bp, Homo sapiens
ccgcattgaagagggcgtcccgcagttcctggtcctcatctcgtctggaaagtctgacgatgaggtggacgacccggcggtggagctcaagcagtttggcrtggcccctttcacgatcgccaggaacgcagaccaggaggagctggtgaagatctcgctgagccccgaatatgtgttctcggtgagcaccttccgggagct

SEQ ID NO: 8012 - DNA, 201 bp, Homo sapiens
gaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattccctggatacc

SEQ ID NO: 8013 - DNA, 201 bp, Homo sapiens
tgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcgtggcccctttcacga

SEQ ID NO: 8014 - DNA, 201 bp, Homo sapiens
cagctgagttccgagccgccccattgcaaggcatgctgcctggcttgctggcacctctcaggaccctctctggaacccctgaagttcactcaaacaaaagrgatatcatctttcttttggatggatcagccaacgttggaaaaaccaatttcccttatgtgcgcgactttgtaatgaacctagttaacagccttgatattg

SEQ ID NO: 8015 - DNA, 201 bp, Homo sapiens
ctgaggaacatcctggtcagctctgcgggaagcaggataacagaaggtgtgccccagctgctgatcgtcctcacggccgacaggtctggggatgatgtgcrgaacccctccgtggtcgtgaagaggggtggggctgtgcccattggcattggcatcgggaacgctgacatcacagagatgcagaccatctccttcatcccg

SEQ ID NO: 8016 - DNA, 201 bp, Homo sapiens
ccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggcctgagccccccggtccttatttttatga

SEQ ID NO: 8017 - DNA, 201 bp, Homo sapiens
ggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctg

SEQ ID NO: 8018 - DNA, 201 bp, Homo sapiens
agaggcctgagccccccggtccttatttttatgacctcaccgtcacctcagcccatgatcagtccctggttctgaagcagaacctcacggtcacggaccgygtcattggaggcctgctcgctgggcagacataccatgtggctgtggtctgctacctgaggtctcaggtcagagccacctaccacggaagtttcagtacaa

SEQ ID NO: 8019 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaagttcactcaaacaaaagggatatcatctttcttttggatggatcagccaacgttggaaaaaccaatttcccttatgtg

SEQ ID NO: 8020 - DNA, 201 bp, Homo sapiens
agatgaaatcagccagcctgcccaggagctgaagagaagcagcataatggcctttgccattgggaacaagggtgccgatcaggctgagctggaagagatckctttcgactcctccctggtgttcatcccagctgagttccgagccgccccattgcaaggcatgctgcctggcttgctggcacctctcaggaccctctctgg

SEQ ID NO: 8021 - DNA, 201 bp, Homo sapiens
tgctgatcacaggtggtaagtccctagatgaaatcagccagcctgcccaggagctgaagagaagcagcataatggcctttgccattgggaacaagggtgcygatcaggctgagctggaagagatcgctttcgactcctccctggtgttcatcccagctgagttccgagccgccccattgcaaggcatgctgcctggcttgc

SEQ ID NO: 8022 - DNA, 201 bp, Homo sapiens
ggttccatcaacttcaggagggacagtttccaggaagtgcttcgttttgtgtctgaaatagtggacacagtttatgaagatggcgactccatccaagtggrgcttgtccagtacaactctgaccccactgacgaattcttcctgaaggacttctctaccaagaggcagattattgacgccatcaacaaagtggtctacaaa

SEQ ID NO: 8023 - DNA, 201 bp, Homo sapiens
actgggagaggcctgagccccccggtccttatttttatgacctcaccgtcacctcagcccatgatcagtccctggttctgaagcagaacctcacggtcacrgaccgcgtcattggaggcctgctcgctgggcagacataccatgtggctgtggtctgctacctgaggtctcaggtcagagccacctaccacggaagtttca

SEQ ID NO: 8024 - DNA, 201 bp, Homo sapiens
ggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggt

SEQ ID NO: 8025 - DNA, 201 bp, Homo sapiens
cagaacctcacggtcacggaccgcgtcattggaggcctgctcgctgggcagacataccatgtggctgtggtctgctacctgaggtctcaggtcagagccayctaccacggaagtttcagtacaaagaaatctcagcccccacctccacagccagcaaggtcagcttctagttcaaccatcaatctaatggtgagcacagaa

SEQ ID NO: 8026 - DNA, 201 bp, Homo sapiens
cagccatctgtgaagccagccgctgcaaagccggcccctgcgaaacctgtggctgccaagcctgtggccacaaagacggccactgttagacccccagtggyggtgaagccagcaacggcagcgaagcctgtagcagcaaagccagcagctgtaagaccccccgctgctgctgctgcaaaaccagtggcgaccaagcctgag

SEQ ID NO: 8027 - DNA, 201 bp, Homo sapiens
ttaagcgtgtgaggaacggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgc

SEQ ID NO: 8028 - DNA, 201 bp, Homo sapiens
agtggacaagtccaccgagctcaacgaggagcctttgatgcgcttcgggaggctgttgccatccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttc

SEQ ID NO: 8029 - DNA, 201 bp, Homo sapiens
acaagattaagaaccttcaggtggctctgacatccaaacagcagagtctggagactgccatgtcgtttgtggccaggaacacatttaagcgtgtgaggaayggattcctaatgaggaaagtggctgttttcttcagcaacacacccacaagagcatccccacagctcagagaggctgtgctcaagctctcagatgcgggga

SEQ ID NO: 8030 - DNA, 201 bp, Homo sapiens
agcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcaacgaggagcctttgatgcgcttcgggaggctgt

SEQ ID NO: 8031 - DNA, 201 bp, Homo sapiens
atgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtg

SEQ ID NO: 8032 - DNA, 201 bp, Homo sapiens
acaccttcgccagtgagccaaacgacgtcttcttcaaattagtggacaagtccaccgagctcaacgaggagcctttgatgcgcttcgggaggctgttgccrtccttcgtcagcagtgaaaatgctttttacttgtccccagatatcaggaaacagtgtgattggttccaaggggaccaacccacaaagaaccttgtgaagt

SEQ ID NO: 8033 - DNA, 201 bp, Homo sapiens
gaggaatcgggaaccggggccctcgtggggagacgggagatgacgggagagacggagttggcagtgaaggacgcagaggcaaaaaaggagaaagaggattycctggatacccaggaccaaagggtaacccaggtgaacctgggctaaatggaacaacaggacccaaaggcatcagaggccgaaggggaaattcgggacctc

SEQ ID NO: 8034 - DNA, 201 bp, Homo sapiens
tcacggtcacggaccgcgtcattggaggcctgctcgctgggcagacataccatgtggctgtggtctgctacctgaggtctcaggtcagagccacctaccayggaagtttcagtacaaagaaatctcagcccccacctccacagccagcaaggtcagcttctagttcaaccatcaatctaatggtgagcacagaaccattgg

SEQ ID NO: 8035 - DNA, 201 bp, Homo sapiens
ggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtgga

SEQ ID NO: 8036 - DNA, 201 bp, Homo sapiens
caggcagccaaaccagctgccaccaagccagccaccactaagcccatggttaagatgtcccgtgaagtccaggtgtttgagataacagagaacagcgccaractccactgggagaggcctgagccccccggtccttatttttatgacctcaccgtcacctcagcccatgatcagtccctggttctgaagcagaacctcacg

SEQ ID NO: 8037 - DNA, 201 bp, Homo sapiens
gccgctgcaaagccggcccctgcgaaacctgtggctgccaagcctgtggccacaaagacggccactgttagacccccagtggcggtgaagccagcaacggyagcgaagcctgtagcagcaaagccagcagctgtaagaccccccgctgctgctgctgcaaaaccagtggcgaccaagcctgaggtccctaggccacaggca

SEQ ID NO: 8038 - DNA, 201 bp, Homo sapiens
gagcggcagggagcgatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggaca

SEQ ID NO: 8039 - DNA, 201 bp, Homo sapiens
gccaaccattgtcacacaagtcattgaagtcaacaagagagacatagtcttcctggtggatggctcatctgcactgggactggccaacttcaatgccatcygagacttcattgctaaagtcatccagaggctggaaatcggacaggatcttatccaggtggcagtggcccagtatgcagacactgtgaggcctgaatttta

SEQ ID NO: 8040 - DNA, 201 bp, Homo sapiens
aaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttc

SEQ ID NO: 8041 - DNA, 201 bp, Homo sapiens
caaaaaaggagaaagaggattccctggatacccaggaccaaagggtaacccaggtgaacctgggctaaatggaacaacaggacccaaaggcatcagaggcygaaggggaaattcgggacctccagggatagttggacagaagggagaccctggctacccaggaccagctggtcccaagggcaacaggggcgactccatcga

SEQ ID NO: 8042 - DNA, 201 bp, Homo sapiens
cagccgctgcaaagccggcccctgcgaaacctgtggctgccaagcctgtggccacaaagacggccactgttagacccccagtggcggtgaagccagcaacrgcagcgaagcctgtagcagcaaagccagcagctgtaagaccccccgctgctgctgctgcaaaaccagtggcgaccaagcctgaggtccctaggccacagg

SEQ ID NO: 8043 - DNA, 201 bp, Homo sapiens
cctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtc

SEQ ID NO: 8044 - DNA, 201 bp, Homo sapiens
tcccgcagttcctggtcctcatctcgtctggaaagtctgacgatgaggtggacgacccggcggtggagctcaagcagtttggcgtggcccctttcacgatygccaggaacgcagaccaggaggagctggtgaagatctcgctgagccccgaatatgtgttctcggtgagcaccttccgggagctgcccagcctggagcaga

SEQ ID NO: 8045 - DNA, 201 bp, Homo sapiens
tggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggag

SEQ ID NO: 8046 - DNA, 201 bp, Homo sapiens
acaccggggccgccctggagtttgtcctgaggaacatcctggtcagctctgcgggaagcaggataacagaaggtgtgccccagctgctgatcgtcctcacrgccgacaggtctggggatgatgtgcggaacccctccgtggtcgtgaagaggggtggggctgtgcccattggcattggcatcgggaacgctgacatcacag

SEQ ID NO: 8047 - DNA, 201 bp, Homo sapiens
tgccaccaagccagccaccactaagcccatggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacggaccgcgtcat

SEQ ID NO: 8048 - DNA, 201 bp, Homo sapiens
agatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggcttccctctgttgaaagagtttgtcc

SEQ ID NO: 8049 - DNA, 201 bp, Homo sapiens
ttggatggatcagccaacgttggaaaaaccaatttcccttatgtgcgcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcag

SEQ ID NO: 8050 - DNA, 201 bp, Homo sapiens
aaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggag

SEQ ID NO: 8051 - DNA, 201 bp, Homo sapiens
gatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcgg

SEQ ID NO: 8052 - DNA, 201 bp, Homo sapiens
attcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaa

SEQ ID NO: 8053 - DNA, 201 bp, Homo sapiens
gagatgacgggagagacggagttggcagtgaaggacgcagaggcaaaaaaggagaaagaggattccctggatacccaggaccaaagggtaacccaggtgarcctgggctaaatggaacaacaggacccaaaggcatcagaggccgaaggggaaattcgggacctccagggatagttggacagaagggagaccctggctacc

SEQ ID NO: 8054 - DNA, 201 bp, Homo sapiens
ttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttgtgtgtgctggagggaggggatttaattttaattttaaaatg

SEQ ID NO: 8055 - DNA, 201 bp, Homo sapiens
ctgggcattggcaggaaggtgaacatcaaggaggtatacaccttcgccagtgagccaaacgacgtcttcttcaaattagtggacaagtccaccgagctcamcgaggagcctttgatgcgcttcgggaggctgttgccatccttcgtcagcagtgaaaatgctttttacttgtccccagatatcaggaaacagtgtgattgg

SEQ ID NO: 8056 - DNA, 201 bp, Homo sapiens
ttctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatt

SEQ ID NO: 8057 - DNA, 201 bp, Homo sapiens
ctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccgg

SEQ ID NO: 8058 - DNA, 201 bp, Homo sapiens
accctctctggaacccctgaagttcactcaaacaaaagggatatcatctttcttttggatggatcagccaacgttggaaaaaccaatttcccttatgtgcrcgactttgtaatgaacctagttaacagccttgatattggaaatgacaatattcgtgttggtttagtgcaatttagtgacactcctgtaacggagttctct

SEQ ID NO: 8059 - DNA, 201 bp, Homo sapiens
ctatgtgcaccgttgggaccaatgccttaattaaagaatttaaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgt

SEQ ID NO: 8060 - DNA, 201 bp, Homo sapiens
tcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcatacctggtcagac

SEQ ID NO: 8061 - DNA, 201 bp, Homo sapiens
tcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatg

SEQ ID NO: 8062 - DNA, 201 bp, Homo sapiens
tttagatgggaagcctgtgtatcgtggagaaacaagagaccaactttttcattccctgcccccaatttcccagactagatttcaagctaattttctttttytgaagcctctaacaaatgatctagttcagaaggaagcaaaatcccttaatctatgtgcaccgttgggaccaatgccttaattaaagaatttaaaaaagtt

SEQ ID NO: 8063 - DNA, 201 bp, Homo sapiens
ggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctgg

SEQ ID NO: 8064 - DNA, 201 bp, Homo sapiens
tggacaagattaagaaccttcaggtggctctgacatccaaacagcagagtctggagactgccatgtcgtttgtggccaggaacacatttaagcgtgtgagraacggattcctaatgaggaaagtggctgttttcttcagcaacacacccacaagagcatccccacagctcagagaggctgtgctcaagctctcagatgcgg

SEQ ID NO: 8065 - DNA, 201 bp, Homo sapiens
acacagtttatgaagatggcgactccatccaagtggggcttgtccagtacaactctgaccccactgacgaattcttcctgaaggacttctctaccaagagrcagattattgacgccatcaacaaagtggtctacaaagggggaagacacgccaacactaaggtgggccttgagcacctgcgggtaaaccactttgtgcctg

SEQ ID NO: 8066 - DNA, 201 bp, Homo sapiens
cagtttccaggaagtgcttcgttttgtgtctgaaatagtggacacagtttatgaagatggcgactccatccaagtggggcttgtccagtacaactctgacyccactgacgaattcttcctgaaggacttctctaccaagaggcagattattgacgccatcaacaaagtggtctacaaagggggaagacacgccaacactaa

SEQ ID NO: 8067 - DNA, 201 bp, Homo sapiens
acaaagcctgtgactattataaatcagccatctgtgaagccagccgctgcaaagccggcccctgcgaaacctgtggctgccaagcctgtggccacaaagayggccactgttagacccccagtggcggtgaagccagcaacggcagcgaagcctgtagcagcaaagccagcagctgtaagaccccccgctgctgctgctgca

SEQ ID NO: 8068 - DNA, 201 bp, Homo sapiens
tgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctgg

SEQ ID NO: 8069 - DNA, 201 bp, Homo sapiens; identical to SEQ ID NO: 8006

SEQ ID NO: 8070 - DNA, 201 bp, Homo sapiens; identical to SEQ ID NO: 8007

SEQ ID NO: 8071 - DNA, 201 bp, Homo sapiens; identical to SEQ ID NO: 8008

SEQ ID NO: 8072 - DNA, 201 bp, Homo sapiens; identical to SEQ ID NO: 8009

SEQ ID NO: 8073 - DNA, 201 bp, Homo sapiens; identical to SEQ ID NO: 8010

SEQ ID NO: 8074 - DNA, 201 bp, Homo sapiens; identical to SEQ ID NO: 8014

SEQ ID NO: 8075 - DNA, 201 bp, Homo sapiens; identical to SEQ ID NO: 8016

SEQ ID NO: 8076 - DNA, 201 bp, Homo sapiens; identical to SEQ ID NO: 8017

SEQ ID NO: 8077 - DNA, 201 bp, Homo sapiens; identical to SEQ ID NO: 8019

SEQ ID NO: 8078 - DNA, 201 bp, Homo sapiens; identical to SEQ ID NO: 8020

SEQ ID NO: 8079 - DNA, 201 bp, Homo sapiens; identical to SEQ ID NO: 8021

SEQ ID NO: 8080 - DNA, 201 bp, Homo sapiens; identical to SEQ ID NO: 8024

SEQ ID NO: 8081 - DNA, 201 bp, Homo sapiens; identical to SEQ ID NO: 8025

SEQ ID NO: 8082 - DNA, 201 bp, Homo sapiens
ggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagcacaagactctgctgacattattttccttattgatggatcaaa

SEQ ID NO: 8083 - DNA, 201 bp, Homo sapiens; identical to SEQ ID NO: 8037

SEQ ID NO: 8084 - DNA, 201 bp, Homo sapiens
tgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggcccca

SEQ ID NO: 8085 - DNA, 201 bp, Homo sapiens; identical to SEQ ID NO: 8040

SEQ ID NO: 8086 - DNA, 201 bp, Homo sapiens; identical to SEQ ID NO: 8042

SEQ ID NO: 8087 - DNA, 201 bp, Homo sapiens
cacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatc

SEQ ID NO: 8088 - DNA, 201 bp, Homo sapiens; identical to SEQ ID NO: 8043

SEQ ID NO: 8089 - DNA, 201 bp, Homo sapiens; identical to SEQ ID NO: 8044

SEQ ID NO: 8090 - DNA, 201 bp, Homo sapiens; identical to SEQ ID NO: 8047

SEQ ID NO: 8091 - DNA, 201 bp, Homo sapiens; identical to SEQ ID NO: 8050

SEQ ID NO: 8092 - DNA, 201 bp, Homo sapiens; identical to SEQ ID NO: 8052

SEQ ID NO: 8093 - DNA, 201 bp, Homo sapiens; identical to SEQ ID NO: 8053

SEQ ID NO: 8094 - DNA, 201 bp, Homo sapiens; identical to SEQ ID NO: 8054

SEQ ID NO: 8095 - DNA, 201 bp, Homo sapiens; identical to SEQ ID NO: 8056

SEQ ID NO: 8096 - DNA, 201 bp, Homo sapiens; identical to SEQ ID NO: 8061

SEQ ID NO: 8097 - DNA, 201 bp, Homo sapiens; identical to SEQ ID NO: 8062

SEQ ID NO: 8098 - DNA, 201 bp, Homo sapiens; identical to SEQ ID NO: 8005

SEQ ID NO: 8099 - DNA, 201 bp, Homo sapiens; identical to SEQ ID NO: 8012

SEQ ID NO: 8100 - DNA, 201 bp, Homo sapiens; identical to SEQ ID NO: 8011

SEQ ID NO: 8101 - DNA, 201 bp, Homo sapiens; identical to SEQ ID NO: 8013

SEQ ID NO: 8102 - DNA, 201 bp, Homo sapiens; identical to SEQ ID NO: 8015

SEQ ID NO: 8103 - DNA, 201 bp, Homo sapiens; identical to SEQ ID NO: 8018

SEQ ID NO: 8104 - DNA, 201 bp, Homo sapiens; identical to SEQ ID NO: 8023

SEQ ID NO: 8105 - DNA, 201 bp, Homo sapiens; identical to SEQ ID NO: 8022

SEQ ID NO: 8106 - DNA, 201 bp, Homo sapiens; identical to SEQ ID NO: 8026

SEQ ID NO: 8107 - DNA, 201 bp, Homo sapiens; identical to SEQ ID NO: 8028

SEQ ID NO: 8108 - DNA, 201 bp, Homo sapiens; identical to SEQ ID NO: 8027

SEQ ID NO: 8109 - DNA, 201 bp, Homo sapiens; identical to SEQ ID NO: 8030

SEQ ID NO: 8110 - DNA, 201 bp, Homo sapiens; identical to SEQ ID NO: 8029

SEQ ID NO: 8111 - DNA, 201 bp, Homo sapiens; identical to SEQ ID NO: 8032

SEQ ID NO: 8112 - DNA, 201 bp, Homo sapiens; identical to SEQ ID NO: 8031

SEQ ID NO: 8113 - DNA, 201 bp, Homo sapiens; identical to SEQ ID NO: 8033

SEQ ID NO: 8114 - DNA, 201 bp, Homo sapiens; identical to SEQ ID NO: 8034

SEQ ID NO: 8115 - DNA, 201 bp, Homo sapiens; identical to SEQ ID NO: 8036

SEQ ID NO: 8116 - DNA, 201 bp, Homo sapiens; identical to SEQ ID NO: 8038

SEQ ID NO: 8117 - DNA, 201 bp, Homo sapiens; identical to SEQ ID NO: 8039

SEQ ID NO: 8118 - DNA, 201 bp, Homo sapiens; identical to SEQ ID NO: 8041

SEQ ID NO: 8119 - DNA, 201 bp, Homo sapiens; identical to SEQ ID NO: 8045

SEQ ID NO: 8120 - DNA, 201 bp, Homo sapiens; identical to SEQ ID NO: 8046

SEQ ID NO: 8121 - DNA, 201 bp, Homo sapiens; identical to SEQ ID NO: 8048

SEQ ID NO: 8122 - DNA, 201 bp, Homo sapiens; identical to SEQ ID NO: 8049

SEQ ID NO: 8123 - DNA, 201 bp, Homo sapiens; identical to SEQ ID NO: 8051

SEQ ID NO: 8124 - DNA, 201 bp, Homo sapiens; identical to SEQ ID NO: 8055

SEQ ID NO: 8125 - DNA, 201 bp, Homo sapiens; identical to SEQ ID NO: 8057

SEQ ID NO: 8126 - DNA, 201 bp, Homo sapiens; identical to SEQ ID NO: 8058

SEQ ID NO: 8127 - DNA, 201 bp, Homo sapiens; identical to SEQ ID NO: 8060

SEQ ID NO: 8128 - DNA, 201 bp, Homo sapiens; identical to SEQ ID NO: 8059

SEQ ID NO: 8129 - DNA, 201 bp, Homo sapiens; identical to SEQ ID NO: 8064

SEQ ID NO: 8130 - DNA, 201 bp, Homo sapiens; identical to SEQ ID NO: 8063

SEQ ID NO: 8131 - DNA, 201 bp, Homo sapiens; identical to SEQ ID NO: 8065

SEQ ID NO: 8132 - DNA, 201 bp, Homo sapiens; identical to SEQ ID NO: 8066

SEQ ID NO: 8133 - DNA, 201 bp, Homo sapiens; identical to SEQ ID NO: 8067

SEQ ID NO: 8134 - DNA, 201 bp, Homo sapiens; identical to SEQ ID NO: 8068

SEQ ID NO: 8135 - DNA, 201 bp, Homo sapiens; identical to SEQ ID NO: 8006

SEQ ID NO: 8136 - DNA, 201 bp, Homo sapiens; identical to SEQ ID NO: 8007

SEQ ID NO: 8137 - DNA, 201 bp, Homo sapiens; identical to SEQ ID NO: 8008

SEQ ID NO: 8138 - DNA, 201 bp, Homo sapiens; identical to SEQ ID NO: 8009

SEQ ID NO: 8139 - DNA, 201 bp, Homo sapiens; identical to SEQ ID NO: 8010

SEQ ID NO: 8140 - DNA, 201 bp, Homo sapiens; identical to SEQ ID NO: 8014

SEQ ID NO: 8141 - DNA, 201 bp, Homo sapiens; identical to SEQ ID NO: 8016

SEQ ID NO: 8142 - DNA, 201 bp, Homo sapiens; identical to SEQ ID NO: 8017

SEQ ID NO: 8143 - DNA, 201 bp, Homo sapiens; identical to SEQ ID NO: 8019

SEQ ID NO: 8144 - DNA, 201 bp, Homo sapiens; identical to SEQ ID NO: 8020

SEQ ID NO: 8145 - DNA, 201 bp, Homo sapiens; identical to SEQ ID NO: 8021

SEQ ID NO: 8146 - DNA, 201 bp, Homo sapiens; identical to SEQ ID NO: 8024

SEQ ID NO: 8147 - DNA, 201 bp, Homo sapiens; identical to SEQ ID NO: 8025

SEQ ID NO: 8148 - DNA, 201 bp, Homo sapiens; identical to SEQ ID NO: 8035

SEQ ID NO: 8149 - DNA, 201 bp, Homo sapiens; identical to SEQ ID NO: 8037

SEQ ID NO: 8150 - DNA, 201 bp, Homo sapiens; identical to SEQ ID NO: 8084

SEQ ID NO: 8151 - DNA, 201 bp, Homo sapiens; identical to SEQ ID NO: 8040

SEQ ID NO: 8152 - DNA, 201 bp, Homo sapiens; identical to SEQ ID NO: 8042

SEQ ID NO: 8153 - DNA, 201 bp, Homo sapiens; identical to SEQ ID NO: 8087

SEQ ID NO: 8154 - DNA, 201 bp, Homo sapiens; identical to SEQ ID NO: 8043

SEQ ID NO: 8155 - DNA, 201 bp, Homo sapiens; identical to SEQ ID NO: 8044

SEQ ID NO: 8156 - DNA, 201 bp, Homo sapiens; identical to SEQ ID NO: 8047

SEQ ID NO: 8157 - DNA, 201 bp, Homo sapiens; identical to SEQ ID NO: 8050

SEQ ID NO: 8158 - DNA, 201 bp, Homo sapiens; identical to SEQ ID NO: 8053

SEQ ID NO: 8159 - DNA, 201 bp, Homo sapiens; identical to SEQ ID NO: 8054

SEQ ID NO: 8160 - DNA, 201 bp, Homo sapiens; identical to SEQ ID NO: 8061

SEQ ID NO: 8161 - DNA, 201 bp, Homo sapiens; identical to SEQ ID NO: 8062

SEQ ID NO: 8162 - DNA, 201 bp, Homo sapiens; identical to SEQ ID NO: 8005

SEQ ID NO: 8163 - DNA, 201 bp, Homo sapiens; identical to SEQ ID NO: 8012

SEQ ID NO: 8164 - DNA, 201 bp, Homo sapiens; identical to SEQ ID NO: 8011

SEQ ID NO: 8165 - DNA, 201 bp, Homo sapiens; identical to SEQ ID NO: 8013

SEQ ID NO: 8166 - DNA, 201 bp, Homo sapiens; identical to SEQ ID NO: 8015

SEQ ID NO: 8167 - DNA, 201 bp, Homo sapiens; identical to SEQ ID NO: 8018

SEQ ID NO: 8168 - DNA, 201 bp, Homo sapiens; identical to SEQ ID NO: 8023

SEQ ID NO: 8169 - DNA, 201 bp, Homo sapiens; identical to SEQ ID NO: 8022

SEQ ID NO: 8170 - DNA, 201 bp, Homo sapiens; identical to SEQ ID NO: 8026

SEQ ID NO: 8171 - DNA, 201 bp, Homo sapiens; identical to SEQ ID NO: 8028

SEQ ID NO: 8172 - DNA, 201 bp, Homo sapiens; identical to SEQ ID NO: 8027

SEQ ID NO: 8173 - DNA, 201 bp, Homo sapiens; identical to SEQ ID NO: 8030

SEQ ID NO: 8174 - DNA, 201 bp, Homo sapiens; identical to SEQ ID NO: 8029

SEQ ID NO: 8175 - DNA, 201 bp, Homo sapiens; identical to SEQ ID NO: 8032

SEQ ID NO: 8176 - DNA, 201 bp, Homo sapiens; identical to SEQ ID NO: 8031

SEQ ID NO: 8177 - DNA, 201 bp, Homo sapiens; identical to SEQ ID NO: 8033

SEQ ID NO: 8178 - DNA, 201 bp, Homo sapiens; identical to SEQ ID NO: 8034

SEQ ID NO: 8179 - DNA, 201 bp, Homo sapiens; identical to SEQ ID NO: 8036

SEQ ID NO: 8180 - DNA, 201 bp, Homo sapiens; identical to SEQ ID NO: 8038

SEQ ID NO: 8181 - DNA, 201 bp, Homo sapiens
aacccttaaagacatcacagtcattgaagtcaacaagagagacatagtcttcctggtggatggctcatctgcactgggactggccaacttcaatgccatcygagacttcattgctaaagtcatccagaggctggaaatcggacaggatcttatccaggtggcagtggcccagtatgcagacactgtgaggcctgaatttta

SEQ ID NO: 8182 - DNA, 201 bp, Homo sapiens; identical to SEQ ID NO: 8041

SEQ ID NO: 8183 - DNA, 201 bp, Homo sapiens; identical to SEQ ID NO: 8045

SEQ ID NO: 8184 - DNA, 201 bp, Homo sapiens; identical to SEQ ID NO: 8046

SEQ ID NO: 8185 - DNA, 201 bp, Homo sapiens; identical to SEQ ID NO: 8048

SEQ ID NO: 8186 - DNA, 201 bp, Homo sapiens; identical to SEQ ID NO: 8049

SEQ ID NO: 8187 - DNA, 201 bp, Homo sapiens; identical to SEQ ID NO: 8051

SEQ ID NO: 8188 - DNA, 201 bp, Homo sapiens; identical to SEQ ID NO: 8055

SEQ ID NO: 8189 - DNA, 201 bp, Homo sapiens; identical to SEQ ID NO: 8057

SEQ ID NO: 8190 - DNA, 201 bp, Homo sapiens; identical to SEQ ID NO: 8058

SEQ ID NO: 8191 - DNA, 201 bp, Homo sapiens; identical to SEQ ID NO: 8060

SEQ ID NO: 8192 - DNA, 201 bp, Homo sapiens; identical to SEQ ID NO: 8059

SEQ ID NO: 8193 - DNA, 201 bp, Homo sapiens; identical to SEQ ID NO: 8064

SEQ ID NO: 8194 - DNA, 201 bp, Homo sapiens; identical to SEQ ID NO: 8063

SEQ ID NO: 8195 - DNA, 201 bp, Homo sapiens; identical to SEQ ID NO: 8065

SEQ ID NO: 8196 - DNA, 201 bp, Homo sapiens; identical to SEQ ID NO: 8066

SEQ ID NO: 8197 - DNA, 201 bp, Homo sapiens; identical to SEQ ID NO: 8067

SEQ ID NO: 8198 - DNA, 201 bp, Homo sapiens; identical to SEQ ID NO: 8068

SEQ ID NO: 8199 - DNA, 201 bp, Homo sapiens; identical to SEQ ID NO: 8006

SEQ ID NO: 8200 - DNA, 201 bp, Homo sapiens; identical to SEQ ID NO: 8007

SEQ ID NO: 8201 - DNA, 201 bp, Homo sapiens; identical to SEQ ID NO: 8008

SEQ ID NO: 8202 - DNA, 201 bp, Homo sapiens; identical to SEQ ID NO: 8009

SEQ ID NO: 8203 - DNA, 201 bp, Homo sapiens; identical to SEQ ID NO: 8010

SEQ ID NO: 8204 - DNA, 201 bp, Homo sapiens; identical to SEQ ID NO: 8014

SEQ ID NO: 8205 - DNA, 201 bp, Homo sapiens; identical to SEQ ID NO: 8016

SEQ ID NO: 8206 - DNA, 201 bp, Homo sapiens; identical to SEQ ID NO: 8017

SEQ ID NO: 8207 - DNA, 201 bp, Homo sapiens; identical to SEQ ID NO: 8019

SEQ ID NO: 8208 - DNA, 201 bp, Homo sapiens; identical to SEQ ID NO: 8020

SEQ ID NO: 8209 - DNA, 201 bp, Homo sapiens; identical to SEQ ID NO: 8021

SEQ ID NO: 8210 - DNA, 201 bp, Homo sapiens; identical to SEQ ID NO: 8024

SEQ ID NO: 8211 - DNA, 201 bp, Homo sapiens; identical to SEQ ID NO: 8025

SEQ ID NO: 8212 - DNA, 201 bp, Homo sapiens; identical to SEQ ID NO: 8035

SEQ ID NO: 8213 - DNA, 201 bp, Homo sapiens; identical to SEQ ID NO: 8037

SEQ ID NO: 8214 - DNA, 201 bp, Homo sapiens; identical to SEQ ID NO: 8084

SEQ ID NO: 8215 - DNA, 201 bp, Homo sapiens; identical to SEQ ID NO: 8040

SEQ ID NO: 8216 - DNA, 201 bp, Homo sapiens; identical to SEQ ID NO: 8042

SEQ ID NO: 8217 - DNA, 201 bp, Homo sapiens; identical to SEQ ID NO: 8087

SEQ ID NO: 8218 - DNA, 201 bp, Homo sapiens; identical to SEQ ID NO: 8043

SEQ ID NO: 8219 - DNA, 201 bp, Homo sapiens; identical to SEQ ID NO: 8044

SEQ ID NO: 8220 - DNA, 201 bp, Homo sapiens; identical to SEQ ID NO: 8047

SEQ ID NO: 8221 - DNA, 201 bp, Homo sapiens; identical to SEQ ID NO: 8050

SEQ ID NO: 8222 - DNA, 201 bp, Homo sapiens; identical to SEQ ID NO: 8052

SEQ ID NO: 8223 - DNA, 201 bp, Homo sapiens; identical to SEQ ID NO: 8053

SEQ ID NO: 8224 - DNA, 201 bp, Homo sapiens; identical to SEQ ID NO: 8054

SEQ ID NO: 8225 - DNA, 201 bp, Homo sapiens; identical to SEQ ID NO: 8056

SEQ ID NO: 8226 - DNA, 201 bp, Homo sapiens; identical to SEQ ID NO: 8061

SEQ ID NO: 8227 - DNA, 201 bp, Homo sapiens; identical to SEQ ID NO: 8062

SEQ ID NO: 8228 - DNA, 201 bp, Homo sapiens; identical to SEQ ID NO: 8005

SEQ ID NO: 8229 - DNA, 201 bp, Homo sapiens; identical to SEQ ID NO: 8012

SEQ ID NO: 8230 - DNA, 201 bp, Homo sapiens; identical to SEQ ID NO: 8011

SEQ ID NO: 8231 - DNA, 201 bp, Homo sapiens; identical to SEQ ID NO: 8013

SEQ ID NO: 8232 - DNA, 201 bp, Homo sapiens; identical to SEQ ID NO: 8015

SEQ ID NO: 8233 - DNA, 201 bp, Homo sapiens; identical to SEQ ID NO: 8018

SEQ ID NO: 8234 - DNA, 201 bp, Homo sapiens; identical to SEQ ID NO: 8023

SEQ ID NO: 8235 - DNA, 201 bp, Homo sapiens; identical to SEQ ID NO: 8022

SEQ ID NO: 8236 - DNA, 201 bp, Homo sapiens; identical to SEQ ID NO: 8026

SEQ ID NO: 8237 - DNA, 201 bp, Homo sapiens; identical to SEQ ID NO: 8028

SEQ ID NO: 8238 - DNA, 201 bp, Homo sapiens; identical to SEQ ID NO: 8027

SEQ ID NO: 8239 - DNA, 201 bp, Homo sapiens; identical to SEQ ID NO: 8030

SEQ ID NO: 8240 - DNA, 201 bp, Homo sapiens; identical to SEQ ID NO: 8029

SEQ ID NO: 8241 - DNA, 201 bp, Homo sapiens; identical to SEQ ID NO: 8032

SEQ ID NO: 8242 - DNA, 201 bp, Homo sapiens; identical to SEQ ID NO: 8031

SEQ ID NO: 8243 - DNA, 201 bp, Homo sapiens; identical to SEQ ID NO: 8033

SEQ ID NO: 8244 - DNA, 201 bp, Homo sapiens; identical to SEQ ID NO: 8034

SEQ ID NO: 8245 - DNA, 201 bp, Homo sapiens; identical to SEQ ID NO: 8036

SEQ ID NO: 8246 - DNA, 201 bp, Homo sapiens; identical to SEQ ID NO: 8038

SEQ ID NO: 8247 - DNA, 201 bp, Homo sapiens; identical to SEQ ID NO: 8039

SEQ ID NO: 8248 - DNA, 201 bp, Homo sapiens; identical to SEQ ID NO: 8041

SEQ ID NO: 8249 - DNA, 201 bp, Homo sapiens; identical to SEQ ID NO: 8045

SEQ ID NO: 8250 - DNA, 201 bp, Homo sapiens; identical to SEQ ID NO: 8046

SEQ ID NO: 8251 - DNA, 201 bp, Homo sapiens; identical to SEQ ID NO: 8048

SEQ ID NO: 8252 - DNA, 201 bp, Homo sapiens; identical to SEQ ID NO: 8049

SEQ ID NO: 8253 - DNA, 201 bp, Homo sapiens; identical to SEQ ID NO: 8051

SEQ ID NO: 8254 - DNA, 201 bp, Homo sapiens; identical to SEQ ID NO: 8055

SEQ ID NO: 8255 - DNA, 201 bp, Homo sapiens; identical to SEQ ID NO: 8057

SEQ ID NO: 8256 - DNA, 201 bp, Homo sapiens; identical to SEQ ID NO: 8058

SEQ ID NO: 8257 - DNA, 201 bp, Homo sapiens; identical to SEQ ID NO: 8060

SEQ ID NO: 8258 - DNA, 201 bp, Homo sapiens; identical to SEQ ID NO: 8059

SEQ ID NO: 8259 - DNA, 201 bp, Homo sapiens; identical to SEQ ID NO: 8064

SEQ ID NO: 8260 - DNA, 201 bp, Homo sapiens; identical to SEQ ID NO: 8063

SEQ ID NO: 8261 - DNA, 201 bp, Homo sapiens; identical to SEQ ID NO: 8065

SEQ ID NO: 8262 - DNA, 201 bp, Homo sapiens; identical to SEQ ID NO: 8066

SEQ ID NO: 8263 - DNA, 201 bp, Homo sapiens; identical to SEQ ID NO: 8067

SEQ ID NO: 8264 - DNA, 201 bp, Homo sapiens; identical to SEQ ID NO: 8068

SEQ ID NO: 8265 - DNA, 201 bp, Homo sapiens; identical to SEQ ID NO: 8005

SEQ ID NO: 8266 - DNA, 201 bp, Homo sapiens; identical to SEQ ID NO: 8006

SEQ ID NO: 8267 - DNA, 201 bp, Homo sapiens; identical to SEQ ID NO: 8009

SEQ ID NO: 8268 - DNA, 201 bp, Homo sapiens; identical to SEQ ID NO: 8011

SEQ ID NO: 8269 - DNA, 201 bp, Homo sapiens; identical to SEQ ID NO: 8012

SEQ ID NO: 8270 - DNA, 201 bp, Homo sapiens; identical to SEQ ID NO: 8013

SEQ ID NO: 8271 - DNA, 201 bp, Homo sapiens; identical to SEQ ID NO: 8014

SEQ ID NO: 8272 - DNA, 201 bp, Homo sapiens; identical to SEQ ID NO: 8015

SEQ ID NO: 8273 - DNA, 201 bp, Homo sapiens; identical to SEQ ID NO: 8016

SEQ ID NO: 8274 - DNA, 201 bp, Homo sapiens
ggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccttgctgttacgggcccctggagt

SEQ ID NO: 8275 - DNA, 201 bp, Homo sapiens; identical to SEQ ID NO: 8019

SEQ ID NO: 8276 - DNA, 201 bp, Homo sapiens; identical to SEQ ID NO: 8018

SEQ ID NO: 8277 - DNA, 201 bp, Homo sapiens; identical to SEQ ID NO: 8020

SEQ ID NO: 8278 - DNA, 201 bp, Homo sapiens; identical to SEQ ID NO: 8022

SEQ ID NO: 8279 - DNA, 201 bp, Homo sapiens; identical to SEQ ID NO: 8023

SEQ ID NO: 8280 - DNA, 201 bp, Homo sapiens; identical to SEQ ID NO: 8021

SEQ ID NO: 8281 - DNA, 201 bp, Homo sapiens; identical to SEQ ID NO: 8024

SEQ ID NO: 8282 - DNA, 201 bp, Homo sapiens; identical to SEQ ID NO: 8025

SEQ ID NO: 8283 - DNA, 201 bp, Homo sapiens; identical to SEQ ID NO: 8026

SEQ ID NO: 8284 - DNA, 201 bp, Homo sapiens; identical to SEQ ID NO: 8027

SEQ ID NO: 8285 - DNA, 201 bp, Homo sapiens; identical to SEQ ID NO: 8028

SEQ ID NO: 8286 - DNA, 201 bp, Homo sapiens; identical to SEQ ID NO: 8029

SEQ ID NO: 8287 - DNA, 201 bp, Homo sapiens; identical to SEQ ID NO: 8030

SEQ ID NO: 8288 - DNA, 201 bp, Homo sapiens; identical to SEQ ID NO: 8031

SEQ ID NO: 8289 - DNA, 201 bp, Homo sapiens; identical to SEQ ID NO: 8032

SEQ ID NO: 8290 - DNA, 201 bp, Homo sapiens; identical to SEQ ID NO: 8033

SEQ ID NO: 8291 - DNA, 201 bp, Homo sapiens; identical to SEQ ID NO: 8034

SEQ ID NO: 8292 - DNA, 201 bp, Homo sapiens; identical to SEQ ID NO: 8036

SEQ ID NO: 8293 - DNA, 201 bp, Homo sapiens; identical to SEQ ID NO: 8035

SEQ ID NO: 8294 - DNA, 201 bp, Homo sapiens; identical to SEQ ID NO: 8037

SEQ ID NO: 8295 - DNA, 201 bp, Homo sapiens; identical to SEQ ID NO: 8038

SEQ ID NO: 8296 - DNA, 201 bp, Homo sapiens; identical to SEQ ID NO: 8084

SEQ ID NO: 8297 - DNA, 201 bp, Homo sapiens; identical to SEQ ID NO: 8039

SEQ ID NO: 8298 - DNA, 201 bp, Homo sapiens; identical to SEQ ID NO: 8040

SEQ ID NO: 8299 - DNA, 201 bp, Homo sapiens; identical to SEQ ID NO: 8042

SEQ ID NO: 8300 - DNA, 201 bp, Homo sapiens; identical to SEQ ID NO: 8041

SEQ ID NO: 8301 - DNA, 201 bp, Homo sapiens; identical to SEQ ID NO: 8087

SEQ ID NO: 8302 - DNA, 201 bp, Homo sapiens; identical to SEQ ID NO: 8043

SEQ ID NO: 8303 - DNA, 201 bp, Homo sapiens; identical to SEQ ID NO: 8044

SEQ ID NO: 8304 - DNA, 201 bp, Homo sapiens; identical to SEQ ID NO: 8045

SEQ ID NO: 8305 - DNA, 201 bp, Homo sapiens; identical to SEQ ID NO: 8046

SEQ ID NO: 8306 - DNA, 201 bp, Homo sapiens; identical to SEQ ID NO: 8047

SEQ ID NO: 8307 - DNA, 201 bp, Homo sapiens; identical to SEQ ID NO: 8048

SEQ ID NO: 8308 - DNA, 201 bp, Homo sapiens; identical to SEQ ID NO: 8049

SEQ ID NO: 8309 - DNA, 201 bp, Homo sapiens; identical to SEQ ID NO: 8050

SEQ ID NO: 8310 - DNA, 201 bp, Homo sapiens; identical to SEQ ID NO: 8051

SEQ ID NO: 8311 - DNA, 201 bp, Homo sapiens; identical to SEQ ID NO: 8052

SEQ ID NO: 8312 - DNA, 201 bp, Homo sapiens; identical to SEQ ID NO: 8053

SEQ ID NO: 8313 - DNA, 201 bp, Homo sapiens; identical to SEQ ID NO: 8055

SEQ ID NO: 8314 - DNA, 201 bp, Homo sapiens; identical to SEQ ID NO: 8057

SEQ ID NO: 8315 - DNA, 201 bp, Homo sapiens; identical to SEQ ID NO: 8056

SEQ ID NO: 8316 - DNA, 201 bp, Homo sapiens; identical to SEQ ID NO: 8058

SEQ ID NO: 8317 - DNA, 201 bp, Homo sapiens; identical to SEQ ID NO: 8060

SEQ ID NO: 8318 - DNA, 201 bp, Homo sapiens; identical to SEQ ID NO: 8061

SEQ ID NO: 8319 - DNA, 201 bp, Homo sapiens; identical to SEQ ID NO: 8064

SEQ ID NO: 8320 - DNA, 201 bp, Homo sapiens; identical to SEQ ID NO: 8063

SEQ ID NO: 8321 - DNA, 201 bp, Homo sapiens; identical to SEQ ID NO: 8065

SEQ ID NO: 8322 - DNA, 201 bp, Homo sapiens; identical to SEQ ID NO: 8066

SEQ ID NO: 8323 - DNA, 201 bp, Homo sapiens; identical to SEQ ID NO: 8067

SEQ ID NO: 8324 - DNA, 201 bp, Homo sapiens; identical to SEQ ID NO: 8068

SEQ ID NO: 8325 - DNA, 201 bp, Homo sapiens; identical to SEQ ID NO: 8005

SEQ ID NO: 8326 - DNA, 201 bp, Homo sapiens; identical to SEQ ID NO: 8006

SEQ ID NO: 8327 - DNA, 201 bp, Homo sapiens; identical to SEQ ID NO: 8009

SEQ ID NO: 8328 - DNA, 201 bp, Homo sapiens; identical to SEQ ID NO: 8011

SEQ ID NO: 8329 - DNA, 201 bp, Homo sapiens; identical to SEQ ID NO: 8012

SEQ ID NO: 8330 - DNA, 201 bp, Homo sapiens; identical to SEQ ID NO: 8013

SEQ ID NO: 8331 - DNA, 201 bp, Homo sapiens; identical to SEQ ID NO: 8014

SEQ ID NO: 8332 - DNA, 201 bp, Homo sapiens; identical to SEQ ID NO: 8015

SEQ ID NO: 8333 - DNA, 201 bp, Homo sapiens; identical to SEQ ID NO: 8016

SEQ ID NO: 8334 - DNA, 201 bp, Homo sapiens; identical to SEQ ID NO: 8274

SEQ ID NO: 8335 - DNA, 201 bp, Homo sapiens; identical to SEQ ID NO: 8019

SEQ ID NO: 8336 - DNA, 201 bp, Homo sapiens; identical to SEQ ID NO: 8018

SEQ ID NO: 8337 - DNA, 201 bp, Homo sapiens; identical to SEQ ID NO: 8020

SEQ ID NO: 8338 - DNA, 201 bp, Homo sapiens; identical to SEQ ID NO: 8022

SEQ ID NO: 8339 - DNA, 201 bp, Homo sapiens; identical to SEQ ID NO: 8023

SEQ ID NO: 8340 - DNA, 201 bp, Homo sapiens; identical to SEQ ID NO: 8021

SEQ ID NO: 8341 - DNA, 201 bp, Homo sapiens; identical to SEQ ID NO: 8024

SEQ ID NO: 8342 - DNA, 201 bp, Homo sapiens; identical to SEQ ID NO: 8025

SEQ ID NO: 8343 - DNA, 201 bp, Homo sapiens; identical to SEQ ID NO: 8026

SEQ ID NO: 8344 - DNA, 201 bp, Homo sapiens; identical to SEQ ID NO: 8027

SEQ ID NO: 8345 - DNA, 201 bp, Homo sapiens; identical to SEQ ID NO: 8028

SEQ ID NO: 8346 - DNA, 201 bp, Homo sapiens; identical to SEQ ID NO: 8029

SEQ ID NO: 8347 - DNA, 201 bp, Homo sapiens; identical to SEQ ID NO: 8030

SEQ ID NO: 8348 - DNA, 201 bp, Homo sapiens; identical to SEQ ID NO: 8031

SEQ ID NO: 8349 - DNA, 201 bp, Homo sapiens; identical to SEQ ID NO: 8032

SEQ ID NO: 8350 - DNA, 201 bp, Homo sapiens; identical to SEQ ID NO: 8033

SEQ ID NO: 8351 - DNA, 201 bp, Homo sapiens; identical to SEQ ID NO: 8034

SEQ ID NO: 8352 - DNA, 201 bp, Homo sapiens; identical to SEQ ID NO: 8036

SEQ ID NO: 8353 - DNA, 201 bp, Homo sapiens; identical to SEQ ID NO: 8082

SEQ ID NO: 8354 - DNA, 201 bp, Homo sapiens; identical to SEQ ID NO: 8037

SEQ ID NO: 8355 - DNA, 201 bp, Homo sapiens; identical to SEQ ID NO: 8038

SEQ ID NO: 8356 - DNA, 201 bp, Homo sapiens; identical to SEQ ID NO: 8084

SEQ ID NO: 8357 - DNA, 201 bp, Homo sapiens; identical to SEQ ID NO: 8039

SEQ ID NO: 8358 - DNA, 201 bp, Homo sapiens; identical to SEQ ID NO: 8040

SEQ ID NO: 8359 - DNA, 201 bp, Homo sapiens; identical to SEQ ID NO: 8042

SEQ ID NO: 8360 - DNA, 201 bp, Homo sapiens; identical to SEQ ID NO: 8041

SEQ ID NO: 8361 - DNA, 201 bp, Homo sapiens; identical to SEQ ID NO: 8087

SEQ ID NO: 8362 - DNA, 201 bp, Homo sapiens; identical to SEQ ID NO: 8043

SEQ ID NO: 8363 - DNA, 201 bp, Homo sapiens; identical to SEQ ID NO: 8044

SEQ ID NO: 8364 - DNA, 201 bp, Homo sapiens; identical to SEQ ID NO: 8045

SEQ ID NO: 8365 - DNA, 201 bp, Homo sapiens; identical to SEQ ID NO: 8046

SEQ ID NO: 8366 - DNA, 201 bp, Homo sapiens; identical to SEQ ID NO: 8047

SEQ ID NO: 8367 - DNA, 201 bp, Homo sapiens; identical to SEQ ID NO: 8048

SEQ ID NO: 8368 - DNA, 201 bp, Homo sapiens; identical to SEQ ID NO: 8049

SEQ ID NO: 8369 - DNA, 201 bp, Homo sapiens; identical to SEQ ID NO: 8050

SEQ ID NO: 8370 - DNA, 201 bp, Homo sapiens; identical to SEQ ID NO: 8051

SEQ ID NO: 8371 - DNA, 201 bp, Homo sapiens; identical to SEQ ID NO: 8052

SEQ ID NO: 8372 - DNA, 201 bp, Homo sapiens; identical to SEQ ID NO: 8053

SEQ ID NO: 8373 - DNA, 201 bp, Homo sapiens; identical to SEQ ID NO: 8055

SEQ ID NO: 8374 - DNA, 201 bp, Homo sapiens; identical to SEQ ID NO: 8057

SEQ ID NO: 8375 - DNA, 201 bp, Homo sapiens; identical to SEQ ID NO: 8056

SEQ ID NO: 8376 - DNA, 201 bp, Homo sapiens; identical to SEQ ID NO: 8058

SEQ ID NO: 8377 - DNA, 201 bp, Homo sapiens; identical to SEQ ID NO: 8060

SEQ ID NO: 8378 - DNA, 201 bp, Homo sapiens; identical to SEQ ID NO: 8061

SEQ ID NO: 8379 - DNA, 201 bp, Homo sapiens; identical to SEQ ID NO: 8064

SEQ ID NO: 8380 - DNA, 201 bp, Homo sapiens; identical to SEQ ID NO: 8063

SEQ ID NO: 8381 - DNA, 201 bp, Homo sapiens; identical to SEQ ID NO: 8065

SEQ ID NO: 8382 - DNA, 201 bp, Homo sapiens; identical to SEQ ID NO: 8066

SEQ ID NO: 8383 - DNA, 201 bp, Homo sapiens; identical to SEQ ID NO: 8067

SEQ ID NO: 8384 - DNA, 201 bp, Homo sapiens; identical to SEQ ID NO: 8068

SEQ ID NO: 8385 - DNA, 201 bp, Homo sapiens; identical to SEQ ID NO: 8005

SEQ ID NO: 8386 - DNA, 201 bp, Homo sapiens; identical to SEQ ID NO: 8006

SEQ ID NO: 8387 - DNA, 201 bp, Homo sapiens; identical to SEQ ID NO: 8009

SEQ ID NO: 8388 - DNA, 201 bp, Homo sapiens; identical to SEQ ID NO: 8011

SEQ ID NO: 8389 - DNA, 201 bp, Homo sapiens; identical to SEQ ID NO: 8012

SEQ ID NO: 8390 - DNA, 201 bp, Homo sapiens; identical to SEQ ID NO: 8013

SEQ ID NO: 8391 - DNA, 201 bp, Homo sapiens; identical to SEQ ID NO: 8015

SEQ ID NO: 8392 - DNA, 201 bp, Homo sapiens; identical to SEQ ID NO: 8016

SEQ ID NO: 8393 - DNA, 201 bp, Homo sapiens; identical to SEQ ID NO: 8274

SEQ ID NO: 8394 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaagagagcaagcgagacattctgttcctctttgacggctcagccaatcttgtgggccagttccctgttgtccgtgacttt

SEQ ID NO: 8395 - DNA, 201 bp, Homo sapiens; identical to SEQ ID NO: 8018

SEQ ID NO: 8396 - DNA, 201 bp, Homo sapiens; identical to SEQ ID NO: 8020

SEQ ID NO: 8397 - DNA, 201 bp, Homo sapiens; identical to SEQ ID NO: 8022

SEQ ID NO: 8398 - DNA, 201 bp, Homo sapiens; identical to SEQ ID NO: 8023

SEQ ID NO: 8399 - DNA, 201 bp, Homo sapiens; identical to SEQ ID NO: 8021

SEQ ID NO: 8400 - DNA, 201 bp, Homo sapiens; identical to SEQ ID NO: 8024

SEQ ID NO: 8401 - DNA, 201 bp, Homo sapiens; identical to SEQ ID NO: 8025

SEQ ID NO: 8402 - DNA, 201 bp, Homo sapiens; identical to SEQ ID NO: 8026

SEQ ID NO: 8403 - DNA, 201 bp, Homo sapiens; identical to SEQ ID NO: 8027

SEQ ID NO: 8404 - DNA, 201 bp, Homo sapiens; identical to SEQ ID NO: 8028

SEQ ID NO: 8405 - DNA, 201 bp, Homo sapiens; identical to SEQ ID NO: 8029

SEQ ID NO: 8406 - DNA, 201 bp, Homo sapiens; identical to SEQ ID NO: 8030

SEQ ID NO: 8407 - DNA, 201 bp, Homo sapiens; identical to SEQ ID NO: 8031

SEQ ID NO: 8408 - DNA, 201 bp, Homo sapiens; identical to SEQ ID NO: 8032

SEQ ID NO: 8409 - DNA, 201 bp, Homo sapiens; identical to SEQ ID NO: 8033

SEQ ID NO: 8410 - DNA, 201 bp, Homo sapiens; identical to SEQ ID NO: 8034

SEQ ID NO: 8411 - DNA, 201 bp, Homo sapiens; identical to SEQ ID NO: 8036

SEQ ID NO: 8412 - DNA, 201 bp, Homo sapiens; identical to SEQ ID NO: 8035

SEQ ID NO: 8413 - DNA, 201 bp, Homo sapiens; identical to SEQ ID NO: 8037

SEQ ID NO: 8414 - DNA, 201 bp, Homo sapiens; identical to SEQ ID NO: 8038

SEQ ID NO: 8415 - DNA, 201 bp, Homo sapiens; identical to SEQ ID NO: 8084

SEQ ID NO: 8416 - DNA, 201 bp, Homo sapiens; identical to SEQ ID NO: 8039

SEQ ID NO: 8417 - DNA, 201 bp, Homo sapiens; identical to SEQ ID NO: 8040

SEQ ID NO: 8418 - DNA, 201 bp, Homo sapiens; identical to SEQ ID NO: 8042

SEQ ID NO: 8419 - DNA, 201 bp, Homo sapiens; identical to SEQ ID NO: 8041

SEQ ID NO: 8420 - DNA, 201 bp, Homo sapiens; identical to SEQ ID NO: 8087

SEQ ID NO: 8421 - DNA, 201 bp, Homo sapiens; identical to SEQ ID NO: 8043

SEQ ID NO: 8422 - DNA, 201 bp, Homo sapiens; identical to SEQ ID NO: 8044

SEQ ID NO: 8423 - DNA, 201 bp, Homo sapiens; identical to SEQ ID NO: 8045

SEQ ID NO: 8424 - DNA, 201 bp, Homo sapiens; identical to SEQ ID NO: 8046

SEQ ID NO: 8425 - DNA, 201 bp, Homo sapiens; identical to SEQ ID NO: 8047

SEQ ID NO: 8426 - DNA, 201 bp, Homo sapiens; identical to SEQ ID NO: 8048

SEQ ID NO: 8427 - DNA, 201 bp, Homo sapiens; identical to SEQ ID NO: 8050

SEQ ID NO: 8428 - DNA, 201 bp, Homo sapiens; identical to SEQ ID NO: 8051

SEQ ID NO: 8429 - DNA, 201 bp, Homo sapiens; identical to SEQ ID NO: 8052

SEQ ID NO: 8430 - DNA, 201 bp, Homo sapiens; identical to SEQ ID NO: 8053

SEQ ID NO: 8431 - DNA, 201 bp, Homo sapiens; identical to SEQ ID NO: 8055

SEQ ID NO: 8432 - DNA, 201 bp, Homo sapiens; identical to SEQ ID NO: 8057

SEQ ID NO: 8433 - DNA, 201 bp, Homo sapiens; identical to SEQ ID NO: 8056

SEQ ID NO: 8434 - DNA, 201 bp, Homo sapiens; identical to SEQ ID NO: 8060

SEQ ID NO: 8435 - DNA, 201 bp, Homo sapiens; identical to SEQ ID NO: 8061

SEQ ID NO: 8436 - DNA, 201 bp, Homo sapiens; identical to SEQ ID NO: 8064

SEQ ID NO: 8437 - DNA, 201 bp, Homo sapiens; identical to SEQ ID NO: 8063

SEQ ID NO: 8438 - DNA, 201 bp, Homo sapiens; identical to SEQ ID NO: 8065

SEQ ID NO: 8439 - DNA, 201 bp, Homo sapiens; identical to SEQ ID NO: 8066

SEQ ID NO: 8440 - DNA, 201 bp, Homo sapiens; identical to SEQ ID NO: 8067

SEQ ID NO: 8441 - DNA, 201 bp, Homo sapiens; identical to SEQ ID NO: 8068

SEQ ID NO: 8442 - DNA, 201 bp, Homo sapiens; identical to SEQ ID NO: 8005

SEQ ID NO: 8443 - DNA, 201 bp, Homo sapiens; identical to SEQ ID NO: 8006

SEQ ID NO: 8444 - DNA, 201 bp, Homo sapiens; identical to SEQ ID NO: 8007

SEQ ID NO: 8445 - DNA, 201 bp, Homo sapiens; identical to SEQ ID NO: 8008

SEQ ID NO: 8446 - DNA, 201 bp, Homo sapiens; identical to SEQ ID NO: 8009

SEQ ID NO: 8447 - DNA, 201 bp, Homo sapiens; identical to SEQ ID NO: 8010

SEQ ID NO: 8448 - DNA, 201 bp, Homo sapiens; identical to SEQ ID NO: 8011

SEQ ID NO: 8449 - DNA, 201 bp, Homo sapiens; identical to SEQ ID NO: 8012

SEQ ID NO: 8450 - DNA, 201 bp, Homo sapiens; identical to SEQ ID NO: 8013

SEQ ID NO: 8451 - DNA, 201 bp, Homo sapiens; identical to SEQ ID NO: 8015

SEQ ID NO: 8452 - DNA, 201 bp, Homo sapiens; identical to SEQ ID NO: 8016

SEQ ID NO: 8453 - DNA, 201 bp, Homo sapiens; identical to SEQ ID NO: 8017

SEQ ID NO: 8454 - DNA, 201 bp, Homo sapiens; identical to SEQ ID NO: 8018

SEQ ID NO: 8455 - DNA, 201 bp, Homo sapiens; identical to SEQ ID NO: 8394

SEQ ID NO: 8456 - DNA, 201 bp, Homo sapiens; identical to SEQ ID NO: 8020

SEQ ID NO: 8457 - DNA, 201 bp, Homo sapiens; identical to SEQ ID NO: 8021

SEQ ID NO: 8458 - DNA, 201 bp, Homo sapiens; identical to SEQ ID NO: 8022

SEQ ID NO: 8459 - DNA, 201 bp, Homo sapiens; identical to SEQ ID NO: 8023

SEQ ID NO: 8460 - DNA, 201 bp, Homo sapiens; identical to SEQ ID NO: 8024

SEQ ID NO: 8461 - DNA, 201 bp, Homo sapiens; identical to SEQ ID NO: 8025

SEQ ID NO: 8462 - DNA, 201 bp, Homo sapiens; identical to SEQ ID NO: 8026

SEQ ID NO: 8463 - DNA, 201 bp, Homo sapiens; identical to SEQ ID NO: 8027

SEQ ID NO: 8464 - DNA, 201 bp, Homo sapiens; identical to SEQ ID NO: 8028

SEQ ID NO: 8465 - DNA, 201 bp, Homo sapiens; identical to SEQ ID NO: 8029

SEQ ID NO: 8466 - DNA, 201 bp, Homo sapiens; identical to SEQ ID NO: 8030

SEQ ID NO: 8467 - DNA, 201 bp, Homo sapiens; identical to SEQ ID NO: 8031

SEQ ID NO: 8468 - DNA, 201 bp, Homo sapiens; identical to SEQ ID NO: 8032

SEQ ID NO: 8469 - DNA, 201 bp, Homo sapiens; identical to SEQ ID NO: 8033

SEQ ID NO: 8470 - DNA, 201 bp, Homo sapiens; identical to SEQ ID NO: 8034

SEQ ID NO: 8471 - DNA, 201 bp, Homo sapiens; identical to SEQ ID NO: 8035

SEQ ID NO: 8472 - DNA, 201 bp, Homo sapiens; identical to SEQ ID NO: 8036

SEQ ID NO: 8473 - DNA, 201 bp, Homo sapiens; identical to SEQ ID NO: 8037

SEQ ID NO: 8474 - DNA, 201 bp, Homo sapiens; identical to SEQ ID NO: 8084

SEQ ID NO: 8475 - DNA, 201 bp, Homo sapiens; identical to SEQ ID NO: 8038

SEQ ID NO: 8476 - DNA, 201 bp, Homo sapiens; identical to SEQ ID NO: 8039

SEQ ID NO: 8477 - DNA, 201 bp, Homo sapiens; identical to SEQ ID NO: 8040

SEQ ID NO: 8478 - DNA, 201 bp, Homo sapiens; identical to SEQ ID NO: 8041

SEQ ID NO: 8479 - DNA, 201 bp, Homo sapiens; identical to SEQ ID NO: 8042

SEQ ID NO: 8480 - DNA, 201 bp, Homo sapiens; identical to SEQ ID NO: 8087

SEQ ID NO: 8481 - DNA, 201 bp, Homo sapiens; identical to SEQ ID NO: 8043

SEQ ID NO: 8482 - DNA, 201 bp, Homo sapiens; identical to SEQ ID NO: 8044

SEQ ID NO: 8483 - DNA, 201 bp, Homo sapiens; identical to SEQ ID NO: 8045

SEQ ID NO: 8484 - DNA, 201 bp, Homo sapiens; identical to SEQ ID NO: 8046

SEQ ID NO: 8485 - DNA, 201 bp, Homo sapiens; identical to SEQ ID NO: 8047

SEQ ID NO: 8486 - DNA, 201 bp, Homo sapiens; identical to SEQ ID NO: 8048

SEQ ID NO: 8487 - DNA, 201 bp, Homo sapiens; identical to SEQ ID NO: 8050

SEQ ID NO: 8488 - DNA, 201 bp, Homo sapiens; identical to SEQ ID NO: 8051

SEQ ID NO: 8489 - DNA, 201 bp, Homo sapiens; identical to SEQ ID NO: 8052

SEQ ID NO: 8490 - DNA, 201 bp, Homo sapiens; identical to SEQ ID NO: 8053

SEQ ID NO: 8491 - DNA, 201 bp, Homo sapiens; identical to SEQ ID NO: 8054

SEQ ID NO: 8492 - DNA, 201 bp, Homo sapiens; identical to SEQ ID NO: 8055

SEQ ID NO: 8493 - DNA, 201 bp, Homo sapiens; identical to SEQ ID NO: 8056

SEQ ID NO: 8494 - DNA, 201 bp, Homo sapiens; identical to SEQ ID NO: 8057

SEQ ID NO: 8495 - DNA, 201 bp, Homo sapiens; identical to SEQ ID NO: 8059

SEQ ID NO: 8496 - DNA, 201 bp, Homo sapiens; identical to SEQ ID NO: 8060

SEQ ID NO: 8497 - DNA, 201 bp, Homo sapiens; identical to SEQ ID NO: 8061

SEQ ID NO: 8498 - DNA, 201 bp, Homo sapiens; identical to SEQ ID NO: 8062

SEQ ID NO: 8499 - DNA, 201 bp, Homo sapiens; identical to SEQ ID NO: 8063

SEQ ID NO: 8500 - DNA, 201 bp, Homo sapiens; identical to SEQ ID NO: 8064

SEQ ID NO: 8501 - DNA, 201 bp, Homo sapiens; identical to SEQ ID NO: 8065

SEQ ID NO: 8502 - DNA, 201 bp, Homo sapiens; identical to SEQ ID NO: 8066

SEQ ID NO: 8503 - DNA, 201 bp, Homo sapiens; identical to SEQ ID NO: 8067

SEQ ID NO: 8504 - DNA, 201 bp, Homo sapiens
tgctgcagagaggtgtggacgtgaacacccgggacacggatggcttcagcccgctgctgctggccgtgcggggcaggcatccgggtgtcattgggttgctscgggaagccggggcctccctgtccacccaggagctggaggaagcagggacggagctgtgcaggctggcatacagggccgacctcgaaggcctgcaggtgt

SEQ ID NO: 8505 - DNA, 201 bp, Homo sapiens
tgaggacactgcccatgttccatgacgaggagcacgcccgagcccgcggcctctctgaggacaccctggtgctacccccggccagccgcaaccagaggatyctctacaccgtgctggagtgccagcccctcttcgactccagtgacatgaccatcgctgagtgggtttgccttgcccagaccatcaagaggcactacgagc

SEQ ID NO: 8506 - DNA, 201 bp, Homo sapiens
ccgtgctggagtgccagcccctcttcgactccagtgacatgaccatcgctgagtgggtttgccttgcccagaccatcaagaggcactacgagcagtaccayggctttgtggtcatccacggcaccgacaccatggcctttgctgcctcgatgctgtccttcatgctggagaacctgcagaagactgtcatcctcactgggg

SEQ ID NO: 8507 - DNA, 201 bp, Homo sapiens
ggtgctacccccggccagccgcaaccagaggattctctacaccgtgctggagtgccagcccctcttcgactccagtgacatgaccatcgctgagtgggttygccttgcccagaccatcaagaggcactacgagcagtaccacggctttgtggtcatccacggcaccgacaccatggcctttgctgcctcgatgctgtcctt

SEQ ID NO: 8508 - DNA, 201 bp, Homo sapiens
aagcccgacctgctgcaggagctgcgggtggccaccgagcgcggcctggtcatcgtcaactgtacccactgcctccagggggctgtgaccacagactatgmagctggcatggccatggcgggagccggcgtcatctcaggcttcgacatgacatcggaggccgccctggccaagctatcgtatgtgctgggccagccaggg

SEQ ID NO: 8509 - DNA, 201 bp, Homo sapiens
gctacccccggccagccgcaaccagaggattctctacaccgtgctggagtgccagcccctcttcgactccagtgacatgaccatcgctgagtgggtttgcsttgcccagaccatcaagaggcactacgagcagtaccacggctttgtggtcatccacggcaccgacaccatggcctttgctgcctcgatgctgtccttcat

SEQ ID NO: 8510 - DNA, 201 bp, Homo sapiens
acgggcctggctgccatcctgaggacactgcccatgttccatgacgaggagcacgcccgagcccgcggcctctctgaggacaccctggtgctacccccggmcagccgcaaccagaggattctctacaccgtgctggagtgccagcccctcttcgactccagtgacatgaccatcgctgagtgggtttgccttgcccagacc

SEQ ID NO: 8511 - DNA, 201 bp, Homo sapiens
cgatgctgtccttcatgctggagaacctgcagaagactgtcatcctcactggggcccaggtgcccatccatgccctgtggagcgacggccgtgagaacctkctgggggcactgctcatggctggccagtatgtgatcccagaggtctgccttttcttccagaatcagctgtttcggggcaaccgggcaaccaaggtagacg

SEQ ID NO: 8512 - DNA, 201 bp, Homo sapiens
gcggcaccattggcatgcggagtgagctcggcgtgcttgtgcccgggacgggcctggctgccatcctgaggacactgcccatgttccatgacgaggagcaygcccgagcccgcggcctctctgaggacaccctggtgctacccccggccagccgcaaccagaggattctctacaccgtgctggagtgccagcccctcttcg

SEQ ID NO: 8513 - DNA, 201 bp, Homo sapiens
gcatggccatggcgggagccggcgtcatctcaggcttcgacatgacatcggaggccgccctggccaagctatcgtatgtgctgggccagccagggctgagsctggatgtcaggaaggagctgctgaccaaggaccttcggggggagatgacgccaccctcggtggaagagcgccggccctcactgcagggcaacacgctgg

SEQ ID NO: 8514 - DNA, 201 bp, Homo sapiens
atctggaaagtcagcgataacgagtcgtcatctaactatacctacaagatacatgtggcgggggagacagattcttccaatctcaacgtcagtgagcctcrcgctgtcatccccggactccgctccagcaccttctacaacatcacagtgtgtcctgtcctaggtgacatcgagggcacgccgggcttcctccaagtgcac

SEQ ID NO: 8515 - DNA, 201 bp, Homo sapiens
attggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttggatgccagcaatacagagagaagccgggcagggagccccaccgcccctgtgcat

SEQ ID NO: 8516 - DNA, 201 bp, Homo sapiens
tacaatgggaagctggaacctctgggctcctaccgggcttgtgtggctggcttcaccaacattaccttccaccctcaaaacaaggggctcattgatggggytgagagctatgtgtccttcagtcgctactcagatgctgtttccttgccccaggatccaggtgtcatctgtggagcggtttttggctgtatctttggtgcc

SEQ ID NO: 8517 - DNA, 106 bp, Homo sapiens
aaagtccactggctttcgtctctctctgccgtgacacatatcggaatctactgtatatatatatatatatatatatatatatatatatatatatatatatrcacta

SEQ ID NO: 8518 - DNA, 201 bp, Homo sapiens
tcataaaagtcatcacagagccgatcccagtttctgatctccgtgttgccctcacgggtgtgaggaaggctgctctctcctggagcaatggcaatggcacygcctcctgccgggttcttcttgaaagcattggaagccatgaggagttgactcaagactcaagacttcaggtcaatatctcgggcctgaagccaggggttc

SEQ ID NO: 8519 - DNA, 201 bp, Homo sapiens
tcacaggcttacgtccagcgacttcatatgtattctccatcactccaggaataggcaatgagacttggggagatcccagagtcataaaagtcatcacagarccgatcccagtttctgatctccgtgttgccctcacgggtgtgaggaaggctgctctctcctggagcaatggcaatggcactgcctcctgccgggttcttc

SEQ ID NO: 8520 - DNA, 201 bp, Homo sapiens
gtagcttagcatcagaggtttgcttcctcagtaacatttctgttctcatttgatcaggggaggcctctttgccccgaccccgcttcccctgccccctgtasatttgtgctccattttttcttcccttttccctcccagttttctccaaagactcttctgttggcaacattttcaacccattggttgggtgagaatggcgac

SEQ ID NO: 8521 - DNA, 201 bp, Homo sapiens
tggaatatacggaatatttaaacagtagcttagcatcagaggtttgcttcctcagtaacatttctgttctcatttgatcaggggaggcctctttgccccgrccccgcttcccctgccccctgtacatttgtgctccattttttcttcccttttccctcccagttttctccaaagactcttctgttggcaacattttcaacc

SEQ ID NO: 8522 - DNA, 201 bp, Homo sapiens
cgcgctgtcatccccggactccgctccagcaccttctacaacatcacagtgtgtcctgtcctaggtgacatcgagggcacgccgggcttcctccaagtgcrcaccccccctgttccagtttctgacttccgagtgacagtggtcagcacgacggagatcggcttagcatggagcagccatgatgcagaatcatttcagatg

SEQ ID NO: 8523 - DNA, 201 bp, Homo sapiens
gccagcaatacagagagaagccgggcagggagccccaccgcccctgtgcatgatgagtccctcgtgggacctgtggacccatcctccggccagcagtcccragacacggaagtcctgcttgtcgggttagagcctggcacccgatacaatgccaccgtttattcccaagcagcgaatggcacagaaggacagccccaggcc

SEQ ID NO: 8524 - DNA, 201 bp, Homo sapiens
aaatggacctgccctcctggcgccaatgcaggctttgagctggaggtcagcagtggagcctggaacaatgcgacccacctggagagctgctcctctgagartggcactgagtatagaacggaagtcacgtatttgaatttttctacctcgtacaacatcagcatcaccactgtgtcctgtggaaagatggcagcccccacc

SEQ ID NO: 8525 - DNA, 201 bp, Homo sapiens
gtgacatcgagggcacgccgggcttcctccaagtgcacaccccccctgttccagtttctgacttccgagtgacagtggtcagcacgacggagatcggcttrgcatggagcagccatgatgcagaatcatttcagatgcatatcacacaggagggagctggcaattctcgggtagaaataaccaccaaccaaagtattatca

SEQ ID NO: 8526 - DNA, 201 bp, Homo sapiens
gatttgaagccagccacggacccatcaaagcctatgctgtcattctcaccaccggggaagctggtcacccttctgcagatgtcctgaaatacacgtatgasgatttcaaaaagggagcctcagatacttatgtgacatacctcataagaacagaagaaaagggacgttctcagagcttgtctgaagttttgaaatatgaaa

SEQ ID NO: 8527 - DNA, 201 bp, Homo sapiens
tcctggccagaccacggtgttcccgacaccactgacctgctcatcaacttccggtacctcgttcgtgactacatgaagcagagtcctcccgaatcgccgaytctggtgcattgcagtgctggggtcggaaggacgggcactttcattgccattgatcgtctcatctaccagatagagaatgagaacaccgtggatgtgtat

SEQ ID NO: 8528 - DNA, 201 bp, Homo sapiens
tcaatcagtgtgttttggatattgtcagatcccagaaagactcaaaagtagatcttatctaccagaacacaactgcaatgacaatctatgaaaaccttgcrcccgtgaccacatttggaaagaccaatggttacatcgcctaattccaaaggaataacctttctggagtgaaccagaccgtcgcacccacagcgaaggcac

SEQ ID NO: 8529 - DNA, 201 bp, Homo sapiens
aatgagaagacaattactgttgtgcatcaaccatggtgtaacatcacaggcttacgtccagcgacttcatatgtattctccatcactccaggaataggcartgagacttggggagatcccagagtcataaaagtcatcacagagccgatcccagtttctgatctccgtgttgccctcacgggtgtgaggaaggctgctctc

SEQ ID NO: 8530 - DNA, 201 bp, Homo sapiens
gaatatacggaatatttaaacagtagcttagcatcagaggtttgcttcctcagtaacatttctgttctcatttgatcaggggaggcctctttgccccgacyccgcttcccctgccccctgtacatttgtgctccattttttcttcccttttccctcccagttttctccaaagactcttctgttggcaacattttcaaccca

SEQ ID NO: 8531 - DNA, 201 bp, Homo sapiens
cacccgatacaatgccaccgtttattcccaagcagcgaatggcacagaaggacagccccaggccatagagttcaggacaaatgctattcaggtttttgacrtcaccgctgtgaacatcagtgccacaagcctgaccctgatctggaaagtcagcgataacgagtcgtcatctaactatacctacaagatacatgtggcggg

SEQ ID NO: 8532 - DNA, 201 bp, Homo sapiens
ctcgggcctgaagccaggggttcaatacaacatcaacccgtatcttctaccatcaaataagacaaagggagaccccttgggcacagaaggtggcttggatrccagcaatacagagagaagccgggcagggagccccaccgcccctgtgcatgatgagtccctcgtgggacctgtggacccatcctccggccagcagtccca

SEQ ID NO: 8533 - DNA, 201 bp, Homo sapiens
tgggtggggagcaaatcatctgcattcctgatgaccaatgggatgaggtcactttttttttttttcccccttgaggattgtggaaaaccaggaaaagggakctatgatttttttttccaaaacaatttcttttttaaaaaagactattttatatgattcacatgctaaagccaggattgtgttgggttgaatatattttaa

SEQ ID NO: 8534 - DNA, 201 bp, Homo sapiens
gggctgtcgggggctgtggatgggtggggagcaaatcatctgcattcctgatgaccaatgggatgaggtcactttttttttttttcccccttgaggattgyggaaaaccaggaaaagggagctatgatttttttttccaaaacaatttcttttttaaaaaagactattttatatgattcacatgctaaagccaggattgtg

SEQ ID NO: 8535 - DNA, 201 bp, Homo sapiens
aagactcaaaagtagatcttatctaccagaacacaactgcaatgacaatctatgaaaaccttgcgcccgtgaccacatttggaaagaccaatggttacatmgcctaattccaaaggaataacctttctggagtgaaccagaccgtcgcacccacagcgaaggcacatgccccgatgtcgacatgtttttatatgtctaata

SEQ ID NO: 8536 - DNA, 201 bp, Homo sapiens
gctcctaccgggcttgtgtggctggcttcaccaacattaccttccaccctcaaaacaaggggctcattgatggggctgagagctatgtgtccttcagtcgytactcagatgctgtttccttgccccaggatccaggtgtcatctgtggagcggtttttggctgtatctttggtgccctggttattgtgactgtgggaggct

SEQ ID NO: 8537 - DNA, 201 bp, Homo sapiens; identical to SEQ ID NO: 8514

SEQ ID NO: 8538 - DNA, 201 bp, Homo sapiens; identical to SEQ ID NO: 8515

SEQ ID NO: 8539 - DNA, 201 bp, Homo sapiens; identical to SEQ ID NO: 8516

SEQ ID NO: 8540 - DNA, 106 bp, Homo sapiens; identical to SEQ ID NO: 8517

SEQ ID NO: 8541 - DNA, 201 bp, Homo sapiens; identical to SEQ ID NO: 8518

SEQ ID NO: 8542 - DNA, 201 bp, Homo sapiens; identical to SEQ ID NO: 8519

SEQ ID NO: 8543 - DNA, 201 bp, Homo sapiens; identical to SEQ ID NO: 8520

SEQ ID NO: 8544 - DNA, 201 bp, Homo sapiens; identical to SEQ ID NO: 8521

SEQ ID NO: 8545 - DNA, 201 bp, Homo sapiens; identical to SEQ ID NO: 8522

SEQ ID NO: 8546 - DNA, 201 bp, Homo sapiens; identical to SEQ ID NO: 8523

SEQ ID NO: 8547 - DNA, 201 bp, Homo sapiens; identical to SEQ ID NO: 8524

SEQ ID NO: 8548 - DNA, 201 bp, Homo sapiens; identical to SEQ ID NO: 8525

SEQ ID NO: 8549 - DNA, 201 bp, Homo sapiens; identical to SEQ ID NO: 8526

SEQ ID NO: 8550 - DNA, 201 bp, Homo sapiens; identical to SEQ ID NO: 8527

SEQ ID NO: 8551 - DNA, 201 bp, Homo sapiens; identical to SEQ ID NO: 8529

SEQ ID NO: 8552 - DNA, 201 bp, Homo sapiens; identical to SEQ ID NO: 8528

SEQ ID NO: 8553 - DNA, 201 bp, Homo sapiens; identical to SEQ ID NO: 8530

SEQ ID NO: 8554 - DNA, 201 bp, Homo sapiens; identical to SEQ ID NO: 8531

SEQ ID NO: 8555 - DNA, 201 bp, Homo sapiens; identical to SEQ ID NO: 8534

SEQ ID NO: 8556 - DNA, 201 bp, Homo sapiens; identical to SEQ ID NO: 8533

SEQ ID NO: 8557 - DNA, 201 bp, Homo sapiens; identical to SEQ ID NO: 8532

SEQ ID NO: 8558 - DNA, 201 bp, Homo sapiens; identical to SEQ ID NO: 8535

SEQ ID NO: 8559 - DNA, 201 bp, Homo sapiens; identical to SEQ ID NO: 8536

SEQ ID NO: 8560 - DNA, 201 bp, Homo sapiens
tcaatcagtgtgttttggatattgtcagatcccagaaagactcaaaagtagatcttatctaccagaacacaactgcaatgacaatctatgaaaaccttgcrcccgtgaccacatttggaaagaccaatgaaaagcagctggtatgggtttgggtgtcaatgaaagggccaaagactggtggccagctggtttgggggattt

SEQ ID NO: 8561 - DNA, 118 bp, Homo sapiens
atgcctgggtacattgcrtgctctggggaccagtatgttttcctcaatcagtgtgttttggatattgtcagatcccagaaagactcaaaagtagatcttatctaccagaacacaactg

SEQ ID NO: 8562 - DNA, 201 bp, Homo sapiens; identical to SEQ ID NO: 8514

SEQ ID NO: 8563 - DNA, 201 bp, Homo sapiens; identical to SEQ ID NO: 8515

SEQ ID NO: 8564 - DNA, 201 bp, Homo sapiens; identical to SEQ ID NO: 8516

SEQ ID NO: 8565 - DNA, 106 bp, Homo sapiens; identical to SEQ ID NO: 8517

SEQ ID NO: 8566 - DNA, 201 bp, Homo sapiens; identical to SEQ ID NO: 8518

SEQ ID NO: 8567 - DNA, 201 bp, Homo sapiens; identical to SEQ ID NO: 8519

SEQ ID NO: 8568 - DNA, 201 bp, Homo sapiens; identical to SEQ ID NO: 8520

SEQ ID NO: 8569 - DNA, 201 bp, Homo sapiens; identical to SEQ ID NO: 8521

SEQ ID NO: 8570 - DNA, 201 bp, Homo sapiens; identical to SEQ ID NO: 8522

SEQ ID NO: 8571 - DNA, 201 bp, Homo sapiens; identical to SEQ ID NO: 8523

SEQ ID NO: 8572 - DNA, 201 bp, Homo sapiens; identical to SEQ ID NO: 8524

SEQ ID NO: 8573 - DNA, 201 bp, Homo sapiens; identical to SEQ ID NO: 8525

SEQ ID NO: 8574 - DNA, 201 bp, Homo sapiens; identical to SEQ ID NO: 8526

SEQ ID NO: 8575 - DNA, 201 bp, Homo sapiens; identical to SEQ ID NO: 8527

SEQ ID NO: 8576 - DNA, 201 bp, Homo sapiens; identical to SEQ ID NO: 8529

SEQ ID NO: 8577 - DNA, 201 bp, Homo sapiens; identical to SEQ ID NO: 8528

SEQ ID NO: 8578 - DNA, 201 bp, Homo sapiens; identical to SEQ ID NO: 8530

SEQ ID NO: 8579 - DNA, 201 bp, Homo sapiens; identical to SEQ ID NO: 8531

SEQ ID NO: 8580 - DNA, 201 bp, Homo sapiens; identical to SEQ ID NO: 8534

SEQ ID NO: 8581 - DNA, 201 bp, Homo sapiens; identical to SEQ ID NO: 8533

SEQ ID NO: 8582 - DNA, 201 bp, Homo sapiens; identical to SEQ ID NO: 8532

SEQ ID NO: 8583 - DNA, 201 bp, Homo sapiens; identical to SEQ ID NO: 8535

SEQ ID NO: 8584 - DNA, 201 bp, Homo sapiens; identical to SEQ ID NO: 8536

SEQ ID NO: 8585 - DNA, 201 bp, Homo sapiens; identical to SEQ ID NO: 8514

SEQ ID NO: 8586 - DNA, 201 bp, Homo sapiens; identical to SEQ ID NO: 8515

SEQ ID NO: 8587 - DNA, 201 bp, Homo sapiens
tgggaagctggaacctctgggctcctaccggtaatggcttgtgtggctggcttcaccaacattaccttccaccctcaaaacaaggggctcattgatggggytgagagctatgtgtccttcagtcgctactcagatgctgtttccttgccccaggatccaggtgtcatctgtggagcggtttttggctgtatctttggtgcc

SEQ ID NO: 8588 - DNA, 106 bp, Homo sapiens; identical to SEQ ID NO: 8517

SEQ ID NO: 8589 - DNA, 201 bp, Homo sapiens; identical to SEQ ID NO: 8518

SEQ ID NO: 8590 - DNA, 201 bp, Homo sapiens; identical to SEQ ID NO: 8519

SEQ ID NO: 8591 - DNA, 201 bp, Homo sapiens; identical to SEQ ID NO: 8520

SEQ ID NO: 8592 - DNA, 201 bp, Homo sapiens; identical to SEQ ID NO: 8521

SEQ ID NO: 8593 - DNA, 201 bp, Homo sapiens; identical to SEQ ID NO: 8522

SEQ ID NO: 8594 - DNA, 201 bp, Homo sapiens; identical to SEQ ID NO: 8523

SEQ ID NO: 8595 - DNA, 201 bp, Homo sapiens; identical to SEQ ID NO: 8524

SEQ ID NO: 8596 - DNA, 201 bp, Homo sapiens; identical to SEQ ID NO: 8525

SEQ ID NO: 8597 - DNA, 201 bp, Homo sapiens; identical to SEQ ID NO: 8526

SEQ ID NO: 8598 - DNA, 201 bp, Homo sapiens; identical to SEQ ID NO: 8527

SEQ ID NO: 8599 - DNA, 201 bp, Homo sapiens; identical to SEQ ID NO: 8529

SEQ ID NO: 8600 - DNA, 201 bp, Homo sapiens; identical to SEQ ID NO: 8528

SEQ ID NO: 8601 - DNA, 201 bp, Homo sapiens; identical to SEQ ID NO: 8530

SEQ ID NO: 8602 - DNA, 201 bp, Homo sapiens; identical to SEQ ID NO: 8531

SEQ ID NO: 8603 - DNA, 201 bp, Homo sapiens; identical to SEQ ID NO: 8534

SEQ ID NO: 8604 - DNA, 201 bp, Homo sapiens; identical to SEQ ID NO: 8533

SEQ ID NO: 8605 - DNA, 201 bp, Homo sapiens; identical to SEQ ID NO: 8532

SEQ ID NO: 8606 - DNA, 201 bp, Homo sapiens
taccggtaatggcttgtgtggctggcttcaccaacattaccttccaccctcaaaacaaggggctcattgatggggctgagagctatgtgtccttcagtcgytactcagatgctgtttccttgccccaggatccaggtgtcatctgtggagcggtttttggctgtatctttggtgccctggttattgtgactgtgggaggct

SEQ ID NO: 8607 - DNA, 201 bp, Homo sapiens; identical to SEQ ID NO: 8535

SEQ ID NO: 8608 - DNA, 201 bp, Homo sapiens
gcagtagcagtggatcgggccaagaaggaggcagctgagaaggaacaggaacttttaaaacagaaattacaggagcagcagcaacagatggaggctcaagwtaagagtcgcaaggaaaacatagcccaactgaaggagaagctgcagatggagagagaacacctactgagagagcagattatgatgttggagcacacgcag

SEQ ID NO: 8609 - DNA, 201 bp, Homo sapiens
cttctagccaatattgagaaggtgtcagaaaagcaactggatcccaaattccaggaacaaacaaacattttctgttcttacatcttcactcatgcaagaaycaagaccctcagggagggaatcacagtcactgggaatcgtctgggaactctggcagtgacttatgtagaggccatcaacagtggagcagtgccttgtctg

SEQ ID NO: 8610 - DNA, 201 bp, Homo sapiens
cccagcgagtgaagttccccacagacacgctccaggagctgctggacgtgcatgcggcctgtgagagggaagccattgcaatcttcatggagcactccttyaaggatgaaaatcaggaattccagaagaagttcatggaaaccacaatgaataagaagggggatttcttgctgcagaatgaagagtcatctgttcaatact

SEQ ID NO: 8611 - DNA, 201 bp, Homo sapiens
gacttatgtagaggccatcaacagtggagcagtgccttgtctggagaatgcagtgataactctggcccagcgtgagaactcagcggccgtgcagagggcakctgactactacagccagcagatggcccagcgagtgaagttccccacagacacgctccaggagctgctggacgtgcatgcggcctgtgagagggaagccat

SEQ ID NO: 8612 - DNA, 201 bp, Homo sapiens
agcatgagcaccatcaaccaccaggccctggagcagctgcattatgtgacggagctcacagaactaattaaggcaaagtcctccccaaggcctgatggagyagaagattccacagagtttgtgagtttcttcccagactttctttggacagtacgggatttcactctggagctgaagttgaacggtcaccctatcacagaa

SEQ ID NO: 8613 - DNA, 201 bp, Homo sapiens
tgagaactcagcggccgtgcagagggcatctgactactacagccagcagatggcccagcgagtgaagttccccacagacacgctccaggagctgctggacrtgcatgcggcctgtgagagggaagccattgcaatcttcatggagcactccttcaaggatgaaaatcaggaattccagaagaagttcatggaaaccacaat

SEQ ID NO: 8614 - DNA, 201 bp, Homo sapiens
gattgaacaggactattggcaagttcccaggaaaggagtaaaggcaaaagaggtcttccagaggttcctggagtcacagatggtgatagaggaatccatcytgcagtcagataaagccctcactgatagagagaaggcagtagcagtggatcgggccaagaaggaggcagctgagaaggaacaggaacttttaaaacagaa

SEQ ID NO: 8615 - DNA, 201 bp, Homo sapiens
tctggagaatgcagtgataactctggcccagcgtgagaactcagcggccgtgcagagggcatctgactactacagccagcagatggcccagcgagtgaagytccccacagacacgctccaggagctgctggacgtgcatgcggcctgtgagagggaagccattgcaatcttcatggagcactccttcaaggatgaaaatca

SEQ ID NO: 8616 - DNA, 201 bp, Homo sapiens
ctgtggagaaggccgataactttgaatacagcgacccagtggatggaagcatttcaagaaatcagggcttgcgcctcattttcacagatggttctcgaatygtcttccgactgagcggcactgggagtgccggggccaccattcggctgtacatcgatagctatgagaaggacgttgccaagattaaccaggacccccagg

SEQ ID NO: 8617 - DNA, 201 bp, Homo sapiens
aagtcatctgattgaagagcatgacagaaacaaaatcagtgcatttacaaggcactgccaaacaagatgcccttgggagctgtgagggaaagaggacctgygggcttagatcaatctcaattccttttcatgccctcctgcattgctgctgcgtgggtatttgtctccttagccatcaggtacagtttacactacaatgta

SEQ ID NO: 8618 - DNA, 201 bp, Homo sapiens
atcatcactggtggttggtggagatgggcggtactttaataaatcagcaatagaaacaatagtgcagatggcagctgccaatgggatcggtcgcttggttrtcggacagaatggaatcctctccacccctgctgtatcctgcatcattagaaaaatcaaagccattggtgggatcattctgacagccagtcacaacccagg

SEQ ID NO: 8619 - DNA, 201 bp, Homo sapiens
cccccttatttccattgctctgaaagtgtcccagctgcaggagaggacgggacgcactgcacccactgtcatcacctaagaagacaggcctgatgtggtaygtccctccacccccggacccatccaagtcatctgattgaagagcatgacagaaacaaaatcagtgcatttacaaggcactgccaaacaagatgcccttgg

SEQ ID NO: 8620 - DNA, 201 bp, Homo sapiens
cctgcatcattagaaaaatcaaagccattggtgggatcattctgacagccagtcacaacccagggggccccaatggagattttggaatcaaattcaatatytctaatggaggtcctgctccagaagcaataactgataaaattttccaaatcagcaagacaattgaagaatatgcagtttgccctgacctgaaagtagacc

SEQ ID NO: 8621 - DNA, 201 bp, Homo sapiens
tgctctgaaagtgtcccagctgcaggagaggacgggacgcactgcacccactgtcatcacctaagaagacaggcctgatgtggtacgtccctccacccccrgacccatccaagtcatctgattgaagagcatgacagaaacaaaatcagtgcatttacaaggcactgccaaacaagatgcccttgggagctgtgagggaaa

SEQ ID NO: 8622 - DNA, 138 bp, Homo sapiens
atgtaagctataggtggagcatcagcagtgagtgaggccattcttcatccttaggatgtggcaatgaaatgatggtgcaagttcctttctcttttgtgaawctttccccccatttcctgtttacatgtaacccaacaa

SEQ ID NO: 8623 - DNA, 201 bp, Homo sapiens
ctgaaagtgtcccagctgcaggagaggacgggacgcactgcacccactgtcatcacctaagaagacaggcctgatgtggtacgtccctccacccccggacycatccaagtcatctgattgaagagcatgacagaaacaaaatcagtgcatttacaaggcactgccaaacaagatgcccttgggagctgtgagggaaagagg

SEQ ID NO: 8624 - DNA, 201 bp, Homo sapiens
aattgtggattcggtagaagcttatgctacaatgctgagaagcatctttgatttcagtgcactgaaagaactactttctgggccaaaccgactgaagatcygtattgatgctatgcatggagttgtgggaccgtatgtaaagaagatcctctgtgaagaactcggtgcccctgcgaactcggcagttaactgcgttcctct

SEQ ID NO: 8625 - DNA, 201 bp, Homo sapiens
ccgtgagaaagatggactgtgggctgtccttgcctggctctccatcctagccacccgcaagcagagtgtggaggacattctcaaagatcattggcaaaagyatggccggaatttcttcaccaggtatgattacgaggaggtggaagctgagggcgcaaacaaaatgatgaaggacttggaggccctgatgtttgatcgctc

SEQ ID NO: 8626 - DNA, 201 bp, Homo sapiens
tgtggagaaggccgataactttgaatacagcgacccagtggatggaagcatttcaagaaatcagggcttgcgcctcattttcacagatggttctcgaatcrtcttccgactgagcggcactgggagtgccggggccaccattcggctgtacatcgatagctatgagaaggacgttgccaagattaaccaggacccccaggt

SEQ ID NO: 8627 - DNA, 201 bp, Homo sapiens; identical to SEQ ID NO: 8616

SEQ ID NO: 8628 - DNA, 201 bp, Homo sapiens
tttaggatttgactttttcactaaccagttgacgagcagtgcatttacaaggcactgccaaacaagatgcccttgggagctgtgagggaaagaggacctgygggcttagatcaatctcaattccttttcatgccctcctgcattgctgctgcgtgggtatttgtctccttagccatcaggtacagtttacactacaatgta

SEQ ID NO: 8629 - DNA, 201 bp, Homo sapiens
tcacctaagaagacaggcctgatgtggtacgtccctccacccccggacccatccaagtcatctgattgaagagcatgacagaaacaaaatgtattcaccamgcattttaggatttgactttttcactaaccagttgacgagcagtgcatttacaaggcactgccaaacaagatgcccttgggagctgtgagggaaagagga

SEQ ID NO: 8630 - DNA, 201 bp, Homo sapiens
ggccacgctggtggtgggcggggacggccggttctacatgaaggaggccatccagctcatcgctcgcatcgctgccgccaacgggatcggtcgcttggttrtcggacagaatggaatcctctccacccctgctgtatcctgcatcattagaaaaatcaaagccattggtgggatcattctgacagccagtcacaacccagg

SEQ ID NO: 8631 - DNA, 201 bp, Homo sapiens
cccccttatttccattgctctgaaagtgtcccagctgcaggagaggacgggacgcactgcacccactgtcatcacctaagaagacaggcctgatgtggtaygtccctccacccccggacccatccaagtcatctgattgaagagcatgacagaaacaaaatgtattcaccaagcattttaggatttgactttttcactaac

SEQ ID NO: 8632 - DNA, 201 bp, Homo sapiens; identical to SEQ ID NO: 8620

SEQ ID NO: 8633 - DNA, 201 bp, Homo sapiens
aaatgatggtgcaagttcctttctcttttgtgaatctttccccccatttcctgtttacatgtaacccaacaaaatgcaatttctagtgccttctgtccaaycagttctttcctctgagtgagacgtacttggctacagatttctgccttgttttgcgacattgtcccattcacacagatattttgggataataaaggaaaa

SEQ ID NO: 8634 - DNA, 201 bp, Homo sapiens
tgctctgaaagtgtcccagctgcaggagaggacgggacgcactgcacccactgtcatcacctaagaagacaggcctgatgtggtacgtccctccacccccrgacccatccaagtcatctgattgaagagcatgacagaaacaaaatgtattcaccaagcattttaggatttgactttttcactaaccagttgacgagcagt

SEQ ID NO: 8635 - DNA, 201 bp, Homo sapiens
atgtaagctataggtggagcatcagcagtgagtgaggccattcttcatccttaggatgtggcaatgaaatgatggtgcaagttcctttctcttttgtgaawctttccccccatttcctgtttacatgtaacccaacaaaatgcaatttctagtgccttctgtccaatcagttctttcctctgagtgagacgtacttggcta

SEQ ID NO: 8636 - DNA, 201 bp, Homo sapiens
aatgaaatgatggtgcaagttcctttctcttttgtgaatctttccccccatttcctgtttacatgtaacccaacaaaatgcaatttctagtgccttctgtmcaatcagttctttcctctgagtgagacgtacttggctacagatttctgccttgttttgcgacattgtcccattcacacagatattttgggataataaagg

SEQ ID NO: 8637 - DNA, 201 bp, Homo sapiens; identical to SEQ ID NO: 8624

SEQ ID NO: 8638 - DNA, 201 bp, Homo sapiens; identical to SEQ ID NO: 8625

SEQ ID NO: 8639 - DNA, 201 bp, Homo sapiens
ctgaaagtgtcccagctgcaggagaggacgggacgcactgcacccactgtcatcacctaagaagacaggcctgatgtggtacgtccctccacccccggacycatccaagtcatctgattgaagagcatgacagaaacaaaatgtattcaccaagcattttaggatttgactttttcactaaccagttgacgagcagtgcat

SEQ ID NO: 8640 - DNA, 201 bp, Homo sapiens
cacccccggacccatccaagtcatctgattgaagagcatgacagaaacaaaatgtattcaccaagcattttaggatttgactttttcactaaccagttgaygagcagtgcatttacaaggcactgccaaacaagatgcccttgggagctgtgagggaaagaggacctgcgggcttagatcaatctcaattccttttcatgc

SEQ ID NO: 8641 - DNA, 201 bp, Homo sapiens; identical to SEQ ID NO: 8626

SEQ ID NO: 8642 - DNA, 201 bp, Homo sapiens
agtctgatctactcttattcataatggaacatgtaaatatactgaaaactgtttttcaggagagaaatatgagttggagggaaggaaaagtggttctactwatgttccaaaatcctcatcagagaaggtatgatgttctcaggtgtggaaaatattttttagttgattgagaatgcaggtttaacagaagagataaggggc

SEQ ID NO: 8643 - DNA, 201 bp, Homo sapiens
gaattcaagatggctgtacttcagttgtatgataaaattaatggttctcatgacttgtgtggcatctaaaaataatgtttttatagcatctctctgccacyaaattgttgacttgaattttgggaaaaaaaaaagttggtgttgatatgtatatgtgtgtgtgtatatatgtatttataaacaagtgtgtttgagtaacaa

SEQ ID NO: 8644 - DNA, 201 bp, Homo sapiens
tccttcctcagggccttgtttgggtctgaagccacacagcatcgttgagacagttgcactaacactacaactcttgttccctgcagttttccctgtgcccggtgcctagtgaaagatttgtgtcttgtacatcctcccaaaagacacatcccatttgatttggttttcttctactttagccactgtggtactactagacaa

SEQ ID NO: 8645 - DNA, 201 bp, Homo sapiens
ggaagcagtagtggcagtaacagcagcctggtttcttccaacagcctaagggaaagccatagccacaccgtcacaaacaggagcagcacggacacggcatycatctttggcatcataccagacattatttcattggactgattcccaggccctgctgctcccatccccaccccagatcgaatgaacttggcagaaagaaga

SEQ ID NO: 8646 - DNA, 201 bp, Homo sapiens
atttttctgtcatcactgttccctctcctcccgagtgtgcattcagttaatataatcagttgcttgcttctttcaaagtgctttgaaggtcttgaactcaygtgtgagcatctttatcaactatcccaattgcatgttctccatcacatattctcttatttgctctgtaccccctgagaatatgttttagagatattggaa

SEQ ID NO: 8647 - DNA, 201 bp, Homo sapiens
gcgcttgcgctgacagacgcaagatggcggacagtgcggaactaaagcaaatggttatgagccttagagtttctgaactccaagtactgttgggctacgcygggagaaacaagcacggacgcaaacacgaacttctcacaaaagccctgcatttgctaaaggctggctgtagtcctgctgtgcaaatgaaaattaaggaac

SEQ ID NO: 8648 - DNA, 201 bp, Homo sapiens
aggctggctgtagtcctgctgtgcaaatgaaaattaaggaactctataggcggcggttcccacagaaaatcatgacgcctgcagacttgtccatccccaaygtacattcaagtcctatgccagcaactttgtctccatctaccattccacaactcacttacgatggtcaccctgcatcatcgccattactccctgtttctc

SEQ ID NO: 8649 - DNA, 201 bp, Homo sapiens
gtctactatttgataaacagttgaaattcaagatgtgtttgacccttagtcatttttactctttggttctgagtatacctattttcttagcgtatctgccytgtttatctttttcttcaccttttaacaagtatgacataggaaagtcatttttttttagaattcatggatcagtctgatctactcttattcataatggaa

SEQ ID NO: 8650 - DNA, 201 bp, Homo sapiens; identical to SEQ ID NO: 8642

SEQ ID NO: 8651 - DNA, 201 bp, Homo sapiens; identical to SEQ ID NO: 8643

SEQ ID NO: 8652 - DNA, 201 bp, Homo sapiens; identical to SEQ ID NO: 8644

SEQ ID NO: 8653 - DNA, 201 bp, Homo sapiens; identical to SEQ ID NO: 8645

SEQ ID NO: 8654 - DNA, 201 bp, Homo sapiens; identical to SEQ ID NO: 8646

SEQ ID NO: 8655 - DNA, 201 bp, Homo sapiens
cttcccccagcaccccatcacctgaagaatttgcagcaagtttcaagcaaatggttatgagccttagagtttctgaactccaagtactgttgggctacgcygggagaaacaagcacggacgcaaacacgaacttctcacaaaagccctgcatttgctaaaggctggctgtagtcctgctgtgcaaatgaaaattaaggaac

SEQ ID NO: 8656 - DNA, 201 bp, Homo sapiens; identical to SEQ ID NO: 8648

SEQ ID NO: 8657 - DNA, 201 bp, Homo sapiens; identical to SEQ ID NO: 8649

SEQ ID NO: 8658 - DNA, 201 bp, Homo sapiens
ttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaagga

SEQ ID NO: 8659 - DNA, 201 bp, Homo sapiens
ctccaagcccccgaggagcctgtggtggggctggagacccggctcaggcccctccaccacccttaaagtcctcagaaggtgggaactgaactggcacaggmtgggaaccggctgtgcgctggccacttgattttgccagctgccctgtaattcagctggtgaggaaactgaggcacagactgaggtagaatgattcgccag

SEQ ID NO: 8660 - DNA, 201 bp, Homo sapiens
attacccgggcctccacccagcttggcagactttagacttgaggctggaggaaagggaactgaacgcggttctgggagcagcaagcccacgggtagcagcygaggccccagaatggccaagtttctttcccaagaccaaattaatgagtacaaggaatgcttctccctgtatgacaagcagcagagggggaagataaaagc

SEQ ID NO: 8661 - DNA, 201 bp, Homo sapiens
aaacaagaagacccaaagaaagaaattcttctagccatgttgatggtggacaaggagaagaaaggttacgtcatggcgtccgacctgcggtcaaaactcamgagtctgggggagaagctcacccacaaggaagtggatgatctcttcagggaagcagatatcgaacccaatggcaaagtgaagtatgatgaatttatccac

SEQ ID NO: 8662 - DNA, 201 bp, Homo sapiens
ggcgtcgggcccagtctccatggcagccgagcatttattacccgggcctccacccagcttggcagactttagacttgaggctggaggaaagggaactgaaygcggttctgggagcagcaagcccacgggtagcagccgaggccccagaatggccaagtttctttcccaagaccaaattaatgagtacaaggaatgcttctc

SEQ ID NO: 8663 - DNA, 201 bp, Homo sapiens
aggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaa

SEQ ID NO: 8664 - DNA, 201 bp, Homo sapiens
ggcaagacaacattacccaactatagaagagaggctaactagcaacaataatagatgatttcagccatggtatgagtagatctttaataaaagatttgtaytgattttattaactaccgtgagtccggccctttcaagcatggaaggagcctgcggtttggagtctggcctgggttccagtcctggctctgctgcttccca

SEQ ID NO: 8665 - DNA, 201 bp, Homo sapiens
gcagacggggaggactgaatcccagcctgagagcaccgaagcttgtatccctgcaataccgagccccaagcctgcgagccccggtgcccatctctgagttrggccgtcttggaagggttcccttcctcctacaagatggtgtgtgaggagccttcaatacgacccggggtgtaaagtgtccaactctagtaggggcctgat

SEQ ID NO: 8666 - DNA, 201 bp, Homo sapiens
gtcctcatgtacgtccacgactactacgtgctcaactatgaggccccagcggcagaggcctgagctgcacctgagggcctggcttctcactgccacctcamacccgctgccagagcccacctctcctcctaggcctcgagtgctggggatgggcctggctgcacagcatcctcctctggtcccagggaggcctctctgccc

SEQ ID NO: 8667 - DNA, 201 bp, Homo sapiens
atcctccctctaccccagtgggggctggtgggccctgagatggaggcatctccttgggccctgctgaggatggcagtagtgggtgagctcctggtgggggratgggtgtggggccgactcctccatcccacatgggctcctgtgcctctccctatcagttggccagtggagctcgagaacaaactgttgctgccagataaa

SEQ ID NO: 8668 - DNA, 201 bp, Homo sapiens
tgatggctcagatcccactggcctggttcgtgggccgctttttccagggcaactatggcaacgcagctgtgtggctgtcgctcatcatcggacagccaatwgccgtcctcatgtacgtccacgactactacgtgctcaactatgaggccccagcggcagaggcctgagctgcacctgagggcctggcttctcactgccacc

SEQ ID NO: 8669 - DNA, 201 bp, Homo sapiens
cctcaggtcggccgcggactacaaatggacgagagaggcggccgtccattagttagcggctccggagcaacgcagccgttgtccttgaggccgacgggccygacgcgggcgggttgaacgcgctggtgaggcggtcacccgggctacggcggccggcagggggcagtggcggccgttgtctagggcccggaggtggggccg

SEQ ID NO: 8670 - DNA, 201 bp, Homo sapiens
atgggctcctgtgcctctccctatcagttggccagtggagctcgagaacaaactgttgctgccagataaagcagcaaagcctgctccactgcccagcgcargcccccttcccttcctccaccaggctgagtggagaaccctaaagctacgggacaggctcccgttccccgtgcctacacagggtgctggctctggcagaaa

SEQ ID NO: 8671 - DNA, 201 bp, Homo sapiens
gccccgcatcacctgtccgagtgcgaacaccttgggaagggggttcctggtggtcctgtgacaaccagagacccccagggccaaggaggccactgcagccyggcccttctgtgccctgggcccctcctcattgcagcaccacccaccgcaccaccctgggacagaggaaacacatggaggccatagcatagagcctgtctg

SEQ ID NO: 8672 - DNA, 201 bp, Homo sapiens
cacccaccgcaccaccctgggacagaggaaacacatggaggccatagcatagagcctgtctgtttatagatctctgcctgtcttgtccgtccatccactgkgtgtatatatctgtgtatctctgtggagcggggaacgggacagttgtgtaaaaatccaaaatacaattctgactatgaacaacctgcagggtcagtccag

SEQ ID NO: 8673 - DNA, 201 bp, Homo sapiens
gcctgaatgccgtggctgagctcatgcagtttggagaccgggagttctaccgggactggtggaactccgagtctgtcacctacttctggcagaactggaasatccctgtgcacaagtggtgcatcagacacttctacaagcccatgcttcgacggggcagcagcaagtggatggccaggacaggggtgttcctggcctcgg

SEQ ID NO: 8674 - DNA, 201 bp, Homo sapiens
caggtggtttctctgttcctgaaggatccctatagctggcccgccccatgcctggttattgcggccaatgtctttgctgtggctgcattccaggttgagargcgcctggcggtgggtgccctgacggagcaggcgggactgctgctgcacgtggccaacctggccaccattctgtgtttcccagcggctgtggtcttactg

SEQ ID NO: 8675 - DNA, 201 bp, Homo sapiens; identical to SEQ ID NO: 8670

SEQ ID NO: 8676 - DNA, 201 bp, Homo sapiens
ccctcaataaagaactgcaagcacatgctggtcctggggagtcgggcaggcacggagctagctgcaagcatccgtcttcccccaggaggccactgcagccyggcccttctgtgccctgggcccctcctcattgcagcaccacccaccgcaccaccctgggacagaggaaacacatggaggccatagcatagagcctgtctg

SEQ ID NO: 8677 - DNA, 201 bp, Homo sapiens; identical to SEQ ID NO: 8672

SEQ ID NO: 8678 - DNA, 201 bp, Homo sapiens; identical to SEQ ID NO: 8666

SEQ ID NO: 8679 - DNA, 201 bp, Homo sapiens
gcctgaatgccgtggctgagctcatgcagtttggagaccgggagttctaccgggactggtggaactccgagtctgtcacctacttctggcagaactggaasatccctgtgcacaagtggtgcatcaggtaggtggggtgtgtgtgtgtgtgatgtggaacatggctgtgaacctgaaccgctttccatgccccctcctctg

SEQ ID NO: 8680 - DNA, 201 bp, Homo sapiens; identical to SEQ ID NO: 8667

SEQ ID NO: 8681 - DNA, 201 bp, Homo sapiens; identical to SEQ ID NO: 8668

SEQ ID NO: 8682 - DNA, 201 bp, Homo sapiens; identical to SEQ ID NO: 8674

SEQ ID NO: 8683 - DNA, 201 bp, Homo sapiens; identical to SEQ ID NO: 8669

SEQ ID NO: 8684 - DNA, 201 bp, Homo sapiens; identical to SEQ ID NO: 8666

SEQ ID NO: 8685 - DNA, 201 bp, Homo sapiens; identical to SEQ ID NO: 8667

SEQ ID NO: 8686 - DNA, 201 bp, Homo sapiens; identical to SEQ ID NO: 8668

SEQ ID NO: 8687 - DNA, 201 bp, Homo sapiens; identical to SEQ ID NO: 8669

SEQ ID NO: 8688 - DNA, 201 bp, Homo sapiens; identical to SEQ ID NO: 8670

SEQ ID NO: 8689 - DNA, 201 bp, Homo sapiens; identical to SEQ ID NO: 8676

SEQ ID NO: 8690 - DNA, 201 bp, Homo sapiens; identical to SEQ ID NO: 8672

SEQ ID NO: 8691 - DNA, 201 bp, Homo sapiens; identical to SEQ ID NO: 8673

SEQ ID NO: 8692 - DNA, 201 bp, Homo sapiens; identical to SEQ ID NO: 8674

SEQ ID NO: 8693 - DNA, 201 bp, Homo sapiens; identical to SEQ ID NO: 8670

SEQ ID NO: 8694 - DNA, 201 bp, Homo sapiens; identical to SEQ ID NO: 8676

SEQ ID NO: 8695 - DNA, 201 bp, Homo sapiens; identical to SEQ ID NO: 8672

SEQ ID NO: 8696 - DNA, 201 bp, Homo sapiens; identical to SEQ ID NO: 8666

SEQ ID NO: 8697 - DNA, 201 bp, Homo sapiens; identical to SEQ ID NO: 8667

SEQ ID NO: 8698 - DNA, 201 bp, Homo sapiens; identical to SEQ ID NO: 8668

SEQ ID NO: 8699 - DNA, 201 bp, Homo sapiens; identical to SEQ ID NO: 8674

SEQ ID NO: 8700 - DNA, 201 bp, Homo sapiens; identical to SEQ ID NO: 8669

SEQ ID NO: 8701 - DNA, 201 bp, Homo sapiens
tttctgccagagccagcaccctgtgtaggcacggggaacgggagcctgtcccgtagctttagggttctccactcagcctggtggaggaagggaagggggcytgcgctgggcagtggagcaggctttgctgctttatctggcagcaacagtttgttctcgagctccactggccaactgatagggagaggcacaggagcccat

SEQ ID NO: 8702 - DNA, 201 bp, Homo sapiens
cagacaggctctatgctatggcctccatgtgtttcctctgtcccagggtggtgcggtgggtggtgctgcaatgaggaggggcccagggcacagaagggccrggctgcagtggcctcctgggggaagacggatgcttgcagctagctccgtgcctgcccgactccccaggaccagcatgtgcttgcagttctttattgaggg

SEQ ID NO: 8703 - DNA, 201 bp, Homo sapiens
ctggactgaccctgcaggttgttcatagtcagaattgtattttggatttttacacaactgtcccgttccccgctccacagagatacacagatatatacacmcagtggatggacggacaagacaggcagagatctataaacagacaggctctatgctatggcctccatgtgtttcctctgtcccagggtggtgcggtgggtg

SEQ ID NO: 8704 - DNA, 201 bp, Homo sapiens
tttatctggcagcaacagtttgttctcgagctccactggccaactgatagggagaggcacaggagcccatgtgggatggaggagtcggccccacacccatycccccaccaggagctcacccactactgccatcctcagcagggcccaaggagatgcctccatctcagggcccaccagcccccactggggtagagggaggat

SEQ ID NO: 8705 - DNA, 201 bp, Homo sapiens
cactatggggctagatggggcagaaggagcaggactgtgcatggatgacattccccacatcttaaaaggttgtatgccagacagatatcagtttaattccygtaaaccaattacacctgagcattctacttttatcacctctccatctctgaaggacaggattcactgtgtggcttatgtcttagacatcaactctattga

SEQ ID NO: 8706 - DNA, 201 bp, Homo sapiens
ttggtgggtccagttgggtctggaaagtccagttttttcaattcagtcaagtctatttttcatggccatgtgactggccaagccgtagtggggtctgataycaccagcataaccgagcggtataggatatattctgttaaagatggaaaaaatggaaaatctctgccatttatgttgtgtgacactatggggctagatggg

SEQ ID NO: 8707 - DNA, 201 bp, Homo sapiens
agtttttcgagttgaaggaattaaggataacctagacgacataaagaggataattaaagccagagagcacagaaataggcttctagcagacatcagagacyataggccctatgcagacttggtttcagaaattcgtattcttttggtgggtccagttgggtctggaaagtccagttttttcaattcagtcaagtctatttt

SEQ ID NO: 8708 - DNA, 201 bp, Homo sapiens
agacatcagagactataggccctatgcagacttggtttcagaaattcgtattcttttggtgggtccagttgggtctggaaagtccagttttttcaattcartcaagtctatttttcatggccatgtgactggccaagccgtagtggggtctgatatcaccagcataaccgagcggtataggatatattctgttaaagatgg

SEQ ID NO: 8709 - DNA, 201 bp, Homo sapiens
actatggggctagatggggcagaaggagcaggactgtgcatggatgacattccccacatcttaaaaggttgtatgccagacagatatcagtttaattcccrtaaaccaattacacctgagcattctacttttatcacctctccatctctgaaggacaggattcactgtgtggcttatgtcttagacatcaactctattgac

SEQ ID NO: 8710 - DNA, 201 bp, Homo sapiens
taatttacatgaaagttctacagagccaaatgattccctatggttttcacttcaaaagaaaaatgacaccactgaaatagaaactttactcttaaatacarcaccaaaaattattgatgagcaactggtgtgtcgtttatcgaaaacggatattttcattatatgtcgagataataaaatttatctagataaaatgataac

SEQ ID NO: 8711 - DNA, 201 bp, Homo sapiens
atggttgaaagatgcagccgtcagggatgtactataacaatggcttacattgattacaatatgattgtagcctttatgcttggaaattatattaatttacrtgaaagttctacagagccaaatgattccctatggttttcacttcaaaagaaaaatgacaccactgaaatagaaactttactcttaaatacagcaccaaaa

SEQ ID NO: 8712 - DNA, 201 bp, Homo sapiens
ttactaaagtggatgattgcagtgaggttcttcaagacaactttttaaacatgagtagatctatgacttctcaaagccgggtcatgaatgtccataaaatkctaggcattcctatttccaatattttgatggttggaaattatgcttcagatttggaactggaccccatgaaggatattctcatcctctctgcactgaggc

SEQ ID NO: 8713 - DNA, 201 bp, Homo sapiens
cagatttggaactggaccccatgaaggatattctcatcctctctgcactgaggcagatgctgcgggctgcagatgattttttagaagatttgcctcttgargaaactggtgcaattgagagagcgttacagccctgcatttgagataagttgccttgattctgacatttggcccagcctgtactggtgtgccgcaatgaga

SEQ ID NO: 8714 - DNA, 201 bp, Homo sapiens
atggaaaaaatggaaaatctctgccatttatgttgtgtgacactatggggctagatggggcagaaggagcaggactgtgcatggatgacattccccacatyttaaaaggttgtatgccagacagatatcagtttaattcccgtaaaccaattacacctgagcattctacttttatcacctctccatctctgaaggacagga

SEQ ID NO: 8715 - DNA, 119 bp, Homo sapiens
ctctgaagccacagatctsttaagaactttctgtctccaaaccgtggctgctcgataaatcagacagaacagttaatcctcaatttaagcctgatctaacccctagaaacagatataga

SEQ ID NO: 8716 - DNA, 201 bp, Homo sapiens
tcgtttatcgaaaacggatattttcattatatgtcgagataataaaatttatctagataaaatgataacaagaaacttgaaactaaggttttatggccacygtcagtatttggaatgtgaagtttttcgagttgaaggaattaaggataacctagacgacataaagaggataattaaagccagagagcacagaaataggct

SEQ ID NO: 8717 - DNA, 201 bp, Homo sapiens
agcgtggattttacttatctgtgtattcacagagcttagcacagtgcctggtaatgagcaagcatacttgccattacttttccttcccactctctccaacrtcacattcactttaaatttttctgtatatagaaaggaaaactagcctgggcaacatgatgaaaccccatctccactgcaaaaaaaaaaaaaaaaaataag

SEQ ID NO: 8718 - DNA, 201 bp, Homo sapiens
gtggcgcggcgcccccggagggggccatatctaacggggtttacgtactgccgagcgcggccaacggagacgtgaagcccgtggtgtccagcacgcctttkgtggacttcttgatgcagctggaagattacacgcctacgatcccagatgcagtgactggttactacctgaaccgtgctggctttgaggcctcagacccac

SEQ ID NO: 8719 - DNA, 201 bp, Homo sapiens
acccaacctaaatgtacttatctgtccccatgtccccacaccagcctgttttcataataaactttattgtgacaggcggggctgatccctcccatgttggragacaccatgtggcaagtgacaaagctctgagcccgcccctcttggggccacagtggtagggatgggggaaggggatggaccccatggctggggtagtac

SEQ ID NO: 8720 - DNA, 201 bp, Homo sapiens
gaggagagccagacgcacgctggttccggtctggacggaatcgccgcggagcacggcagaggctagggcggaatggctacggcagcgcagttcgccaaggmtcggtctccgccctgcagcctatttcctctaacccgcagatccactatgggaggaggcggggagcgggctggagagcactaacagagacaggcggggcga

SEQ ID NO: 8721 - DNA, 201 bp, Homo sapiens
ctggggtagtaccatgactggaggcgggggaggcaaccagaggcctgctgctttggggaggtgcattcccccaaccatgtcccgacacctctggagttcargcaaggaccttccagtcctacttgtcctgcatcttctcaaggataggcacaatcatgtcaaatttgggtcgctttgcagggtcttcattcatgcagatct

SEQ ID NO: 8722 - DNA, 201 bp, Homo sapiens
cctcagacccacgcataattcggctcatctccttagctgcccagaaattcatctcagatattgccaatgatgccctacagcactgcaaaatgaagggcacrgcctccggcagctcccggagcaagagcaaggaccgcaagtacactctaaccatggaggacttgacccctgccctcagcgagtatggcatcaatgtgaaga

SEQ ID NO: 8723 - DNA, 201 bp, Homo sapiens
ctttccaaatccactatgaatccttaaaaggctgaataagggaacttgaaacgatgcagacaggcaggcaacccgtagtcgagggacatagggccataaaygtcgaagccaggtcttgagcgtcagacagaatgaggtgtcccagagcggcggaggagagccagacgcacgctggttccggtctggacggaatcgccgcgg

SEQ ID NO: 8724 - DNA, 154 bp, Homo sapiens
gtactaccccagccatggggtccatccccttcccccatccctaccactgtggccccaagaggggcgggctcagagctttgtcacttgccacatggtgtctyccaacatgggagggatcagccccgcctgtcacaataaagtttattatgaaaac

SEQ ID NO: 8725 - DNA, 201 bp, Homo sapiens
gggatgacacccccctgcatctggcagccagtcatggacaccgtgatattgtacagaagctattgcagtacaaggcagacatcaatgcagtgaatgaacaygggaatgtgcccctgcactatgcctgtttttggggccaagatcaagtggcagaggacctggtggcaaatggggcccttgtcagcatctgtaacaagtatg

SEQ ID NO: 8726 - DNA, 174 bp, Homo sapiens
cggaggcccgcgctgcccaagagcgccacgggcggggcggggccggcggcgggctgcgggcgcggccggacggkagttccccggagaaggatcctgcagcccgagtcccgtcctcaggcttccccaatccaggggactcggcgccgggacgctgctatggacgacattttcact

SEQ ID NO: 8727 - DNA, 201 bp, Homo sapiens
cccggctcaggattttctcgcatccaaatgtgctcccagtgctaggtgcctgccagtctccacctgctcctcatcctactctcatcacacactggatgccrtatggatccctctacaatgtactacatgaaggcaccaatttcgtcgtggaccagagccaggctgtgaagtttgctttggacatggcaaggggcatggcct

SEQ ID NO: 8728 - DNA, 201 bp, Homo sapiens
cgtatggatccctctacaatgtactacatgaaggcaccaatttcgtcgtggaccagagccaggctgtgaagtttgctttggacatggcaaggggcatggcyttcctacacacactagagcccctcatcccacgacatgcactcaatagccgtagtgtaatgattgatgaggacatgactgcccgaattagcatggctgatg

SEQ ID NO: 8729 - DNA, 201 bp, Homo sapiens
agatctgcatgaatgaagaccctgcaaagcgacccaaatttgacatgattgtgcctatccttgagaagatgcaggacaagtaggactggaaggtccttgcytgaactccagaggtgtcgggacatggttgggggaatgcacctccccaaagcagcaggcctctggttgcctcccccgcctccagtcatggtactaccccag

SEQ ID NO: 8730 - DNA, 154 bp, Homo sapiens; identical to SEQ ID NO: 8724

SEQ ID NO: 8731 - DNA, 201 bp, Homo sapiens; identical to SEQ ID NO: 8725

SEQ ID NO: 8732 - DNA, 201 bp, Homo sapiens; identical to SEQ ID NO: 8727

SEQ ID NO: 8733 - DNA, 201 bp, Homo sapiens; identical to SEQ ID NO: 8728

SEQ ID NO: 8734 - DNA, 201 bp, Homo sapiens; identical to SEQ ID NO: 8729

SEQ ID NO: 8735 - DNA, 154 bp, Homo sapiens; identical to SEQ ID NO: 8724

SEQ ID NO: 8736 - DNA, 201 bp, Homo sapiens; identical to SEQ ID NO: 8725

SEQ ID NO: 8737 - DNA, 201 bp, Homo sapiens; identical to SEQ ID NO: 8727

SEQ ID NO: 8738 - DNA, 201 bp, Homo sapiens; identical to SEQ ID NO: 8728

SEQ ID NO: 8739 - DNA, 201 bp, Homo sapiens; identical to SEQ ID NO: 8729

SEQ ID NO: 8740 - DNA, 154 bp, Homo sapiens; identical to SEQ ID NO: 8724

SEQ ID NO: 8741 - DNA, 201 bp, Homo sapiens; identical to SEQ ID NO: 8725

SEQ ID NO: 8742 - DNA, 201 bp, Homo sapiens; identical to SEQ ID NO: 8727

SEQ ID NO: 8743 - DNA, 201 bp, Homo sapiens; identical to SEQ ID NO: 8728

SEQ ID NO: 8744 - DNA, 201 bp, Homo sapiens; identical to SEQ ID NO: 8729

SEQ ID NO: 8745 - DNA, 201 bp, Homo sapiens
cgcagactggcggagaaggagaggaacgggcagcctgggcctgggtggaaatcctgccctggaggaagttgtggggagatccactgggacccccaacattytgccctcacctctgtgcccagcctggaaacctacagacaaggaggagttccaccatgagctcacccgtgtctatgacgcaaagatcaccagccatgtgcc

SEQ ID NO: 8746 - DNA, 201 bp, Homo sapiens
acccgtgtctatgacgcaaagatcaccagccatgtgccttagtgtccttcttaacagactcaaaccacatggaccacgaatattctttctgtccagaaggrctactttccacatatagagctccagggactgtcttttctgtattcgctgttcaataaacattgagtgagcacctccccagatggagcatgctggtcctgg

SEQ ID NO: 8747 - DNA, 184 bp, Homo sapiens
gtgccttagtgtccttcttaacagactcaaaccacatggaccacgaatattctttctgtccagaagggctactttccacatatagagctccagggactgtyttttctgtattcgctgttcaataaacattgagtgagcacctccccagatggagcatgctggtcctgggccatgactcaaacca

SEQ ID NO: 8748 - DNA, 201 bp, Homo sapiens
caccactggggccctggagtctgcgatcgccatcgcaaccggaaagatgctgtccttggcggaacagcagctggtggactgcgcccaggacttcaataatyacggctgccaagggggtctccccagccaggctttcgagtatatcctgtacaacaaggggatcatgggtgaagacacctacccctaccagggcaaggatgg

SEQ ID NO: 8749 - DNA, 197 bp, Homo sapiens
tccacgctcgtgccgcccccccccgcgctcccagttgacgctctgggccgccacctccgcggaccctgagcgcaagagccaagccgccagcgctgckatgtgggccacgctgccgctgctctgcgccggggcctggctcctgggagtccccgtctgcggtgccgccgaactgtgcgtgaactccttagagaagtttc

SEQ ID NO: 8750 - DNA, 201 bp, Homo sapiens
aagagccaagccgccagcgctgcgatgtgggccacgctgccgctgctctgcgccggggcctggctcctgggagtccccgtctgcggtgccgccgaactgtscgtgaactccttagagaagtttcacttcaagtcatggatgtctaagcaccgtaagacctacagtacggaggagtaccaccacaggctgcagacgtttgcc

SEQ ID NO: 8751 - DNA, 201 bp, Homo sapiens
aggaggagttccaccatgagctcacccgtgtctatgacgcaaagatcaccagccatgtgccttagtgtccttcttaacagactcaaaccacatggaccacraatattctttctgtccagaagggctactttccacatatagagctccagggactgtcttttctgtattcgctgttcaataaacattgagtgagcacctccc

SEQ ID NO: 8752 - DNA, 201 bp, Homo sapiens
cctgccctggaggaagttgtggggagatccactgggacccccaacattctgccctcacctctgtgcccagcctggaaacctacagacaaggaggagttccmccatgagctcacccgtgtctatgacgcaaagatcaccagccatgtgccttagtgtccttcttaacagactcaaaccacatggaccacgaatattctttct

SEQ ID NO: 8753 - DNA, 201 bp, Homo sapiens
ccctgagcgcaagagccaagccgccagcgctgcgatgtgggccacgctgccgctgctctgcgccggggcctggctcctgggagtccccgtctgcggtgccrccgaactgtgcgtgaactccttagagaagtttcacttcaagtcatggatgtctaagcaccgtaagacctacagtacggaggagtaccaccacaggctgca

SEQ ID NO: 8754 - DNA, 201 bp, Homo sapiens
gtgaaaaatcagggtgcctgcggcagttgctggactttctccaccactggggccctggagtctgcgatcgccatcgcaaccggaaagatgctgtccttggsggaacagcagctggtggactgcgcccaggacttcaataatcacggctgccaagggggtctccccagccaggctttcgagtatatcctgtacaacaagggg

SEQ ID NO: 8755 - DNA, 201 bp, Homo sapiens
tggactggcggaaaaaaggaaattttgtctcacctgtgaaaaatcagggtgcctgcggcagttgctggactttctccaccactggggccctggagtctgcratcgccatcgcaaccggaaagatgctgtccttggcggaacagcagctggtggactgcgcccaggacttcaataatcacggctgccaagggggtctcccca

SEQ ID NO: 8756 - DNA, 201 bp, Homo sapiens
cggaaagaacatgtgtggcctggctgcctgcgcctcctaccccatccctctggtgtgagccgtggcagccgcagcgcagactggcggagaaggagaggaaygggcagcctgggcctgggtggaaatcctgccctggaggaagttgtggggagatccactgggacccccaacattctgccctcacctctgtgcccagcctgg

SEQ ID NO: 8757 - DNA, 201 bp, Homo sapiens
taccccatccctctggtgtgagccgtggcagccgcagcgcagactggcggagaaggagaggaacgggcagcctgggcctgggtggaaatcctgccctggargaagttgtggggagatccactgggacccccaacattctgccctcacctctgtgcccagcctggaaacctacagacaaggaggagttccaccatgagctca

SEQ ID NO: 8758 - DNA, 201 bp, Homo sapiens
ctcccagttgacgctctgggccgccacctccgcggaccctgagcgcaagagccaagccgccagcgctgcgatgtgggccacgctgccgctgctctgcgccrgggcctggctcctgggagtccccgtctgcggtgccgccgaactgtgcgtgaactccttagagaagtttcacttcaagtcatggatgtctaagcaccgtaa

SEQ ID NO: 8759 - DNA, 201 bp, Homo sapiens
tcacaatctatgacgaggaagcgatggtggaggctgtggccctctacaaccctgtgagctttgcctttgaggtgactcaggacttcatgatgtatagaacsggcatctactccagtacttcctgccataaaactccagataaagtaaaccatgcagtactggctgttgggtatggagaaaaaaatgggatcccttactgga

SEQ ID NO: 8760 - DNA, 201 bp, Homo sapiens
atcgagcgcggaaagaacatgtgtggcctggctgcctgcgcctcctaccccatccctctggtgtgagccgtggcagccgcagcgcagactggcggagaagkagaggaacgggcagcctgggcctgggtggaaatcctgccctggaggaagttgtggggagatccactgggacccccaacattctgccctcacctctgtgcc

SEQ ID NO: 8761 - DNA, 201 bp, Homo sapiens
ctgtgcccagcctggaaacctacagacaaggaggagttccaccatgagctcacccgtgtctatgacgcaaagatcaccagccatgtgccttagtgtccttyttaacagactcaaaccacatggaccacgaatattctttctgtccagaagggctactttccacatatagagctccagggactgtcttttctgtattcgctg

SEQ ID NO: 8762 - DNA, 201 bp, Homo sapiens
agacacgttccactgtgcccggggcacccccatgcaccccaaggagcgatgccgcgtgtggtagccaaggccctgccgcgctgtgcggcccacgcccaccygctgctcggaggcatctgtgcgaaggtgcagctagcggcgacccagtgtacgtcccgccccggccaaccatgccaagcctgcctgccaggcctctgcgcc

SEQ ID NO: 8763 - DNA, 201 bp, Homo sapiens
agccactcctgagtgagcaaaggttcctccgcggtgctctcccgtccagagccctgctgatggggaagtccgaaggcccagtggggatggtggagagcgcyggccgtgcagggcagaagcgcccggggttcctggagggggggctgctgctgctgctgctgctggtgaccgctgccctggtggccttgggtgtcctctacg

SEQ ID NO: 8764 - DNA, 201 bp, Homo sapiens
cgctgccctggtggccttgggtgtcctctacgccgaccgcagagggaagcagctgccacgccttgctagccggctgtgcttcttacaggaggagaggaccwttgtaaaacgaaaaccccgagggatcccagaggcccaagaggtgagcgaggtctgcaccacccctggctgcgtgatagcagctgccaggatcctccagaa

SEQ ID NO: 8765 - DNA, 201 bp, Homo sapiens
gagctgggctggatggacgaggagtccaagaagaaggcgcaggagaaggccatgagcatccgggagcagatcgggcaccctgactacatcctggaggagaygaacaggcgcctggacgaggagtactccaatctgaacttctcagaggacctgtactttgagaacagtctgcagaacctcaaggtgggcgcccagcggagc

SEQ ID NO: 8766 - DNA, 201 bp, Homo sapiens
ctcaccccaactccaacccactgggacccagtctccaggggcctgactgtgggcggcagccactcctgagtgagcaaaggttcctccgcggtgctctcccstccagagccctgctgatggggaagtccgaaggcccagtggggatggtggagagcgccggccgtgcagggcagaagcgcccggggttcctggagggggggc

SEQ ID NO: 8767 - DNA, 201 bp, Homo sapiens
aggcctctgcgcctggcctagggtgcagccacctgcctgacacccagggatgagcagtgtccagtgcagtacctggaccggagccccctccacagacaccmgcggggctcagtgcccccgtcacagctctgtagagacaatcaactgtgtcctgcccaccctccaaggtgcattgtcttccagtatctacagcttcagact

SEQ ID NO: 8768 - DNA, 201 bp, Homo sapiens
tacaggaggagaggacctttgtaaaacgaaaaccccgagggatcccagaggcccaagaggtgagcgaggtctgcaccacccctggctgcgtgatagcagcygccaggatcctccagaacatggacccgaccacggaaccgtgtgacgacttctaccagtttgcatgcggaggctggctgcggcgccacgtgatccctgaga

SEQ ID NO: 8769 - DNA, 201 bp, Homo sapiens
cgttccctggagacagcaagagcatggtcagagaactcattgacaaggtgcggacagtgtttgtggagacgctggacgagctgggctggatggacgaggartccaagaagaaggcgcaggagaaggccatgagcatccgggagcagatcgggcaccctgactacatcctggaggagatgaacaggcgcctggacgaggagt

SEQ ID NO: 8770 - DNA, 201 bp, Homo sapiens
tccactgtgcccggggcacccccatgcaccccaaggagcgatgccgcgtgtggtagccaaggccctgccgcgctgtgcggcccacgcccacccgctgctcrgaggcatctgtgcgaaggtgcagctagcggcgacccagtgtacgtcccgccccggccaaccatgccaagcctgcctgccaggcctctgcgcctggcctag

SEQ ID NO: 8771 - DNA, 201 bp, Homo sapiens
aggggcctgactgtgggcggcagccactcctgagtgagcaaaggttcctccgcggtgctctcccgtccagagccctgctgatggggaagtccgaaggcccmgtggggatggtggagagcgccggccgtgcagggcagaagcgcccggggttcctggagggggggctgctgctgctgctgctgctggtgaccgctgccctgg

SEQ ID NO: 8772 - DNA, 201 bp, Homo sapiens
aagcctacctgcagttcatggtgtcagtggccacgttgctgcgggaggatgcaaacctgcccagggacagctgcctggtgcaggaggacatggtgcaggtkctggagctggagacacagctggccaaggccacggtaccccaggaggagagacacgacgtcatcgccttgtaccaccggatgggactggaggagctgcaaa

SEQ ID NO: 8773 - DNA, 201 bp, Homo sapiens
tattccctgccgggatcctccagccccccttcttcagcaaggagcagccacaggccttgaactttggaggcattgggatggtgatcgggcacgagatcacrcacggctttgacgacaatggccggaacttcgacaagaatggcaacatgatggattggtggagtaacttctccacccagcacttccgggagcagtcagagt

SEQ ID NO: 8774 - DNA, 201 bp, Homo sapiens
gcaagagcatggtcagagaactcattgacaaggtgcggacagtgtttgtggagacgctggacgagctgggctggatggacgaggagtccaagaagaaggcrcaggagaaggccatgagcatccgggagcagatcgggcaccctgactacatcctggaggagatgaacaggcgcctggacgaggagtactccaatctgaact

SEQ ID NO: 8775 - DNA, 201 bp, Homo sapiens; identical to SEQ ID NO: 8762

SEQ ID NO: 8776 - DNA, 179 bp, Homo sapiens
gttcctccgcggtgctctcccgtccagagccctgctgatggggaagtccgaaggcccagtggggatggtggagagcgcyggccgtgcagggcagaagcgcccggggttcctggagggggggctgctgctgctgctgctgctggtgaccgctgccctggtggccttgggtgtcctctacg

SEQ ID NO: 8777 - DNA, 201 bp, Homo sapiens; identical to SEQ ID NO: 8764

SEQ ID NO: 8778 - DNA, 201 bp, Homo sapiens; identical to SEQ ID NO: 8765

SEQ ID NO: 8779 - DNA, 122 bp, Homo sapiens
gttcctccgcggtgctctcccstccagagccctgctgatggggaagtccgaaggcccagtggggatggtggagagcgccggccgtgcagggcagaagcgcccggggttcctggagggggggc

SEQ ID NO: 8780 - DNA, 201 bp, Homo sapiens; identical to SEQ ID NO: 8767

SEQ ID NO: 8781 - DNA, 201 bp, Homo sapiens; identical to SEQ ID NO: 8768

SEQ ID NO: 8782 - DNA, 201 bp, Homo sapiens; identical to SEQ ID NO: 8769

SEQ ID NO: 8783 - DNA, 201 bp, Homo sapiens; identical to SEQ ID NO: 8770

SEQ ID NO: 8784 - DNA, 158 bp, Homo sapiens
gttcctccgcggtgctctcccgtccagagccctgctgatggggaagtccgaaggcccmgtggggatggtggagagcgccggccgtgcagggcagaagcgcccggggttcctggagggggggctgctgctgctgctgctgctggtgaccgctgccctgg

SEQ ID NO: 8785 - DNA, 201 bp, Homo sapiens; identical to SEQ ID NO: 8772

SEQ ID NO: 8786 - DNA, 201 bp, Homo sapiens; identical to SEQ ID NO: 8773

SEQ ID NO: 8787 - DNA, 201 bp, Homo sapiens; identical to SEQ ID NO: 8774

SEQ ID NO: 8788 - DNA, 201 bp, Homo sapiens; identical to SEQ ID NO: 8763

SEQ ID NO: 8789 - DNA, 201 bp, Homo sapiens; identical to SEQ ID NO: 8764

SEQ ID NO: 8790 - DNA, 201 bp, Homo sapiens; identical to SEQ ID NO: 8765

SEQ ID NO: 8791 - DNA, 201 bp, Homo sapiens; identical to SEQ ID NO: 8766

SEQ ID NO: 8792 - DNA, 201 bp, Homo sapiens; identical to SEQ ID NO: 8768

SEQ ID NO: 8793 - DNA, 201 bp, Homo sapiens; identical to SEQ ID NO: 8769

SEQ ID NO: 8794 - DNA, 201 bp, Homo sapiens; identical to SEQ ID NO: 8771

SEQ ID NO: 8795 - DNA, 201 bp, Homo sapiens; identical to SEQ ID NO: 8772

SEQ ID NO: 8796 - DNA, 201 bp, Homo sapiens; identical to SEQ ID NO: 8773

SEQ ID NO: 8797 - DNA, 201 bp, Homo sapiens; identical to SEQ ID NO: 8774

SEQ ID NO: 8798 - DNA, 201 bp, Homo sapiens; identical to SEQ ID NO: 8762

SEQ ID NO: 8799 - DNA, 201 bp, Homo sapiens; identical to SEQ ID NO: 8763

SEQ ID NO: 8800 - DNA, 201 bp, Homo sapiens; identical to SEQ ID NO: 8764

SEQ ID NO: 8801 - DNA, 201 bp, Homo sapiens; identical to SEQ ID NO: 8765

SEQ ID NO: 8802 - DNA, 201 bp, Homo sapiens; identical to SEQ ID NO: 8766

SEQ ID NO: 8803 - DNA, 201 bp, Homo sapiens; identical to SEQ ID NO: 8767

SEQ ID NO: 8804 - DNA, 201 bp, Homo sapiens; identical to SEQ ID NO: 8768

SEQ ID NO: 8805 - DNA, 201 bp, Homo sapiens; identical to SEQ ID NO: 8769

SEQ ID NO: 8806 - DNA, 201 bp, Homo sapiens; identical to SEQ ID NO: 8770

SEQ ID NO: 8807 - DNA, 201 bp, Homo sapiens; identical to SEQ ID NO: 8771

SEQ ID NO: 8808 - DNA, 201 bp, Homo sapiens; identical to SEQ ID NO: 8772

SEQ ID NO: 8809 - DNA, 201 bp, Homo sapiens; identical to SEQ ID NO: 8773

SEQ ID NO: 8810 - DNA, 201 bp, Homo sapiens; identical to SEQ ID NO: 8774

SEQ ID NO: 8811 - DNA, 201 bp, Homo sapiens
ggcgcagaggcctggcaggcaggcttggcatggttggccggggcgggacgtacactgggtcgccgctagctgcaccttcgcacagatgcctccgagcagcrggtgggcgtgggccgcacagcgcggcagggccttggctaccacacgcggcatcgctccttggggtgcatgggggtgccccgggcacagtggaacgtgtct

SEQ ID NO: 8812 - DNA, 201 bp, Homo sapiens
agtctgaagctgtagatactggaagacaatgcaccttggagggtgggcaggacacagttgattgtctctacagagctgtgacgggggcactgagccccgckggtgtctgtggagggggctccggtccaggtactgcactggacactgctcatccctgggtgtcaggcaggtggctgcaccctaggccaggcgcagaggcct

SEQ ID NO: 8813 - DNA, 201 bp, Homo sapiens
tttcagggcagagatgggcttgattccacctggtggggtgggtggaccctggagactctcaggtgatgggccagcctgccccaaggctctttactgatgtyagaatcattgtttgcacctgctgggtatggcctttggggcggccggcccgggagggtcttagtctaattaggtgtgtccagcttcttggccacctttccc

SEQ ID NO: 8814 - DNA, 201 bp, Homo sapiens
ctaggccaggcgcagaggcctggcaggcaggcttggcatggttggccggggcgggacgtacactgggtcgccgctagctgcaccttcgcacagatgcctcygagcagcgggtgggcgtgggccgcacagcgcggcagggccttggctaccacacgcggcatcgctccttggggtgcatgggggtgccccgggcacagtgga

SEQ ID NO: 8815 - DNA, 201 bp, Homo sapiens
ctactaaaaatacaaaaaattagccgggcgtggtggcgggcgcctgtagtcccagctactcgggaggctgatgcagaagaatggcgtgaacccggaaggcrgagcttgcagtgagccgagatcacgccactgcactccagcctgggtgacagagcgagactctggctcataaaataataataataataaataaataaaaaa

SEQ ID NO: 8816 - DNA, 201 bp, Homo sapiens
caggcaggagctgagcatggggtgggcagtgaggtccctgtaccagcgactcctgccccggttcaaccctaccagcttgtggtaacttactgtcacatagstctgacgttttgttgtaataaatgttttcaggccgggcactgtggctcacgcctgtaatcccagcactttgggagaccgaggcaggtggatcacgaggtc

SEQ ID NO: 8817 - DNA, 201 bp, Homo sapiens
cacgtgcccgcccgccagctgctgctgaactgccgcctggtctgcagcctctggcgggacctcatcgacctcatgaccctctggaaacgcaagtgcctgcragagggcttcatcaccaaggactgggaccagcccgtggccgactggaaaatcttctacttcctacggagcctgcataggaacctcctgcgcaacccgtgt

SEQ ID NO: 8818 - DNA, 201 bp, Homo sapiens
taaggactggtttgctgccagagccgactgtggctgcacctaccaactcaaagtgcagctggcctcggctgactacttcgtgttggcctccttcgagcccmcacctgtgaccatccaacagtggaacaatgccacatggacagaggtctcctacaccttctcagactacccccggggtgtccgctacatcctcttccagca

SEQ ID NO: 8819 - DNA, 201 bp, Homo sapiens
acctcatcgacctcatgaccctctggaaacgcaagtgcctgcgagagggcttcatcaccaaggactgggaccagcccgtggccgactggaaaatcttctayttcctacggagcctgcataggaacctcctgcgcaacccgtgtgctgaagaggatatgtttgcatggcaaattgatttcaatggtggggaccgctggaagg

SEQ ID NO: 8820 - DNA, 201 bp, Homo sapiens
ggcggagccacccgaaaggctccggtcgggggcgggaacaggatcggcccgcgggctggcgtcgataggctgccgcagagacagggcgggctctgctaagsgacgcgcctcgccgtggggcggtgcctgcgcctgagcctctacgagagggaaggaacgctgctccgagctccgcgtcgcgtcgcgtagattcgcgtcgcc

SEQ ID NO: 8821 - DNA, 201 bp, Homo sapiens
ttctcttttaatgaggaccaatgtacagttgaaataactggaacaaattatttttggtgtgtgtgacaattctgtttttaatgctatttgaacaagtgggycattagccagatttgtctttttgttgtaaaacaaaatttgactaattttacatgtttataaatcttatgctctcactgtttgtttttatttaaattacaa

SEQ ID NO: 8822 - DNA, 201 bp, Homo sapiens
ccgaagcccccagccagggcggggcggcgcagcccgagctcccggacccggaagaagcgccatctcccgcctccaccatggagcccaccgcaccgtccctsaccgaggaggacctcactgaagtgaagaaggacgccttagaaaatttacgtgtatacctgtgtgagaaaatcatagctgagagacattttgatcatctac

SEQ ID NO: 8823 - DNA, 201 bp, Homo sapiens
gcagagacagggcgggctctgctaagggacgcgcctcgccgtggggcggtgcctgcgcctgagcctctacgagagggaaggaacgctgctccgagctccgsgtcgcgtcgcgtagattcgcgtcgccgtcgacctcagaggcggggccggaagcgctacggtttgacccccgagtccctctgttcccgaaggggcggccgt

SEQ ID NO: 8824 - DNA, 201 bp, Homo sapiens
aaactgagggcatccactgtcatgtaccatccagaaggagaatccagcacgacgccctttttttctactaattcttctctgaatttgcctgttctagaagwaggcagaactgaaaataccatcttctcttcaactacacttcccagacctggggacccaggggctcctcctttgccaccagatctacagttagaagaagaa

SEQ ID NO: 8825 - DNA, 201 bp, Homo sapiens
agtctcccccgacgacctgcgcaggcgtggcttgaggaaacgcccgctgtgggcggagccacccgaaaggctccggtcgggggcgggaacaggatcggccygcgggctggcgtcgataggctgccgcagagacagggcgggctctgctaagggacgcgcctcgccgtggggcggtgcctgcgcctgagcctctacgagagg

SEQ ID NO: 8826 - DNA, 201 bp, Homo sapiens
ggcttgaggaaacgcccgctgtgggcggagccacccgaaaggctccggtcgggggcgggaacaggatcggcccgcgggctggcgtcgataggctgccgcaragacagggcgggctctgctaagggacgcgcctcgccgtggggcggtgcctgcgcctgagcctctacgagagggaaggaacgctgctccgagctccgcgtc

SEQ ID NO: 8827 - DNA, 201 bp, Homo sapiens
ggcagaactgaaaataccatcttctcttcaactacacttcccagacctggggacccaggggctcctcctttgccaccagatctacagttagaagaagaagraacttgtgcaaactctagtgagatgtttcttcccttaagatcacgtactgtttcacgacaatgacactttattgccttttaatttttaatgatgacaaaa

SEQ ID NO: 8828 - DNA, 201 bp, Homo sapiens
tgccaccagatctacagttagaagaagaaggaacttgtgcaaactctagtgagatgtttcttcccttaagatcacgtactgtttcacgacaatgacacttyattgccttttaatttttaatgatgacaaaaaatgttttaaagaatatgactttttataaaatggctgtaatcatttgtttacatttgatgcatgtctttt

SEQ ID NO: 8829 - DNA, 201 bp, Homo sapiens
aaacacatttgttaaatgaaaggattcatcctaaagttaaggatggttaagtaaatcggatggaagatgatgaaaaattaagcaattagaaaaaaactgtycttgtgtaatgtgtcaacatggaaacaggacataatgtaaacatcagaatcccttgctgtgattctggtttttgtggctctggttacattgtttttttgt

SEQ ID NO: 8830 - DNA, 201 bp, Homo sapiens
tcgcgtagattcgcgtcgccgtcgacctcagaggcggggccggaagcgctacggtttgacccccgagtccctctgttcccgaaggggcggccgtctttctsccgacccgctccgcctcctctccttcttccccattacccggaggccgaagcccccagccagggcggggcggcgcagcccgagctcccggacccggaagaa

SEQ ID NO: 8831 - DNA, 201 bp, Homo sapiens
tttggtgtgtgtgacaattctgtttttaatgctatttgaacaagtgggccattagccagatttgtctttttgttgtaaaacaaaatttgactaattttacrtgtttataaatcttatgctctcactgtttgtttttatttaaattacaattttatctgtttcctgacattgtctcctatatatttctattattaattgcaa

SEQ ID NO: 8832 - DNA, 201 bp, Homo sapiens
attctgtttttaatgctatttgaacaagtgggccattagccagatttgtctttttgttgtaaaacaaaatttgactaattttacatgtttataaatcttaygctctcactgtttgtttttatttaaattacaattttatctgtttcctgacattgtctcctatatatttctattattaattgcaaaaacatagaaatggaa

SEQ ID NO: 8833 - DNA, 201 bp, Homo sapiens
acagctgttttcctagcacctagaacagtgtctggcacatagtggacattcaaaacacatttgttaaatgaaaggattcatcctaaagttaaggatggttmagtaaatcggatggaagatgatgaaaaattaagcaattagaaaaaaactgtccttgtgtaatgtgtcaacatggaaacaggacataatgtaaacatcaga

SEQ ID NO: 8834 - DNA, 201 bp, Homo sapiens
tgtaatgtgtcaacatggaaacaggacataatgtaaacatcagaatcccttgctgtgattctggtttttgtggctctggttacattgtttttttgtgtgttttttttttttttttgctttcccgtttcttaaacattggcgttcccaagtttctccttggtcctcctgtcatttttatctactctcgtagcttcaaatacc

SEQ ID NO: 8835 - DNA, 201 bp, Homo sapiens
aggaaagagatttttattggttttgttcacagctgttttcctagcacctagaacagtgtctggcacatagtggacattcaaaacacatttgttaaatgaarggattcatcctaaagttaaggatggttaagtaaatcggatggaagatgatgaaaaattaagcaattagaaaaaaactgtccttgtgtaatgtgtcaacat

SEQ ID NO: 8836 - DNA, 201 bp, Homo sapiens
gactgattttaatagggaatatatctctatttgagaatagacccttactaggaagaacgttttttcctcagtgcatttgtgctagaaattttcaagagtckaatagtctttgccagtcattcagcagcaaattttcagcattaagctgttcctgttcagtaataaaaccggtcactgatgggaaaactgccaatatagaaa

SEQ ID NO: 8837 - DNA, 201 bp, Homo sapiens
aaactgaagccaggaatgaagatgaaatgtataaaattctcttgaatgattatgaatatcgtcagaaacaaatcctaatggaaaatgcagaacttaagaargttcttcaacaaatgaaaaaggaaatgatttctcttctttctccccaaaagaagaaacctagagaaagagtagatgatagtacaggaactgttatttccg

SEQ ID NO: 8838 - DNA, 201 bp, Homo sapiens
aagagacagacagttacaatgtaagaacaggaatttgcatcagctactaaagaatgagaaagatgaggtgcaaaaattacaaaatatcattgcaagtcgarctactcagtataatcatgatatgaagagaaaagagcgtgaatataataaactgaaggaacgtctacatcaacttgttatgaacaagaaagataagaaaat

SEQ ID NO: 8839 - DNA, 201 bp, Homo sapiens
atgacaatggagttctagaaagcagcatctgttttttgttgcgtgtttccattttaaagtgagttgagttctcaaattggaaagaaagattccttgagacktacttttaaaatctaaagtgtgaaagaaacagcagagtaaaagccagactcattgcaccttcaatgtctgcatagatccagaagttgtacattttaccta

SEQ ID NO: 8840 - DNA, 201 bp, Homo sapiens
gggaaaacacattttgtgcgcatgatgaagagagcaccgtgaatctagtcttgactgcccctggtggaacatttgaaagcccttgggactccaggagagakgtttttgcagcatgtatgctaaatttgtgagttagcaagaccctgctgtgattactatgttgtacagatcttcaaagtatattgcctaatatgagtcatg

SEQ ID NO: 8841 - DNA, 201 bp, Homo sapiens
aaagcaaaactatctctcaatatacctcagaaacaaagatgtctccatcaagtttatactcacagcaagtgctatgttcttcaatacctttatcgaaaaaygtgcacagttttttcagtgccttctgcacagaagataatattgaacagagtatctcatatcttgatcaggaattgactacttttggttttccttcattat

SEQ ID NO: 8842 - DNA, 201 bp, Homo sapiens
tatctgaacatagttcaatcaatgtactgaatataactgctgaagaaattaaaccaaatcaggttggaggagaatgtacaaatcaaaaatggagtgtggcrtcaagacctggatcacaggaaggttgctatagtggatgctccttgagctacacaaattctcatgtagaaaaagatgacttaccttagacatgtggactgg

SEQ ID NO: 8843 - DNA, 201 bp, Homo sapiens
agacttttgccagacacgttcctgcatatctgaacatagttcaatcaatgtactgaatataactgctgaagaaattaaaccaaatcaggttggaggagaaygtacaaatcaaaaatggagtgtggcatcaagacctggatcacaggaaggttgctatagtggatgctccttgagctacacaaattctcatgtagaaaaaga

SEQ ID NO: 8844 - DNA, 201 bp, Homo sapiens
tgattatgttaagaggctttaagatttaaaagtttcacacaaccataagtatagtatttcatgccagtaaaatttttttagtggtattctgtttacagatrtattaggaccattgatgcattacatttaagaattctctttaatacatctgggcaataaatattgaaaggtattccatgaagctgagttctttagataatc

SEQ ID NO: 8845 - DNA, 201 bp, Homo sapiens
ttttgtatatgtagaatattataatttttaaaaggactattgatgatagaagaataggggcaagacgacaaaagtacctttgaataaaacaatttaagaarttggtttaagatattggatgatagaagatatttaagatatctagatggtgatattttccttacaagatgggaggtatttaccactgaagaaatatgataa

SEQ ID NO: 8846 - DNA, 201 bp, Homo sapiens; identical to SEQ ID NO: 8841

SEQ ID NO: 8847 - DNA, 201 bp, Homo sapiens; identical to SEQ ID NO: 8842

SEQ ID NO: 8848 - DNA, 201 bp, Homo sapiens; identical to SEQ ID NO: 8843

SEQ ID NO: 8849 - DNA, 201 bp, Homo sapiens
ttttgtatatgtagaatattataatttttaaaaggactattgatgatagaagaataggggcaagacgacaaaagtacctttgaataaaacaatttaagaarttggtttaagatattggatgatagaagatatttaagatatctagatggtgatattttccttacaagatgggtaccagtatagtaatatctgtatactaac

SEQ ID NO: 8850 - DNA, 201 bp, Homo sapiens; identical to SEQ ID NO: 8840

SEQ ID NO: 8851 - DNA, 201 bp, Homo sapiens; identical to SEQ ID NO: 8839

SEQ ID NO: 8852 - DNA, 201 bp, Homo sapiens; identical to SEQ ID NO: 8838

SEQ ID NO: 8853 - DNA, 201 bp, Homo sapiens; identical to SEQ ID NO: 8837

SEQ ID NO: 8854 - DNA, 201 bp, Homo sapiens
tgaataaaacaatttaagaaattggtttaagatattggatgatagaagatatttaagatatctagatggtgatattttccttacaagatgggtaccagtayagtaatatctgtatactaactagggctttgtattgtcaataattttttaataattttttaatgaggtatttaccactgaagaaatatgataatataaaac

SEQ ID NO: 8855 - DNA, 201 bp, Homo sapiens; identical to SEQ ID NO: 8844

SEQ ID NO: 8856 - DNA, 201 bp, Homo sapiens
tgctggtgctggggaagcacctgggcatccccaagccctttgggcccatcatcaatggctgctgctgcctggaggagaaggtgcggtccctgctggagcckctgggcctccactgcaccttcattgatgacttcactccataccacatgctgcatggggaggtgcactgtggcaccaatgtgtgcagaaagcccttctctt

SEQ ID NO: 8857 - DNA, 201 bp, Homo sapiens
tgagctttgtccctgcccccgatgggaagggcttccggatgctcctggccagccctggggcctgcttcaagctcttccaggaaaagcagaagtgtggccaygggagggccctcctgttccagggggttgttgatgatgagcaggtcaagaccatctccatcaaccaggtgctctccaataaagacctcatcaactacaata

SEQ ID NO: 8858 - DNA, 201 bp, Homo sapiens
ctgcaccttcattgatgacttcactccataccacatgctgcatggggaggtgcactgtggcaccaatgtgtgcagaaagcccttctctttcaagtggtggmacatggtgccctgagacagctcccacccaccatcctgtccccctggggcgggcattggcccaggtggtggagacagagacaggcccctgaacgataagca

SEQ ID NO: 8859 - DNA, 201 bp, Homo sapiens
cgactggaaccgtgaggtgctgaagcgggagctgggcctggcagagtgtgacatcattgacatcccacagctcttcaagaccgagaggaaaaaagcaacgrccttcttccctgacttggtgaacatgctggtgctggggaagcacctgggcatccccaagccctttgggcccatcatcaatggctgctgctgcctggagga

SEQ ID NO: 8860 - DNA, 201 bp, Homo sapiens
ttcactgacactgtggtgttccgagtggcaccctggatcatgacgcccagcactctgccacccctagaggtgtatgtgtgccgtgtgaggaacaacacgtrttttgtggatgcggtggcagagctggccaggaaggccggctgcaagctgaccatctgcccacaggccgagaaccgcaacgaccgctggatccaggatgag

SEQ ID NO: 8861 - DNA, 201 bp, Homo sapiens
cctgacttggtgaacatgctggtgctggggaagcacctgggcatccccaagccctttgggcccatcatcaatggctgctgctgcctggaggagaaggtgcrgtccctgctggagccgctgggcctccactgcaccttcattgatgacttcactccataccacatgctgcatggggaggtgcactgtggcaccaatgtgtgc

SEQ ID NO: 8862 - DNA, 201 bp, Homo sapiens
aggtctgtgagtggcctggactcctttgggaacctggaggtcagccctccagtggtggccaatgggaaagagtaccccctggggaggatcctcattggggrcaacctgcctgggtcaagtggccgcagggtcacccaggtggtgcgggacttcctccatgcccagaaggtgcagccccccgtggagctctttgtggactgg

SEQ ID NO: 8863 - DNA, 201 bp, Homo sapiens
gtgtgtggctggcgtggagaccctcgtggacatttatgggtcagtgcctgagggcacagaaatgtttgaggtctatgggacgcctggcgtggacatctacrtctctcccaacatggagaggggccgggagcgtgcagacaccaggcggtggcgctttgacgcgactttggagatcatcgtggtcatgaactcccccagcaa

SEQ ID NO: 8864 - DNA, 155 bp, Homo sapiens
gcagtgttggggttggcggccacagctaagtccaacaccagcatgtcgctgcagmgaatcgtgcgtgtgtccctggagcatcccaccagcgcggtgtgtgtggctggcgtggagaccctcgtggacatttatgggtcagtgcctgagggcacaga

SEQ ID NO: 8865 - DNA, 201 bp, Homo sapiens
tgtcctccatacctccagctatgatgccaaacgggcacaggtcttccacatctgcggtcctgaggatgtgtgtgaggcctataggcatgtgctgggccaarataaggtgtcctatgaggtaccccgcttgcatggggatgaggagcgcttcttcgtggaaggcctgtccttccctgatgccggcttcacaggactcatctc

SEQ ID NO: 8866 - DNA, 110 bp, Homo sapiens
gcagtgttgrggttggcggccacagctaagtccaacaccagcatgtcgctgcagagaatcgtgcgtgtgtccctggagcatcccaccagcgcggtgtgtgtggctggcgt

SEQ ID NO: 8867 - DNA, 201 bp, Homo sapiens
gcccacaggccgagaaccgcaacgaccgctggatccaggatgagatggagctgggctacgttcaggcgccgcacaagaccctcccggtggtctttgactcyccaaggaatggggaactgcaggatttcccttacaaaagaatcctgggtccagattttggttacgtgactcgggaaccacgcgacaggtctgtgagtggcc

SEQ ID NO: 8868 - DNA, 201 bp, Homo sapiens
tcccggtggtctttgactccccaaggaatggggaactgcaggatttcccttacaaaagaatcctgggtccagattttggttacgtgactcgggaaccacgygacaggtctgtgagtggcctggactcctttgggaacctggaggtcagccctccagtggtggccaatgggaaagagtaccccctggggaggatcctcattg

SEQ ID NO: 8869 - DNA, 201 bp, Homo sapiens
acatggttgactatggtgatccaccttgtgatggttaatattaggtgtctggagaaggttgcttcattggccctgggacttctctctgcaggaggagagamcgctgcctctcctctggattggtctcaggctctctgttggcctttggtcagcgtttccacatcctgctctgctgcaggagagggggctaaggggctggat

SEQ ID NO: 8870 - DNA, 201 bp, Homo sapiens
gcagtgggtctgggggcccagtgggtatggcggcatcttgctggtgaactgtgaccgtgatgatccgagctgtgatgtccaggacaattgtgaccagcacrtgcactgcctgcaagacctggaagacatgtctgtcatggtcctgcggacgcagggccctgcagccctctttgatgaccacaaacttgtcctccatacctc

SEQ ID NO: 8871 - DNA, 201 bp, Homo sapiens
gttggcctttggtcagcgtttccacatcctgctctgctgcaggagagggggctaaggggctggatccaccaaggcagctcacagcgggaaaactctgggamtgaaccactgaattcaggggatgggggtgggggggcggttctcgaggtgtgtgccagctacacgtgtgttctgtatgggtccagctgcgtttccatcact

SEQ ID NO: 8872 - DNA, 201 bp, Homo sapiens
tgtgccgtgtgaggaacaacacgtgttttgtggatgcggtggcagagctggccaggaaggccggctgcaagctgaccatctgcccacaggccgagaaccgyaacgaccgctggatccaggatgagatggagctgggctacgttcaggcgccgcacaagaccctcccggtggtctttgactccccaaggaatggggaactgc

SEQ ID NO: 8873 - DNA, 201 bp, Homo sapiens
ctgcctccgccatggctgcaagaaccgttatcattgaccacgggtctggctttttgaaggctggcacggccggctggaatgagcctcagatggtcttcccraacatcgtgaactacctaccgtgcaaggagaaccctggccccagctatgcccgtaggcgtgtgagcctgggcatcgacatttgccatcctgacaccttta

SEQ ID NO: 8874 - DNA, 201 bp, Homo sapiens
aggaagattgcgatagacgctgcctgtttcagctggagacagtcgccgtgactcagatgaacaagtgctacgtgccgcagaatctgggggaggccctggaytttcgtgagaggcagcagagtgccttggatgagagcaacacctatcagctcccagacggctcccgcgtggagctgacccccatgcagcgggtggctcctg

SEQ ID NO: 8875 - DNA, 201 bp, Homo sapiens
cagtgggtgcctcttgtgagacactgtttctgagagcagcttttgtggcatcttacagggcagatttctggtcccacccacctctgcctccgccatggctkcaagaaccgttatcattgaccacgggtctggctttttgaaggctggcacggccggctggaatgagcctcagatggtcttcccgaacatcgtgaactacct

SEQ ID NO: 8876 - DNA, 201 bp, Homo sapiens
gtgctacgtgccgcagaatctgggggaggccctggactttcgtgagaggcagcagagtgccttggatgagagcaacacctatcagctcccagacggctccygcgtggagctgacccccatgcagcgggtggctcctgagatgttctttagcccgcaggtgttcgagcagccggggcccagcatcccacgggccattgtgga

SEQ ID NO: 8877 - DNA, 201 bp, Homo sapiens
aattctaggggcatgagggtattttttaggttctaaggttttatcttgttgcaagagtgggacctacccaagggggaagacaagatgtcatccttggaaaycctgcaggggacagtttttccagggtggcctatcattggggtatgagtggctgactgccatctccatgcctgagagccactgatttttcattggcatttc

SEQ ID NO: 8878 - DNA, 201 bp, Homo sapiens
ctggaatgagcctcagatggtcttcccgaacatcgtgaactacctaccgtgcaaggagaaccctggccccagctatgcccgtaggcgtgtgagcctgggcrtcgacatttgccatcctgacacctttagctaccccatcgagcggggccgcatcctcaactgggagggtgtgcagtacctctggtcatttgtgttggagaa

SEQ ID NO: 8879 - DNA, 201 bp, Homo sapiens
agggcagatttctggtcccacccacctctgcctccgccatggctgcaagaaccgttatcattgaccacgggtctggctttttgaaggctggcacggccggmtggaatgagcctcagatggtcttcccgaacatcgtgaactacctaccgtgcaaggagaaccctggccccagctatgcccgtaggcgtgtgagcctgggca

SEQ ID NO: 8880 - DNA, 201 bp, Homo sapiens
tgaagatgggtctccggtgtcttttgcagctcacattgcaggtggatttgctggaatgtccattggctacacggtgtttagctgctttgataaagcactgmtgaaagatccaaggttttggatagcaattgctgcatatttagcttgtgtcttatttgctgtgtttttcaacattttcctatctccagcaaactgacctgc

SEQ ID NO: 8881 - DNA, 201 bp, Homo sapiens
gaagaggagaaaatgagagaggatgggggaggtaaagatcgggccaagagtaaaaaggtccacaggattgtctcaaaatggatgctgcccgaaaagtcccraggaacatacttggagagagctaactgcttcccgcctcccgtgttcatcatctccatcagcctggccgagctggcagtgtttatttactatgctgtgtgg

SEQ ID NO: 8882 - DNA, 201 bp, Homo sapiens
caaactgacctgcccctattgtaagtcaattaataaaaagagccatctggaggaaataaaaaaaaaaggaagactctatgaagaaacagagaagtctcagmaaaggctaacaattttatatagaggacaaaacagcattaaactcatcagttgcaaagattgcctataaaaggaccttaggatttaaggaaggggcttctt

SEQ ID NO: 8883 - DNA, 201 bp, Homo sapiens; identical to SEQ ID NO: 8880

SEQ ID NO: 8884 - DNA, 201 bp, Homo sapiens; identical to SEQ ID NO: 8881

SEQ ID NO: 8885 - DNA, 201 bp, Homo sapiens; identical to SEQ ID NO: 8882

SEQ ID NO: 8886 - DNA, 201 bp, Homo sapiens
gatgacatccagcggcacctggagactcttatccggagctaccccgacatcaggcgggaccacatactggccattctggcgctgcgccgactgggccgccrgcggaaccagcatctcttgcagcacactcaagacctgctgagagctgcggccggggcggcgggtgcggaggcccctcggggccgcgtgctcttcgaggag

SEQ ID NO: 8887 - DNA, 201 bp, Homo sapiens
ccaaggaagatacgggcctgttccggcgaagctcctgctccctgttccggtccttccggcaagccctgaatgacggcccagctaccggccattcccaggcsactcctgaggtgccctcgggggtcatgaatggtgtcagccagcaggcatccactggggcagcgtctgaggaactgaaacccgaggcaggtgactctaagg

SEQ ID NO: 8888 - DNA, 201 bp, Homo sapiens
tcctgggcgagacctacaaagatgacatccagcggcacctggagactcttatccggagctaccccgacatcaggcgggaccacatactggccattctggcrctgcgccgactgggccgccggcggaaccagcatctcttgcagcacactcaagacctgctgagagctgcggccggggcggcgggtgcggaggcccctcggg

SEQ ID NO: 8889 - DNA, 201 bp, Homo sapiens
gatggcacaaggctgggcctgggctccctgaggcaggccttctcccgggccagccagcgggctttgacccaggtctccaaggaagatacgggcctgttccrgcgaagctcctgctccctgttccggtccttccggcaagccctgaatgacggcccagctaccggccattcccaggccactcctgaggtgccctcgggggtc

SEQ ID NO: 8890 - DNA, 201 bp, Homo sapiens
gcccaccgcaaggatggcacaaggctgggcctgggctccctgaggcaggccttctcccgggccagccagcgggctttgacccaggtctccaaggaagataygggcctgttccggcgaagctcctgctccctgttccggtccttccggcaagccctgaatgacggcccagctaccggccattcccaggccactcctgaggtg

SEQ ID NO: 8891 - DNA, 201 bp, Homo sapiens
cagccgagatcggcgccatcgtgcgcgagacgctggacagcgacggtgtggacgcggccgcgctggccgagctggcccgcgtggtgagcgcggaggaggargcccacccttctccccccgacgacggcgacttcctgcgcacgccgcgccgctggcgccagcactgggaggaggcggtgcggcgaagcgctcaggagcgcg

SEQ ID NO: 8892 - DNA, 201 bp, Homo sapiens
tatccggagctaccccgacatcaggcgggaccacatactggccattctggcgctgcgccgactgggccgccggcggaaccagcatctcttgcagcacactsaagacctgctgagagctgcggccggggcggcgggtgcggaggcccctcggggccgcgtgctcttcgaggagatcaaggtgcccagtgccatggctgtgct

SEQ ID NO: 8893 - DNA, 190 bp, Homo sapiens
ggaccacatactggccattctggcgctgcgccgactgggccgccggcggaaccagcatctcttgcagcacactcaagacctgctgagagctgcggccgggrcggcgggtgcggaggcccctcggggccgcgtgctcttcgaggagatcaaggtgcccagtgccatggctgtgctgatcacctgcgtctag

SEQ ID NO: 8894 - DNA, 201 bp, Homo sapiens
ggatggcacaaggctgggcctgggctccctgaggcaggccttctcccgggccagccagcgggctttgacccaggtctccaaggaagatacgggcctgttcyggcgaagctcctgctccctgttccggtccttccggcaagccctgaatgacggcccagctaccggccattcccaggccactcctgaggtgccctcgggggt

SEQ ID NO: 8895 - DNA, 185 bp, Homo sapiens
ctccatccagctgcttagccgcctctgggaacctcaaggaagctctcctgctgccaagatgccatcaccacagacagacactccygggccggagctgcagagtcccaaggaggctgaggagccacagactccagctcagggctcccggcgaacaagcagcaggaaagagcccaatgcccaccgca

SEQ ID NO: 8896 - DNA, 201 bp, Homo sapiens
ccagccagcgggctttgacccaggtctccaaggaagatacgggcctgttccggcgaagctcctgctccctgttccggtccttccggcaagccctgaatgasggcccagctaccggccattcccaggccactcctgaggtgccctcgggggtcatgaatggtgtcagccagcaggcatccactggggcagcgtctgaggaac

SEQ ID NO: 8897 - DNA, 201 bp, Homo sapiens
tgttccggtccttccggcaagccctgaatgacggcccagctaccggccattcccaggccactcctgaggtgccctcgggggtcatgaatggtgtcagccarcaggcatccactggggcagcgtctgaggaactgaaacccgaggcaggtgactctaagggagggctcctggcagctggggcctgttgttcctggagcaggc

SEQ ID NO: 8898 - DNA, 201 bp, Homo sapiens
ttatccggagctaccccgacatcaggcgggaccacatactggccattctggcgctgcgccgactgggccgccggcggaaccagcatctcttgcagcacacycaagacctgctgagagctgcggccggggcggcgggtgcggaggcccctcggggccgcgtgctcttcgaggagatcaaggtgcccagtgccatggctgtgc

SEQ ID NO: 8899 - DNA, 201 bp, Homo sapiens
tgagcagtgaatgattcagtgttaaatgtgatgaatactgtattttgtattgtttcaattgcatctcccagataatgtgaaaatggtccaggagaaggccrattcctatacgcagcgtgctttaaaaaataaataagaaacaactctttgagaaacaacaatttctactttgaagtcataccaatgaaaaaatgtatatgc

SEQ ID NO: 8900 - DNA, 201 bp, Homo sapiens
acctgcctgacatttggagtgttccccttccactgagggcagtcgatagagctgtattaagccacttaaaatgttcacttttgacaaaggcaagcacttgygggtttttgttttgtttttcattcagtcttacgaatacttttgccctttgattaaagactccagttaaaaaaaattttaatgaagaaagtggaaaacaag

SEQ ID NO: 8901 - DNA, 201 bp, Homo sapiens
cagtcaggaaaggaatcatttctatttctcctccatgggagaaaatagataagagtagaaactgcagggaaaattatttgcataacaattcctctactaayaatcagctccttcctggagactgcccagctaaagcaatatgcatttaaatacagtcttccatttgcaagggaaaatctctgagcagtgaatgattcagtg

SEQ ID NO: 8902 - DNA, 201 bp, Homo sapiens
actccagttaaaaaaaattttaatgaagaaagtggaaaacaaggaagtcaaagcaaggaaactatgtaacatgtaggaagtaggaagtaaattatagtgaygtaatcttgaattgtaactgttcttgaatttaataatctgtagggtaattagtaacatgtgttaagtattttcataagtatttcaaattggagcttcatg

SEQ ID NO: 8903 - DNA, 201 bp, Homo sapiens
attcagtgttaaatgtgatgaatactgtattttgtattgtttcaattgcatctcccagataatgtgaaaatggtccaggagaaggccaattcctatacgcrgcgtgctttaaaaaataaataagaaacaactctttgagaaacaacaatttctactttgaagtcataccaatgaaaaaatgtatatgcacttataattttc

SEQ ID NO: 8904 - DNA, 201 bp, Homo sapiens
ctctactaacaatcagctccttcctggagactgcccagctaaagcaatatgcatttaaatacagtcttccatttgcaagggaaaatctctgagcagtgaakgattcagtgttaaatgtgatgaatactgtattttgtattgtttcaattgcatctcccagataatgtgaaaatggtccaggagaaggccaattcctatacg

SEQ ID NO: 8905 - DNA, 201 bp, Homo sapiens
aggagatgctccttgggccctttgagtgcagtcctgatcagagccgtggtcctttggggtgaactaccttggttcccccactgatcacaaaaacatggtgsgtccatgggcagagcccaagggaattcggtgtgcaccagggttgaccccagaggattgctgccccatcagtgctccctcacatgtcagtaccttcaaact

SEQ ID NO: 8906 - DNA, 201 bp, Homo sapiens
tcagtgttaaatgtgatgaatactgtattttgtattgtttcaattgcatctcccagataatgtgaaaatggtccaggagaaggccaattcctatacgcagygtgctttaaaaaataaataagaaacaactctttgagaaacaacaatttctactttgaagtcataccaatgaaaaaatgtatatgcacttataattttcct

SEQ ID NO: 8907 - DNA, 201 bp, Homo sapiens
acccagccctcatcccgagcacctccacatcctccacgttctgctcatcattctctgtctcatccatcatcatgtgtgtccacgactgtctccatggcccygcaaaaggactctcaggaccaaagctttcatgtaaactgtgcaccaagcaggaaatgaaaatgtcttgtgttacctgaaaacactgtgcacatctgtgtc

SEQ ID NO: 8908 - DNA, 201 bp, Homo sapiens
agtcaacctgggcaaagcctagtgaaggcttctctctgtgggatgggatggtggagggccacatgggaggctcacccccttctccatccacatgggagccrggtctgcctcttctgggagggcagcagggctaccctgagctgaggcagcagtgtgaggccagggcagagtgagacccagccctcatcccgagcacctcca

SEQ ID NO: 8909 - DNA, 201 bp, Homo sapiens; identical to SEQ ID NO: 8902

SEQ ID NO: 8910 - DNA, 201 bp, Homo sapiens; identical to SEQ ID NO: 8900

SEQ ID NO: 8911 - DNA, 142 bp, Homo sapiens
cagtcaggaaaggaatcatttctatttctcctccatgggagaaaatagataagagtagaaactgcagggaaaattatttgcataacaattcctctactaayaatcagctccttcctggagactgcccagctaaagcaatatg

SEQ ID NO: 8912 - DNA, 201 bp, Homo sapiens
tcccatgagagcagggcagggtggggtgacaaggaccacgatggccagcctggccctgggtgtaccctgagatgtggattccttgtccccagtgggaatcrggttcaggttggcagattggcagtcgctgtaacccattcacaaaggtgttctaggagcccattgaacatttgtttgaatggaaggaaatgtccaatttat

SEQ ID NO: 8913 - DNA, 201 bp, Homo sapiens
cattgatctgggatcgggcctgaggtttgccagcatttagaccctgcatttatagcatacggtatgatattgcagcttatattcatccatgccctgtaccygtgcacgttggaacttttattactggggtttttctaagaaagaaattgtattatcaacagcattttcaagcagttagttccttcatgatcatcacaatca

SEQ ID NO: 8914 - DNA, 201 bp, Homo sapiens
ctgcagcctccaaaacgttattcaatttgaaatgcagacatttcttagagaaagctaagagttcagccctgcattgagaagaagaaaaagtcccatgagarcagggcagggtggggtgacaaggaccacgatggccagcctggccctgggtgtaccctgagatgtggattccttgtccccagtgggaatcaggttcaggtt

SEQ ID NO: 8915 - DNA, 150 bp, Homo sapiens
aggcctgagactgaaggcacagtttaaccagtacacgggccagtgttaaatcttatgcagactgagacgaacttttgtttatttccacattattaatggtwctactaattttatctaagggggcgcagagaagaaaaagtggggaaaaaa

SEQ ID NO: 8916 - DNA, 199 bp, Homo sapiens
atttattttaatgaattactgataaacagtgctttgaccaggggcctccaggcctgagactgaaggcacagtttaaccagtacacgggccagtgttaaatyttatgcagactgagacgaacttttgtttatttccacattattaatggttctactaattttatctaagggggcgcagagaagaaaaagtggggaaaaaa

SEQ ID NO: 8917 - DNA, 201 bp, Homo sapiens
ccgcaccagccgggaagagggtgattgctggggctcgtgccctgcatccctctcctcccagggcctgccccacagctcgggccctctgtgagatccgtctwtggcctcctccagaatggagctggccctctcctggggatgtgtaatggtccccctgcttacccgcaaaagacaagtctttacagaatcaaatgcaatttt

SEQ ID NO: 8918 - DNA, 201 bp, Homo sapiens
catcttgccactaccccctcctgaagccacagcagggtttcaggttccaatcagaactgttggcaaggtgacatttccatgcataaatgcgatccacagarggtcctggtggtatttgtaactttttgcaaggcatttttttatatatatttttgtgcacatttttttttacgtttctttagaaaacaaatgtatttcaaa

SEQ ID NO: 8919 - DNA, 201 bp, Homo sapiens; identical to SEQ ID NO: 8899

SEQ ID NO: 8920 - DNA, 201 bp, Homo sapiens; identical to SEQ ID NO: 8900

SEQ ID NO: 8921 - DNA, 201 bp, Homo sapiens
cagtcaggaaaggaatcatttctatttctcctccatgggagaaaatagataagagtagaaactgcagggaaaattatttgcataacaattcctctactaayaatcagctccttcctggagactgcccagctaaagcaatatgcatttaaatacagtcttccatttgcaagggaaaagtctcttgtaatccgaatctctttt

SEQ ID NO: 8922 - DNA, 201 bp, Homo sapiens; identical to SEQ ID NO: 8902

SEQ ID NO: 8923 - DNA, 201 bp, Homo sapiens; identical to SEQ ID NO: 8903

SEQ ID NO: 8924 - DNA, 201 bp, Homo sapiens
cctagaaacttccaaatcccctaagcagaccactgataaaaccatgtagaaaatttgttattttgcaacctcgctggactctcagtctctgagcagtgaakgattcagtgttaaatgtgatgaatactgtattttgtattgtttcaattgcatctcccagataatgtgaaaatggtccaggagaaggccaattcctatacg

SEQ ID NO: 8925 - DNA, 201 bp, Homo sapiens
tgctgtggtgtgtccccctctgtccaggcactgagataccagcgaggaggctccagagggcactctgcttgttattagagattacctcctgagaaaaaagsttccgcttggagcagaggggctgaatagcagaaggttgcacctcccccaaccttagatgttctaagtctttccattggatctcattggacccttccatgg

SEQ ID NO: 8926 - DNA, 201 bp, Homo sapiens
ccagaggaaggggccagaggctcgttgactggctgtgtgttgggattgagtctgtgccacgtgtttgtgctgtggtgtgtccccctctgtccaggcactgwgataccagcgaggaggctccagagggcactctgcttgttattagagattacctcctgagaaaaaagcttccgcttggagcagaggggctgaatagcagaa

SEQ ID NO: 8927 - DNA, 201 bp, Homo sapiens
gctccctgactgggagttgatcgcctttcccaggtgctacacccttttccagctggatgagaatttgagtgctctgatccctctacagagcttccctgacycattctgaaggagccccattcctgggaaatattccctagaaacttccaaatcccctaagcagaccactgataaaaccatgtagaaaatttgttattttgc

SEQ ID NO: 8928 - DNA, 201 bp, Homo sapiens; identical to SEQ ID NO: 8905

SEQ ID NO: 8929 - DNA, 201 bp, Homo sapiens; identical to SEQ ID NO: 8906

SEQ ID NO: 8930 - DNA, 201 bp, Homo sapiens; identical to SEQ ID NO: 8907

SEQ ID NO: 8931 - DNA, 201 bp, Homo sapiens; identical to SEQ ID NO: 8908

SEQ ID NO: 8932 - DNA, 198 bp, Homo sapiens
gcggtacgggaagacagctttgggatgtcggaagatcctagaggtcccaaggtagctgacttgcgaagctgaggctccagccgagggctccaggcctstgaccggcccagcagtgagcgcggctgcccgacgcttcagggccgggagcagggagcgtgagtcgccatggcgacgccggcgggtctggagcgctgggtt

SEQ ID NO: 8933 - DNA, 201 bp, Homo sapiens
tttggattgatcaaggatgttgctcgcttccgacctgagctcaaggtcctggtggcttcagccacaatggacactgcccgtttttccaccttctttgatgrcgcccctgtgtttcgaatccccggacgcaggtttcctgtggacatcttctacaccaaggctccagaggctgactacttggaagcttgtgtagtatctgtg

SEQ ID NO: 8934 - DNA, 3 bp, Homo sapiens
tck

SEQ ID NO: 8935 - DNA, 201 bp, Homo sapiens
acccacttcaactcaggcccagcagaaagagtccatccaggccgtccgccgcagcctcccggtgttcccatttcgagaggagctcctggctgctattgcaratcaccaagtcctcatcattgaaggcgagacaggctcagggaagaccacccagatcccgcagtatctctttgaggagggttatacaaacaagggtatgaa

SEQ ID NO: 8936 - DNA, 201 bp, Homo sapiens
tcaacttctttctccctggcggtgaccacctggttctgctaaatgtttacacacagtgggctgagagtggttactcttcccagtggtgctatgagaacttygtacagttcagatcgatgcgccgagcccgggatgtgcgggaacagctggaagggctcttggaacgtgtggaagttggtctcagttcctgccagggggact

SEQ ID NO: 8937 - DNA, 201 bp, Homo sapiens
tccccatgctaagaaaatgcccaaaaaaataggcaaaacacgagaagagctagggtaagagaaggacgtaaacagaacctgacaccagctccttttccttytatacattatttaatacctattaaataaaattatttttggaataaagcttgtgggaacatttgggatctagagaaagtgatatgtgaaattctatctcat

SEQ ID NO: 8938 - DNA, 201 bp, Homo sapiens
agctgcactcggtgttggggctgagcgagcggcacgtcgcccagtttctgatcggtaccgcacagcgctgcacctctgccgaggagttcgtgcagcgcctrcgagacactgataccttggatctcagtgggccggcccgggacttcgccctgagactctggaacaaggtaccacgaaaggcagtggtagaaaagccagctc

SEQ ID NO: 8939 - DNA, 201 bp, Homo sapiens
cagcttgggcaatgtcgtgttgctgctcaagagcttagggatccatgacctaatgcactttgatttcctggaccctccaccatatgagacactgctgctgrctttggagcagctgtatgctctgggagccctcaaccaccttggggagctcaccacgtctggtcgaaagatggcagagctgccggtggaccccatgctgtc

SEQ ID NO: 8940 - DNA, 171 bp, Homo sapiens
gagtgtgaaggcatcagctgcagggagaaaggttaatgccagttgggggaggcacacaaatgttctaccctttaccccacccagccctacctaggactcamtttatctagacgatggcgacaaatgaggccactggaattcaggtagaaagtggagtaggcatcataggtc

SEQ ID NO: 8941 - DNA, 201 bp, Homo sapiens
gagatgctgcctctcaggagcccaagtatcaactggtgctggaggaggaggagaccattgagtttgtccgggccactcagctccagggtgatgaggagccrtcagctccacccacttcaactcaggcccagcagaaagagtccatccaggccgtccgccgcagcctcccggtgttcccatttcgagaggagctcctggctg

SEQ ID NO: 8942 - DNA, 201 bp, Homo sapiens
atcaggagcccctggggaggagcagcggcgctgggaggaggcgcggcttggggcagcgtccctgaagtttggggcccgagatgctgcctctcaggagcccragtatcaactggtgctggaggaggaggagaccattgagtttgtccgggccactcagctccagggtgatgaggagccgtcagctccacccacttcaactca

SEQ ID NO: 8943 - DNA, 161 bp, Homo sapiens
gcggtacgggaagacagctttgggatgtcggaagatcctagaggtcccaaggtagctgacytgcgaagctgaggctccagccgagggctccaggcctctgaccggcccagcagtgagcgcggctgcccgacgcttcagggccgggagcagggagcgtgagt

SEQ ID NO: 8944 - DNA, 201 bp, Homo sapiens
taagcggcgagtgcgggatctcgcccgggagtaccgggcagctggggagcaggagaagctggaggccaccaatcgctaccacatgcccaaggaaacccgargacagccagcccgagctgtggatctagtggaggaggaatcaggagcccctggggaggagcagcggcgctgggaggaggcgcggcttggggcagcgtccct

SEQ ID NO: 8945 - DNA, 201 bp, Homo sapiens
gctccaaaatccgggagctcctggtgctgcccatttatgccaatctgccctctgacatgcaggcccgtatcttccagcccacaccacctggggcacgaaakgtggttgtggcaacgaacattgctgagacatcactcaccattgagggcatcatttatgtgctggatccagggttctgtaagcagaagagctacaaccccc

SEQ ID NO: 8946 - DNA, 198 bp, Homo sapiens
gcggtacgggaagacagctttgggatgtcggaagatcctagaggtcccaaggtaccacgaaaggcagtggtagaaaagccagctcgggcagcagagcsagaggcccgggccctgctggagaagaaccgatcttataggttactggaagacagtgaagagagcagtgaggagactgtgagtagggctggaagcagcctc

SEQ ID NO: 8947 - DNA, 201 bp, Homo sapiens; identical to SEQ ID NO: 8933

SEQ ID NO: 8948 - DNA, 201 bp, Homo sapiens
atcagagcgaactgtcctccgctacatgacagatgggatgcttctccgggagttcctctctgagcctgacctggcgagttacagcgtggtgatggtggatraggcacacgaaaggaccctacacacagacattctctttggattgatcaaggatgttgctcgcttccgacctgagctcaaggtcctggtggcttcagccac

SEQ ID NO: 8949 - DNA, 201 bp, Homo sapiens
tctttgagcaacagccacgctggctgctctaccacgaacttgtcttgaccaccaaagagttcatgagacaggtactggagattgagagcagttggcttctygaggtggctccccattattataaggccaaggagctagaagatccccatgctaagaaaatgcccaaaaaaataggcaaaacacgagaagagctagggtaag

SEQ ID NO: 8950 - DNA, 177 bp, Homo sapiens
gcctccacctccttctcttgggcgtagcagtcttcagtgctgcctccactccaaggtcaaggatcagggcttggaacacaggtttaagtcaggttctggcyctgacagccccagggccaccagggctcccactagcagcttcttcacaggcgttggaggtgagtgtgaaggcatcag

SEQ ID NO: 8951 - DNA, 201 bp, Homo sapiens
aacgtaaaaagcggaaacacctcaggaagaagcgtgaggaagaagaggaggaagaggcttctgagaaagggaagaagaaaacaggggggagtaaacagcayacagagaagccagagtcggaagatgagtgggaacggacagagcgtgaacgccttcaggacctggaggagcgtgatgcctttgctgagcgggttcgacagc

SEQ ID NO: 8952 - DNA, 201 bp, Homo sapiens
caatgcccgtgtcaacttctttctccctggcggtgaccacctggttctgctaaatgtttacacacagtgggctgagagtggttactcttcccagtggtgcratgagaactttgtacagttcagatcgatgcgccgagcccgggatgtgcgggaacagctggaagggctcttggaacgtgtggaagttggtctcagttcctg

SEQ ID NO: 8953 - DNA, 201 bp, Homo sapiens
cccaaccccggagagtggctgccatgagtgtggccgcccgagtggcccgggagatgggtgtgaagcttgggaatgaggttggctacagcatccgctttgargactgcacatcagagcgaactgtcctccgctacatgacagatgggatgcttctccgggagttcctctctgagcctgacctggcgagttacagcgtggtga

SEQ ID NO: 8954 - DNA, 201 bp, Homo sapiens
ctcagggaagaccacccagatcccgcagtatctctttgaggagggttatacaaacaagggtatgaagattgcctgcacccaaccccggagagtggctgccrtgagtgtggccgcccgagtggcccgggagatgggtgtgaagcttgggaatgaggttggctacagcatccgctttgaggactgcacatcagagcgaactgt

SEQ ID NO: 8955 - DNA, 161 bp, Homo sapiens
gcggtacgggaagacagctttgggatgtcggaagatcctagaggtcccaaggtaccacgayaggcagtggtagaaaagccagctcgggcagcagagcgagaggcccgggccctgctggagaagaaccgatcttataggttactggaagacagtgaagagag

SEQ ID NO: 8956 - DNA, 201 bp, Homo sapiens
tccacccacttcaactcaggcccagcagaaagagtccatccaggccgtccgccgcagcctcccggtgttcccatttcgagaggagctcctggctgctattrcaaatcaccaagtcctcatcattgaaggcgagacaggctcagggaagaccacccagatcccgcagtatctctttgaggagggttatacaaacaagggtat

SEQ ID NO: 8957 - DNA, 201 bp, Homo sapiens
atcagcacgagcttgaggaaaccacagtgcctgagatccagaggaccagcttgggcaatgtcgtgttgctgctcaagagcttagggatccatgacctaatkcactttgatttcctggaccctccaccatatgagacactgctgctggctttggagcagctgtatgctctgggagccctcaaccaccttggggagctcacca

SEQ ID NO: 8958 - DNA, 198 bp, Homo sapiens; identical to SEQ ID NO: 8932

SEQ ID NO: 8959 - DNA, 201 bp, Homo sapiens; identical to SEQ ID NO: 8938

SEQ ID NO: 8960 - DNA, 161 bp, Homo sapiens; identical to SEQ ID NO: 8943

SEQ ID NO: 8961 - DNA, 35 bp, Homo sapiens
tctctctacaataaaagataccctcattaccctcr

SEQ ID NO: 8962 - DNA, 201 bp, Homo sapiens; identical to SEQ ID NO: 8936

SEQ ID NO: 8963 - DNA, 201 bp, Homo sapiens
tgcctttttgactcttcagaggctgtgaatttctggtcttggaagatcacagtggagcaattggacagataggattttatccttcatatcccttgcaaaaratctctaagaacccatggagagccagccagcgcaagagtgtctgatgcagatgtttttgcccatcgagccagcctgctttgtggaatggctggggacttc

SEQ ID NO: 8964 - DNA, 201 bp, Homo sapiens; identical to SEQ ID NO: 8939

SEQ ID NO: 8965 - DNA, 201 bp, Homo sapiens; identical to SEQ ID NO: 8937

SEQ ID NO: 8966 - DNA, 201 bp, Homo sapiens; identical to SEQ ID NO: 8933

SEQ ID NO: 8967 - DNA, 201 bp, Homo sapiens; identical to SEQ ID NO: 8945

SEQ ID NO: 8968 - DNA, 201 bp, Homo sapiens
tattttaagaaaaaaggttttcttctgattttctgcacaaccagacgtttgtttgtttgctttaaaatgtttcaacaaaatcctggtttgtttcgaaataygttggattagcatttaacacctcatcggtcactaaagcccagtcagttcaccagccccaacacagcctcggctaaaagaacatcagagcaaacagagctg

SEQ ID NO: 8969 - DNA, 201 bp, Homo sapiens
ggtgcagagagaacctccggctttacttctgtctcgtctgccccaaccgctagcctcggcttgggtaaggcgaggcggaattaaaccccgctccgagagcrgcagcttcgcgcgcggtgcgctcggcctatgcctgccccgaggggcgtctggtaggcaccccgccctctcccgcagctcgacccccatgatagatacgct

SEQ ID NO: 8970 - DNA, 201 bp, Homo sapiens
atcaacgtggccatcccgggcatcatgctgcggcgcctgcagaagggtaacctgccggtgcgcgcgctcttcacgcgcggcgaggaccgggaccgcttcayccggcgctgtggcaccgacacagtggtgctctacgacgagagcagcagcgactggaacgagaatacgggcggcgagtcggtgctcgggctgctgctcaag

SEQ ID NO: 8971 - DNA, 201 bp, Homo sapiens
atcctagtgtgagaatgctgaatccagaatgatgtctccactttttcccctagcatgcgcatggcaaggcatatctaagcttcctcaccgtgtcaggatayggctttagaattttacattggcacttaggaggcaactttgtcatccctgttgtaatgtgcttttttgtttaactggcttgggatgtgggtcagaaaccct

SEQ ID NO: 8972 - DNA, 201 bp, Homo sapiens
aaacctgtcccagtttttccctgaggccatttctttcatagatgaagcccggggcaagaactgtggtgtcttggtacattgcttggctggcattagccgckcagtcactgtgactgtggcttaccttatgcagaagctcaatctgtcgatgaacgatgcctatgacattgtcaaaatgaaaaaatccaacatatcccctaa

SEQ ID NO: 8973 - DNA, 201 bp, Homo sapiens
acaagttttcctaaagctagctcgcgaacgcaagcgtcgcgaacaagggcttttgtgcatgctaattgcgccattggtgcgcaaaagttccgacgcgaagkgtgaactctcaacagaaggaaacatgagacaactgaagtgccctggtttatgtgccctgctcctcctccgctgccgcctccccttctttctccttcctcc

SEQ ID NO: 8974 - DNA, 201 bp, Homo sapiens
atacaatttggatattaaccacagagaggtgtagcagaataccaagatgacagccacatgttaacctcctccctatccttcactgtcaggatcttctgctytataatgctgagataatgccaaagaggaagtagggataattctttttccagtctgttgtcatgggcaattctacctgcagatatcctagtgtgagaatgc

SEQ ID NO: 8975 - DNA, 201 bp, Homo sapiens
caagagatagcaaatcgagtcttaaataatccggggagaaagacgcccgggtagatttgaggtgcagccttggagggagggattagaagccgctagacttyttttcctcccctctcagtagcacggagtccgaattaattggatttcattcactggggaggaacaaaaactatctgggcagcttcattgagagagattcat

SEQ ID NO: 8976 - DNA, 201 bp, Homo sapiens
tagtttgactatgccttacctttgtaaatatttttgcttgtgttgtcgcaaaggggataatctgggaaagacaccaaatcatgggctcactttaaaaaaaraaagaataaaaaaaccttcagctgtgctaaacagtatattacctctgtataaaattcttcagggagtgtcacctcaaatgcaatactttgggttggtttc

SEQ ID NO: 8977 - DNA, 201 bp, Homo sapiens
ttaaaagaaattatccaaagggagaaagagcagtatgccacttcttaaaacagaacaaaacaaaaaaagaaaattgtgctcttttctaatccaaagggtakatttgcagcatgcttgactttaccaattctgatgacatctttacggacactattatcactaagaccttgttatggcgaagtctttagtctttttcatgta

SEQ ID NO: 8978 - DNA, 201 bp, Homo sapiens
catctttacggacactattatcactaagaccttgttatggcgaagtctttagtctttttcatgtattttcctcatgattttttctctttatgtagtttgastatgccttacctttgtaaatatttttgcttgtgttgtcgcaaaggggataatctgggaaagacaccaaatcatgggctcactttaaaaaaagaaagaata

SEQ ID NO: 8979 - DNA, 201 bp, Homo sapiens
ttttttcctttgatgggcttaaaagaaattatccaaagggagaaagagcagtatgccacttcttaaaacagaacaaaacaaaaaaagaaaattgtgctctkttctaatccaaagggtatatttgcagcatgcttgactttaccaattctgatgacatctttacggacactattatcactaagaccttgttatggcgaagtc

SEQ ID NO: 8980 - DNA, 201 bp, Homo sapiens
gcttaaaagaaattatccaaagggagaaagagcagtatgccacttcttaaaacagaacaaaacaaaaaaagaaaattgtgctcttttctaatccaaagggkatatttgcagcatgcttgactttaccaattctgatgacatctttacggacactattatcactaagaccttgttatggcgaagtctttagtctttttcatg

SEQ ID NO: 8981 - DNA, 201 bp, Homo sapiens
cttttctaatccaaagggtatatttgcagcatgcttgactttaccaattctgatgacatctttacggacactattatcactaagaccttgttatggcgaastctttagtctttttcatgtattttcctcatgattttttctctttatgtagtttgactatgccttacctttgtaaatatttttgcttgtgttgtcgcaaag

SEQ ID NO: 8982 - DNA, 201 bp, Homo sapiens
ctgactatataattgtcttcaatgaagactaattcaattttgcatatagaggagccaaagagagatttcagctctgtatttgtggtatcagtttggaaaaraaaatctgatactccatttgattattgtaaatatttgatcttgaatcacttgacagtgtttgtttgaattgtgtttgttttttcctttgatgggcttaaa

SEQ ID NO: 8983 - DNA, 201 bp, Homo sapiens
tttcctttgatgggcttaaaagaaattatccaaagggagaaagagcagtatgccacttcttaaaacagaacaaaacaaaaaaagaaaattgtgctcttttstaatccaaagggtatatttgcagcatgcttgactttaccaattctgatgacatctttacggacactattatcactaagaccttgttatggcgaagtcttt

SEQ ID NO: 8984 - DNA, 201 bp, Homo sapiens
ctacctgcagatatcctagtgtgagaatgctgaatccagaatgatgtctccactttttcccctagcatgcgcatggcaaggcatatctaagcttcctcacygtgtcaggatatggctttagaattttacattggcacttaggaggcaactttgtcatccctgttgtaatgtgcttttttgtttaactggcttgggatgtgg

SEQ ID NO: 8985 - DNA, 201 bp, Homo sapiens
acctatgtgtgaagtgacacattttagaactttttcattcagggattgattttgacttgtaggcatagtagggcaaggttcttttaagcttttcctagaaygtttttcagcagcagtttatgaaattcatcgtttgccacgaataaagatgacatcctagaatggaccgactgtaccgtgtatatgaacaatacctcttat

SEQ ID NO: 8986 - DNA, 201 bp, Homo sapiens
tgtgtgtgtgtgagcatgggtacccatttgataagagaaatgcatttgattgtgaagaagggagagttaaattctccattatgttcgtggtgtaaagtttwgagctggaatttattataagaatgtaaaaccttaaattattaataaataactattttggctattgaatgtgtgtttttaaaaactcagttatacctatgt

SEQ ID NO: 8987 - DNA, 201 bp, Homo sapiens
catgctgtatagatacaggcagtaggtttgctctgtacccatgtgtacagcctacccatgcagggactgggattcgaggacttccaggcgcatagggtagraccaaatgatagggtaggagcatgtgttctttagggccttgtaaggctgtttccttttgcatctggaactgactatataattgtcttcaatgaagactaa

SEQ ID NO: 8988 - DNA, 201 bp, Homo sapiens
agaactgtggtgtcttggtacattgcttggctggcattagccgctcagtcactgtgactgtggcttaccttatgcagaagctcaatctgtcgatgaacgaygcctatgacattgtcaaaatgaaaaaatccaacatatcccctaacttcaacttcatgggtcagctgctggacttcgagaggacgctgggactcagcagcc

SEQ ID NO: 8989 - DNA, 201 bp, Homo sapiens
cggcgagtcggtgctcgggctgctgctcaagaagctcaaggacgagggctgccgggcgttctacctggaaggtggcttcagtaagttccaagccgagttckccctgcattgcgagaccaatctagacggctcgtgtagcagcagctcgccgccgttgccagtgctggggctcgggggcctgcggatcagctctgactcttc

SEQ ID NO: 8990 - DNA, 201 bp, Homo sapiens
cgaggaccgggaccgcttcacccggcgctgtggcaccgacacagtggtgctctacgacgagagcagcagcgactggaacgagaatacgggcggcgagtcgktgctcgggctgctgctcaagaagctcaaggacgagggctgccgggcgttctacctggaaggtggcttcagtaagttccaagccgagttctccctgcattg

SEQ ID NO: 8991 - DNA, 201 bp, Homo sapiens; identical to SEQ ID NO: 8968

SEQ ID NO: 8992 - DNA, 201 bp, Homo sapiens; identical to SEQ ID NO: 8969

SEQ ID NO: 8993 - DNA, 201 bp, Homo sapiens; identical to SEQ ID NO: 8970

SEQ ID NO: 8994 - DNA, 201 bp, Homo sapiens; identical to SEQ ID NO: 8972

SEQ ID NO: 8995 - DNA, 201 bp, Homo sapiens; identical to SEQ ID NO: 8973

SEQ ID NO: 8996 - DNA, 201 bp, Homo sapiens; identical to SEQ ID NO: 8975

SEQ ID NO: 8997 - DNA, 201 bp, Homo sapiens; identical to SEQ ID NO: 8976

SEQ ID NO: 8998 - DNA, 201 bp, Homo sapiens; identical to SEQ ID NO: 8978

SEQ ID NO: 8999 - DNA, 201 bp, Homo sapiens; identical to SEQ ID NO: 8977

SEQ ID NO: 9000 - DNA, 201 bp, Homo sapiens; identical to SEQ ID NO: 8979

SEQ ID NO: 9001 - DNA, 201 bp, Homo sapiens; identical to SEQ ID NO: 8981

SEQ ID NO: 9002 - DNA, 201 bp, Homo sapiens; identical to SEQ ID NO: 8980

SEQ ID NO: 9003 - DNA, 201 bp, Homo sapiens; identical to SEQ ID NO: 8982

SEQ ID NO: 9004 - DNA, 201 bp, Homo sapiens; identical to SEQ ID NO: 8983

SEQ ID NO: 9005 - DNA, 201 bp, Homo sapiens; identical to SEQ ID NO: 8987

SEQ ID NO: 9006 - DNA, 169 bp, Homo sapiens
tgtgtgtgtgtgagcatgggtacccatttgataagagaaatgcatttgattgtgaagaagggagagttaaattctccattatgttcgtggtgtaaagtttwgagctggaatttattataagaatgtaaaaccttaaattattaataaataactattttggctattgaat

SEQ ID NO: 9007 - DNA, 201 bp, Homo sapiens; identical to SEQ ID NO: 8988

SEQ ID NO: 9008 - DNA, 201 bp, Homo sapiens; identical to SEQ ID NO: 8989

SEQ ID NO: 9009 - DNA, 201 bp, Homo sapiens; identical to SEQ ID NO: 8990

SEQ ID NO: 9010 - DNA, 201 bp, Homo sapiens; identical to SEQ ID NO: 8968

SEQ ID NO: 9011 - DNA, 201 bp, Homo sapiens; identical to SEQ ID NO: 8969

SEQ ID NO: 9012 - DNA, 201 bp, Homo sapiens; identical to SEQ ID NO: 8970

SEQ ID NO: 9013 - DNA, 201 bp, Homo sapiens; identical to SEQ ID NO: 8971

SEQ ID NO: 9014 - DNA, 201 bp, Homo sapiens
gaagctcaaggacgagggctgccgggcgttctacctggaagatgaagcccggggcaagaactgtggtgtcttggtacattgcttggctggcattagccgckcagtcactgtgactgtggcttaccttatgcagaagctcaatctgtcgatgaacgatgcctatgacattgtcaaaatgaaaaaatccaacatatcccctaa

SEQ ID NO: 9015 - DNA, 201 bp, Homo sapiens; identical to SEQ ID NO: 8973

SEQ ID NO: 9016 - DNA, 201 bp, Homo sapiens; identical to SEQ ID NO: 8974

SEQ ID NO: 9017 - DNA, 201 bp, Homo sapiens; identical to SEQ ID NO: 8975

SEQ ID NO: 9018 - DNA, 201 bp, Homo sapiens; identical to SEQ ID NO: 8976

SEQ ID NO: 9019 - DNA, 201 bp, Homo sapiens; identical to SEQ ID NO: 8977

SEQ ID NO: 9020 - DNA, 201 bp, Homo sapiens; identical to SEQ ID NO: 8978

SEQ ID NO: 9021 - DNA, 201 bp, Homo sapiens; identical to SEQ ID NO: 8979

SEQ ID NO: 9022 - DNA, 201 bp, Homo sapiens; identical to SEQ ID NO: 8980

SEQ ID NO: 9023 - DNA, 201 bp, Homo sapiens; identical to SEQ ID NO: 8981

SEQ ID NO: 9024 - DNA, 201 bp, Homo sapiens; identical to SEQ ID NO: 8982

SEQ ID NO: 9025 - DNA, 201 bp, Homo sapiens; identical to SEQ ID NO: 8983

SEQ ID NO: 9026 - DNA, 201 bp, Homo sapiens; identical to SEQ ID NO: 8984

SEQ ID NO: 9027 - DNA, 201 bp, Homo sapiens; identical to SEQ ID NO: 8985

SEQ ID NO: 9028 - DNA, 201 bp, Homo sapiens; identical to SEQ ID NO: 8986

SEQ ID NO: 9029 - DNA, 201 bp, Homo sapiens; identical to SEQ ID NO: 8987

SEQ ID NO: 9030 - DNA, 201 bp, Homo sapiens; identical to SEQ ID NO: 8988

SEQ ID NO: 9031 - DNA, 201 bp, Homo sapiens
cgaggaccgggaccgcttcacccggcgctgtggcaccgacacagtggtgctctacgacgagagcagcagcgactggaacgagaatacgggcggcgagtcgktgctcgggctgctgctcaagaagctcaaggacgagggctgccgggcgttctacctggaagatgaagcccggggcaagaactgtggtgtcttggtacattg

SEQ ID NO: 9032 - DNA, 201 bp, Homo sapiens
ttctaattcatagtggaaagaaaccttacaaatgtcatgaacgtggcaaggtcttcaggcatagtttatccctaagcaatcatcagagaattcatactggrgagaggccttacaaatgttatgaatgtggcaaggtcttcaatcaaattgcacaccttgcacgacattggagaactcatactggagagaaaccttacaaaa

SEQ ID NO: 9033 - DNA, 201 bp, Homo sapiens
gataattcatactggagagaagccttacaaatgtaatgaatgtggcaaagtttttagcccgagactgagttatttcttactggagagaaaccttacaaatwtaatgaatgttacaaggtctttactcacagttcacactttatagaacattggataattcataccagagaaaagccttacaaatgtaatgaatgtggcaaa

SEQ ID NO: 9034 - DNA, 201 bp, Homo sapiens
cccatcttctaattcatagtggaaagaaaccttacaaatgtcatgaacgtggcaaggtcttcaggcatagtttatccctaagcaatcatcagagaattcayactggagagaggccttacaaatgttatgaatgtggcaaggtcttcaatcaaattgcacaccttgcacgacattggagaactcatactggagagaaacctt

SEQ ID NO: 9035 - DNA, 201 bp, Homo sapiens
aacatctgagaattcatactggagagaaaccttacaaatgtatggaatgtggcaaagtctttagtcgcaattcacaccttacagagtattagtgagtgaayacaggacagaaaccttacaaatgtaatgaatgcggcaagttctttagttgcaattcaaaccttgcacaaaatcgaagaattcatactggagaaagtctca

SEQ ID NO: 9036 - DNA, 201 bp, Homo sapiens
gactattcaggccttattgcccatcttctaattcatagtggaaagaaaccttacaaatgtcatgaacgtggcaaggtcttcaggcatagtttatccctaarcaatcatcagagaattcatactggagagaggccttacaaatgttatgaatgtggcaaggtcttcaatcaaattgcacaccttgcacgacattggagaact

SEQ ID NO: 9037 - DNA, 101 bp, Homo sapiens
agcactccagcctgggcgacagagaaagactctgtctcaaaaaaaaaaaaaaaagaaagaaagaaaagaaagaaaaaatttcttctggtgtgaaaactcac

SEQ ID NO: 9038 - DNA, 201 bp, Homo sapiens
gatttttttgattctccattgctcccacaagaacagaaaacacacattagggaaaaatcttatgaatgtaatgagcatggcaaagtctttagagtgtcttyaagccttggtaaccatgacataatcctggatccagataaactttacaaatgtaatgagtgtggtaaagtctttaggaaaaattcatacattgtacaacat

SEQ ID NO: 9039 - DNA, 201 bp, Homo sapiens
taggttataaaagacactgcagcttctacttgagccctctctctctgccacccaccgcccccaatctatcttggctcactcgctctgggggaagctagctkccatgctatgagcaggcctataaagagacttacgtggtaaaaaatgaagtctcctgcccacagccacattagtgaacctagaagcagagactctgtgaga

SEQ ID NO: 9040 - DNA, 201 bp, Homo sapiens
gccctctctctctgccacccaccgcccccaatctatcttggctcactcgctctgggggaagctagctgccatgctatgagcaggcctataaagagacttaygtggtaaaaaatgaagtctcctgcccacagccacattagtgaacctagaagcagagactctgtgagataatcgatgtttgttgttttaagttgctcagtt

SEQ ID NO: 9041 - DNA, 201 bp, Homo sapiens
cagacatcatctctgattgtcctcagcctccacttccccagagtaaattcaaattgaatcgagctctgctgctctggttggttgtagtagtgatcaggaawcagatctcagcaaagccactgaggaggaggctgtgctgagtttgtgtggctggaatctctgggtaaggaacttaaagaacaaaaatcatctggtaattct

SEQ ID NO: 9042 - DNA, 201 bp, Homo sapiens
acgtgccccccagaactccctgggcagagccagctcgggtgaggggtgagtggaggagacccatggcggacaatcactctctctgctctcaggacccccasgtctgacttagtgggcacctgaccactttgtcttctggttcccagtttggataaattctgagatttggagctcagtccacggtcctcccccactggatgg

SEQ ID NO: 9043 - DNA, 201 bp, Homo sapiens
aagctaagaaacaccaaggattgtggcaaccatcagaagcttggaagaggcaaagaagaattcttccctagaggctttagagggataacggctctgctgamaccttaatctcagacttccagcctcctgaacgaagaaagaataaatttcggctgttttaagccaccaaggataattggttacagcagctctaggaaacta

SEQ ID NO: 9044 - DNA, 201 bp, Homo sapiens
ttttctacaatgaagatgaattccttgtataaaaataagaaaagaaattaatcttgaggtaagcagagcagacatcatctctgattgtcctcagcctccamttccccagagtaaattcaaattgaatcgagctctgctgctctggttggttgtagtagtgatcaggaaacagatctcagcaaagccactgaggaggaggct

SEQ ID NO: 9045 - DNA, 201 bp, Homo sapiens
taactgacaagtgttaccctgagccccgcaggccaacccatccccagttgagccttatagggtcagtagctctccacatgaagtcctgtcactcaccactrtgcaggagagggaggtggtcatagagtcagggatctatggcccttggcccagccccacccccttccctttaatcctgccactgtcatatgctacctttcc

SEQ ID NO: 9046 - DNA, 201 bp, Homo sapiens
gtagttagttaagacaaggtcatgctggatgaaggtagacctaaattcaatatgactggtttccttgtatgaaaaggagaggacacagagacagaggagaygcggggaagactatgtaaagatgaaggcagagatcggagttttgcagccacaagctaagaaacaccaaggattgtggcaaccatcagaagcttggaagag

SEQ ID NO: 9047 - DNA, 201 bp, Homo sapiens
ccttccctttaatcctgccactgtcatatgctacctttcctatctcttccctcatcatcttgttgtgggcatgaggaggtggtgatgtcagaagaaatggytcgagctcagaagataaaagataagtagggtatgctgatcctcttttaaaaacccaagatacaatcaaaatcccagatgctggtctctattcccatgaaa

SEQ ID NO: 9048 - DNA, 201 bp, Homo sapiens
acctgaccactttgtcttctggttcccagtttggataaattctgagatttggagctcagtccacggtcctcccccactggatggtgctactgctgtggaaycttgtaaaaaccatgtggggtaaactgggaataacatgaaaagatttctgtgggggtggggtgggggagtggtgggaatcattcctgcttaatggtaact

SEQ ID NO: 9049 - DNA, 201 bp, Homo sapiens
gtaaaaaccatgtggggtaaactgggaataacatgaaaagatttctgtgggggtggggtgggggagtggtgggaatcattcctgcttaatggtaactgacmagtgttaccctgagccccgcaggccaacccatccccagttgagccttatagggtcagtagctctccacatgaagtcctgtcactcaccactgtgcaggag

SEQ ID NO: 9050 - DNA, 201 bp, Homo sapiens
ggtcagtagctctccacatgaagtcctgtcactcaccactgtgcaggagagggaggtggtcatagagtcagggatctatggcccttggcccagccccaccyccttccctttaatcctgccactgtcatatgctacctttcctatctcttccctcatcatcttgttgtgggcatgaggaggtggtgatgtcagaagaaatgg

SEQ ID NO: 9051 - DNA, 201 bp, Homo sapiens
tatttctttatagaaaaaagtctggaagagtttacttcaattgtagcaatgtcagggtggtggcagtataggtgatttttcttttaattctgttaatttayctgtatttcctaatttttctacaatgaagatgaattccttgtataaaaataagaaaagaaattaatcttgaggtaagcagagcagacatcatctctgatt

SEQ ID NO: 9052 - DNA, 201 bp, Homo sapiens
ccttggcccagccccacccccttccctttaatcctgccactgtcatatgctacctttcctatctcttccctcatcatcttgttgtgggcatgaggaggtgstgatgtcagaagaaatggctcgagctcagaagataaaagataagtagggtatgctgatcctcttttaaaaacccaagatacaatcaaaatcccagatgct

SEQ ID NO: 9053 - DNA, 201 bp, Homo sapiens
ggataacggctctgctgaaaccttaatctcagacttccagcctcctgaacgaagaaagaataaatttcggctgttttaagccaccaaggataattggttayagcagctctaggaaactaatacagctgctaaaatgatccctgtctcctcgtgtttacattctgtgtgtgtcccctcccacaatgtaccaaagttgtcttt

SEQ ID NO: 9054 - DNA, 201 bp, Homo sapiens
ctgaagccgatcagcctgtcagactcacccagcttcccgagaatggtggctggaatgcccccatcacagacttctacttccagcagtgtgactagggcaaygtgccccccagaactccctgggcagagccagctcgggtgaggggtgagtggaggagacccatggcggacaatcactctctctgctctcaggacccccacg

SEQ ID NO: 9055 - DNA, 201 bp, Homo sapiens
ttggtgccaaggaatccaagagcttcaccttctaccggcgggacatggggctcacctccagcttcgagtcggctgcctacccgggctggttcctgtgcacsgtgcctgaagccgatcagcctgtcagactcacccagcttcccgagaatggtggctggaatgcccccatcacagacttctacttccagcagtgtgactagg

SEQ ID NO: 9056 - DNA, 201 bp, Homo sapiens
gataacggctctgctgaaaccttaatctcagacttccagcctcctgaacgaagaaagaataaatttcggctgttttaagccaccaaggataattggttacrgcagctctaggaaactaatacagctgctaaaatgatccctgtctcctcgtgtttacattctgtgtgtgtcccctcccacaatgtaccaaagttgtctttg

SEQ ID NO: 9057 - DNA, 201 bp, Homo sapiens
ctcagtccacggtcctcccccactggatggtgctactgctgtggaaccttgtaaaaaccatgtggggtaaactgggaataacatgaaaagatttctgtggrggtggggtgggggagtggtgggaatcattcctgcttaatggtaactgacaagtgttaccctgagccccgcaggccaacccatccccagttgagccttata

SEQ ID NO: 9058 - DNA, 201 bp, Homo sapiens
tcctgcttaatggtaactgacaagtgttaccctgagccccgcaggccaacccatccccagttgagccttatagggtcagtagctctccacatgaagtcctstcactcaccactgtgcaggagagggaggtggtcatagagtcagggatctatggcccttggcccagccccacccccttccctttaatcctgccactgtcat

SEQ ID NO: 9059 - DNA, 201 bp, Homo sapiens
tcattcctgcttaatggtaactgacaagtgttaccctgagccccgcaggccaacccatccccagttgagccttatagggtcagtagctctccacatgaagwcctgtcactcaccactgtgcaggagagggaggtggtcatagagtcagggatctatggcccttggcccagccccacccccttccctttaatcctgccactg

SEQ ID NO: 9060 - DNA, 201 bp, Homo sapiens
cccagagtaaattcaaattgaatcgagctctgctgctctggttggttgtagtagtgatcaggaaacagatctcagcaaagccactgaggaggaggctgtgmtgagtttgtgtggctggaatctctgggtaaggaacttaaagaacaaaaatcatctggtaattctttcctagaaggatcacagcccctgggattccaaggc

SEQ ID NO: 9061 - DNA, 201 bp, Homo sapiens
ttaattctgttaatttatctgtatttcctaatttttctacaatgaagatgaattccttgtataaaaataagaaaagaaattaatcttgaggtaagcagagyagacatcatctctgattgtcctcagcctccacttccccagagtaaattcaaattgaatcgagctctgctgctctggttggttgtagtagtgatcaggaaa

SEQ ID NO: 9062 - DNA, 184 bp, Homo sapiens
ctatgagcaggcctataaagagacttacgtggtaaaaaatgaagtctcctgcccacagccacattagtgaacctagaagcagagactctgtgagataatcratgtttgttgttttaagttgctcagttttggtctaacttgttatgcagcaatagataaataatatgcagagaaagagaaacaa

SEQ ID NO: 9063 - DNA, 201 bp, Homo sapiens; identical to SEQ ID NO: 9039

SEQ ID NO: 9064 - DNA, 201 bp, Homo sapiens; identical to SEQ ID NO: 9040

SEQ ID NO: 9065 - DNA, 201 bp, Homo sapiens; identical to SEQ ID NO: 9041

SEQ ID NO: 9066 - DNA, 201 bp, Homo sapiens; identical to SEQ ID NO: 9042

SEQ ID NO: 9067 - DNA, 201 bp, Homo sapiens; identical to SEQ ID NO: 9043

SEQ ID NO: 9068 - DNA, 201 bp, Homo sapiens; identical to SEQ ID NO: 9044

SEQ ID NO: 9069 - DNA, 201 bp, Homo sapiens; identical to SEQ ID NO: 9045

SEQ ID NO: 9070 - DNA, 201 bp, Homo sapiens; identical to SEQ ID NO: 9046

SEQ ID NO: 9071 - DNA, 201 bp, Homo sapiens; identical to SEQ ID NO: 9047

SEQ ID NO: 9072 - DNA, 201 bp, Homo sapiens; identical to SEQ ID NO: 9048

SEQ ID NO: 9073 - DNA, 201 bp, Homo sapiens; identical to SEQ ID NO: 9049

SEQ ID NO: 9074 - DNA, 201 bp, Homo sapiens; identical to SEQ ID NO: 9050

SEQ ID NO: 9075 - DNA, 201 bp, Homo sapiens; identical to SEQ ID NO: 9051

SEQ ID NO: 9076 - DNA, 201 bp, Homo sapiens; identical to SEQ ID NO: 9052

SEQ ID NO: 9077 - DNA, 201 bp, Homo sapiens; identical to SEQ ID NO: 9053

SEQ ID NO: 9078 - DNA, 201 bp, Homo sapiens; identical to SEQ ID NO: 9054

SEQ ID NO: 9079 - DNA, 201 bp, Homo sapiens; identical to SEQ ID NO: 9055

SEQ ID NO: 9080 - DNA, 201 bp, Homo sapiens; identical to SEQ ID NO: 9056

SEQ ID NO: 9081 - DNA, 201 bp, Homo sapiens; identical to SEQ ID NO: 9057

SEQ ID NO: 9082 - DNA, 201 bp, Homo sapiens; identical to SEQ ID NO: 9058

SEQ ID NO: 9083 - DNA, 201 bp, Homo sapiens; identical to SEQ ID NO: 9059

SEQ ID NO: 9084 - DNA, 201 bp, Homo sapiens; identical to SEQ ID NO: 9060

SEQ ID NO: 9085 - DNA, 201 bp, Homo sapiens; identical to SEQ ID NO: 9061

SEQ ID NO: 9086 - DNA, 184 bp, Homo sapiens; identical to SEQ ID NO: 9062

SEQ ID NO: 9087 - DNA, 201 bp, Homo sapiens
gaaactgtgacctgtgaggatgcccaaaagacctgccctgcagtgattgcctgtagctctccaggcatcaacggcttcccaggcaaagatgggcgtgatgrcaccaagggagaaaagggggaaccaggccaagggctcagaggcttacagggcccccctggaaagttggggcctccaggaaatccagggccttctgggtca

SEQ ID NO: 9088 - DNA, 201 bp, Homo sapiens
ttactcagaaactgtgacctgtgaggatgcccaaaagacctgccctgcagtgattgcctgtagctctccaggcatcaacggcttcccaggcaaagatgggygtgatggcaccaagggagaaaagggggaaccaggccaagggctcagaggcttacagggcccccctggaaagttggggcctccaggaaatccagggccttc

SEQ ID NO: 9089 - DNA, 201 bp, Homo sapiens
aaaaaggagaccctggaaaaagtccggatggtgatagtagcctggctgcctcagaaagaaaagctctgcaaacagaaatggcacgtatcaaaaagtggctsaccttctctctgggcaaacaagttgggaacaagttcttcctgaccaatggtgaaataatgacctttgaaaaagtgaaggccttgtgtgtcaagttccagg

SEQ ID NO: 9090 - DNA, 201 bp, Homo sapiens
tcctgagtatggtggcagcgtcttactcagaaactgtgacctgtgaggatgcccaaaagacctgccctgcagtgattgcctgtagctctccaggcatcaayggcttcccaggcaaagatgggcgtgatggcaccaagggagaaaagggggaaccaggccaagggctcagaggcttacagggcccccctggaaagttggggc

SEQ ID NO: 9091 - DNA, 201 bp, Homo sapiens
acctgtgaggatgcccaaaagacctgccctgcagtgattgcctgtagctctccaggcatcaacggcttcccaggcaaagatgggcgtgatggcaccaaggragaaaagggggaaccaggccaagggctcagaggcttacagggcccccctggaaagttggggcctccaggaaatccagggccttctgggtcaccaggacca

SEQ ID NO: 9092 - DNA, 201 bp, Homo sapiens; identical to SEQ ID NO: 9087

SEQ ID NO: 9093 - DNA, 201 bp, Homo sapiens
actgggaccacattgagtctatcaatcaacttatgcagaactggcaacttactactgaatctctaatcaatgttcatcatgtatcgcttcatgtaactagratttctttaacttaattgctatgttttgacatttttagtttaaaaaccttgtatatcttgttttggtggttttagtgattttaataatatattttaaata

SEQ ID NO: 9094 - DNA, 201 bp, Homo sapiens
gtaagctgaaaatatggcaatacttgcttcttcccaattgctttaccttttttcttaccttattgcactggttagcaaccccaatacagagaccaccagakcaggtatagactcctgaaagacaatataatgaagtgctccagtcaggcctatctaaactggattcacagctctgtcacttaattgctacatgatctagag

SEQ ID NO: 9095 - DNA, 201 bp, Homo sapiens
gtgtgtgtgtctgtttctgggctgtctattctagtctatttgttgatgcttgtgtcaaacagtacactatcttaattattgtacatttatagttgtaactrtagtccagctttgttcttcttaaagtcaagatttccatataaatattagaaacagcttctcaatttctacaaaatcctgatgaggtttctactgggacca

SEQ ID NO: 9096 - DNA, 201 bp, Homo sapiens
tgaaatcatgaagatatttttccatttttttctaatagttttattaataaacattctatctattcctggtagaatagatatccacttgagacagcactatrtaggaaagaccatttttcctccactgaactagggtggtgcatttttgtaagttaggtaactgtatgtgtgtgtgtctgtttctgggctgtctattctagt

SEQ ID NO: 9097 - DNA, 201 bp, Homo sapiens
tgtctattctagtctatttgttgatgcttgtgtcaaacagtacactatcttaattattgtacatttatagttgtaactatagtccagctttgttcttcttmaagtcaagatttccatataaatattagaaacagcttctcaatttctacaaaatcctgatgaggtttctactgggaccacattgagtctatcaatcaactt

SEQ ID NO: 9098 - DNA, 201 bp, Homo sapiens
aaacagtacactatcttaattattgtacatttatagttgtaactatagtccagctttgttcttcttaaagtcaagatttccatataaatattagaaacagyttctcaatttctacaaaatcctgatgaggtttctactgggaccacattgagtctatcaatcaacttatgcagaactggcaacttactactgaatctctaa

SEQ ID NO: 9099 - DNA, 201 bp, Homo sapiens
gtaaagtgatatttccccatggttttaatctgtatttccccaacatgtaataaggttgaacacttttttatatgcttattgggcacttgggtatcttcttytgtgaagtacccgttcacatttttgtattttgtttaaattagttagccaatatttttcttactgatttttaagttatttttacattctgaatatgtcctt

SEQ ID NO: 9100 - DNA, 201 bp, Homo sapiens
tcctgaaagacaatataatgaagtgctccagtcaggcctatctaaactggattcacagctctgtcacttaattgctacatgatctagagccagttactttktgtttcagccatgtatttgcagctgagagaaaataatcattcttatttcatgaaaattgtggggatgatgaaataagttaacacctttaaagtgtgtagt

SEQ ID NO: 9101 - DNA, 201 bp, Homo sapiens
tttagtagatattaccagttttcctaagtgattgtatgaatttatgctcctaccggcaatgtgtggcagtcctagatgctctatgtgcttgtaaaaagtcratgttttcagttctcttgattttcattattcctgtggatgtaaagtgatatttccccatggttttaatctgtatttccccaacatgtaataaggttgaac

SEQ ID NO: 9102 - DNA, 201 bp, Homo sapiens
tttagtgattttaataatatattttaaatattttttcttttctattgttgtacacagaaatacagttaagttttgtgtgtagtcttacgatgtttagtaamctcaataagtttatttcttaaatctagtaatttgtagattcctctggattttgtatatgcatagtcatgtaagctgaaaatatggcaatacttgcttctt

SEQ ID NO: 9103 - DNA, 201 bp, Homo sapiens; identical to SEQ ID NO: 9088

SEQ ID NO: 9104 - DNA, 201 bp, Homo sapiens
aggaaaatactattctgacctccatgactgcacagtaatttcgtctgtttataaacattgtatagttggaatcatattgtgtgtaatgttgtatgtcttgyttactcagaattaagtctgtgagattcattcatgtcatgtgtacaaaagtttcatccttttcattgccatgtagggttcccttatattaatattcctcag

SEQ ID NO: 9105 - DNA, 201 bp, Homo sapiens; identical to SEQ ID NO: 9089

SEQ ID NO: 9106 - DNA, 201 bp, Homo sapiens
aggtttctactgggaccacattgagtctatcaatcaacttatgcagaactggcaacttactactgaatctctaatcaatgttcatcatgtatcgcttcatktaactagaatttctttaacttaattgctatgttttgacatttttagtttaaaaaccttgtatatcttgttttggtggttttagtgattttaataatatat

SEQ ID NO: 9107 - DNA, 201 bp, Homo sapiens; identical to SEQ ID NO: 9091

SEQ ID NO: 9108 - DNA, 201 bp, Homo sapiens; identical to SEQ ID NO: 9090

SEQ ID NO: 9109 - DNA, 201 bp, Homo sapiens
agtggcccatccagtgcccaggtgcggggctccccgtgtgcacccctgagaaagacttcgctgagcacctcctcatcccacgcaccaggggcctcctcagyggctgggcacgcaatggcactgacctgggcaactcgctgaccacgcggcctgtcacacttgtggagggggaggagtgcgggcaggtcctgaatgtgactg

SEQ ID NO: 9110 - DNA, 201 bp, Homo sapiens
gctcacatggtccttgtcaccaaggtctccaggtactcactctggtttaaacagatcatgaactaactgaaactcagctagccagaatgaacaacacaacyggaagcgggattccaagctggcactgccactgtggagggcgctgaaacttcatcacacactgagaggccgtcacagccccagaccacccgcttggcccac

SEQ ID NO: 9111 - DNA, 201 bp, Homo sapiens
ctgagaaagacttcgctgagcacctcctcatcccacgcaccaggggcctcctcagcggctgggcacgcaatggcactgacctgggcaactcgctgaccacrcggcctgtcacacttgtggagggggaggagtgcgggcaggtcctgaatgtgactgtcaccaccaggacctactgtgagagaagcagcgtggcggccatgc

SEQ ID NO: 9112 - DNA, 201 bp, Homo sapiens
gaggtggaagcgtgcgggctcctatcttctggaagaactcttcgagggaaacttggaaaaagaatgttatgaagaaatctgtgtctatgaagaagcaagaraagtgtttgaaaatgaagtagtcactgatgaattctggagacgatataagggcggctccccgtgcatctcccagccctgcctccacaacggctcttgcca

SEQ ID NO: 9113 - DNA, 200 bp, Homo sapiens
tgtagccctgtcccagcactccgggtgggaatggcaggctgcgtcccactgctccagggcctggtcctggtcctcgccctccatcgtgtggagccctcartatttctcccggcctccaaagcaaacgacgttctggtgaggtggaagcgtgcgggctcctatcttctggaagaactcttcgagggaaacttggaaaaaga

SEQ ID NO: 9114 - DNA, 201 bp, Homo sapiens
gaaacttggaaaaagaatgttatgaagaaatctgtgtctatgaagaagcaagagaagtgtttgaaaatgaagtagtcactgatgaattctggagacgatayaagggcggctccccgtgcatctcccagccctgcctccacaacggctcttgccaggacagcatctggggctacacctgcacctgctcccccggctatgagg

SEQ ID NO: 9115 - DNA, 201 bp, Homo sapiens
gctatgagggcagcaactgcgagctggctaaaaatgaatgtcacccagagcggactgatgggtgtcaacacttctgcctcccaggacaggaatcctacacrtgcagctgtgctcagggctacaggcttggtgaggaccacaaacagtgtgtgccccacgaccagtgtgcctgcggggtgctgacctctgagaagcgtgcac

SEQ ID NO: 9116 - DNA, 118 bp, Homo sapiens
tgtagccctgtcccagcrctccgggtgggaatggcaggctgcgtcccactgctccagggcctggtcctggtcctcgccctccatcgtgtggagccctcagtatttctcccggcctcca

SEQ ID NO: 9117 - DNA, 201 bp, Homo sapiens
ctgtcactgctggagctggagtggcccatccagtgcccaggtgcggggctccccgtgtgcacccctgagaaagacttcgctgagcacctcctcatcccacrcaccaggggcctcctcagcggctgggcacgcaatggcactgacctgggcaactcgctgaccacgcggcctgtcacacttgtggagggggaggagtgcggg

SEQ ID NO: 9118 - DNA, 201 bp, Homo sapiens; identical to SEQ ID NO: 9110

SEQ ID NO: 9119 - DNA, 201 bp, Homo sapiens; identical to SEQ ID NO: 9114

SEQ ID NO: 9120 - DNA, 201 bp, Homo sapiens; identical to SEQ ID NO: 9115

SEQ ID NO: 9121 - DNA, 201 bp, Homo sapiens; identical to SEQ ID NO: 9112

SEQ ID NO: 9122 - DNA, 118 bp, Homo sapiens; identical to SEQ ID NO: 9116

SEQ ID NO: 9123 - DNA, 200 bp, Homo sapiens; identical to SEQ ID NO: 9113

SEQ ID NO: 9124 - DNA, 201 bp, Homo sapiens
gctgacctctgagaagcgtgcaccggatctacaggacctcccgtggcaggcctctaacacaattatctcctgcctgaactgaggtgcagccctcgtgtccmcaatgctccgtacccgagtgtggctgccgtgtggatggcacagcctcaggggccccccttgtaaagttaacaaattccgaaggaaaagacttctgtggtg

SEQ ID NO: 9125 - DNA, 201 bp, Homo sapiens; identical to SEQ ID NO: 9109

SEQ ID NO: 9126 - DNA, 201 bp, Homo sapiens; identical to SEQ ID NO: 9110

SEQ ID NO: 9127 - DNA, 201 bp, Homo sapiens; identical to SEQ ID NO: 9111

SEQ ID NO: 9128 - DNA, 201 bp, Homo sapiens; identical to SEQ ID NO: 9112

SEQ ID NO: 9129 - DNA, 170 bp, Homo sapiens
atggcaggctgcgtcccactgctccagggcctggtcctggtcctcgccctccatcgtgtggagccctcarccacttcactgaaggaacgacatggactccattctgactctgcctgcacaggcgtccaggaaagcttatttctcccggcctccaaagcaaacgacgttct

SEQ ID NO: 9130 - DNA, 201 bp, Homo sapiens; identical to SEQ ID NO: 9115

SEQ ID NO: 9131 - DNA, 201 bp, Homo sapiens; identical to SEQ ID NO: 9114

SEQ ID NO: 9132 - DNA, 201 bp, Homo sapiens; identical to SEQ ID NO: 9117

SEQ ID NO: 9133 - DNA, 201 bp, Homo sapiens
agagttcagtcaacagagccatgggcctgggcagtccgatgatgcctgctctgagcccaccaacaagaagatgcgccgcaaccggttcaaatgggggcccrcgtcccagcaaatcttgtaccaggcctacgatcggcaaaagaaccccagcaaggaagagagagaggccttagtggaggaatgcaacagggcagaatgttt

SEQ ID NO: 9134 - DNA, 201 bp, Homo sapiens
cccttggagggctgctaaaatgatcaagggttacatgcagcaacacaacatcccccagagggaggtggtcgatgtcaccggcctgaaccagtcgcacctcycccagcatctcaacaagggcacccctatgaagacccagaagcgtgccgctctgtacacctggtacgtcagaaagcaacgagagatcctccgacaattcaa

SEQ ID NO: 9135 - DNA, 201 bp, Homo sapiens
ccagcaaatcttgtaccaggcctacgatcggcaaaagaaccccagcaaggaagagagagaggccttagtggaggaatgcaacagggcagaatgtttgcagygaggggtgtccccctccaaagcccacggcctgggctccaacttggtcactgaggtccgtgtctacaactggtttgcaaaccgcaggaaggaggaggcatt

SEQ ID NO: 9136 - DNA, 201 bp, Homo sapiens
cggcctgaaccagtcgcacctctcccagcatctcaacaagggcacccctatgaagacccagaagcgtgccgctctgtacacctggtacgtcagaaagcaaygagagatcctccgacaattcaaccagacagtccagagttctggaaatatgacagacaaaagcagtcaggatcagctgctgtttctctttccagagttcag

SEQ ID NO: 9137 - DNA, 201 bp, Homo sapiens
agccctttaccctatttgtctccttccctcttcttctccctgtgtggctgctgactcagcggtcattctacactgaggaggctgccttatgggtgggccasatccaaaccgcaggcaaacgggtcgtgatggcgtggcaaccctcactgtgttggaggatggcactccggccacctcctccatctctggccatatcctgcc

SEQ ID NO: 9138 - DNA, 201 bp, Homo sapiens
aaatggagaaataggaccttccacacagggtgcatgtgaggatgaaaggagtgaatgtataaagacacctttcccgataacccatactaccctcattatgrctcttaacattagagagggctaaacaagggcagtgagaagactggcaggcagcagaaatcattttctttttgatctcacacaccagggcattccccctaa

SEQ ID NO: 9139 - DNA, 201 bp, Homo sapiens
gtctacctctgtcacccgagctagagtgcagtggtgcagtcttggctcactacagcctcgaactcctggtctcaagcagtcctcctgtcttagcctcccawagtgctgggattacagttgtgagattgtgcccagcccttctgctttaattttcactctgggctcctcaacatggtccttgtcccaagcccagggactggc

SEQ ID NO: 9140 - DNA, 201 bp, Homo sapiens
catagcactgcctcttccagggcctctgggagcctgacagtgcccagcatgaaggtggggccagtgctgggggtttctgtaggtcccactcccacagaggrgagaggctcagccacacaggaagaaagtcttggttacttaagaggcagagaagcccctaggcaaagactggcctgattgcagagtaacttcgccccttta

SEQ ID NO: 9141 - DNA, 201 bp, Homo sapiens
tttttttttttttgagagacagggtctacctctgtcacccgagctagagtgcagtggtgcagtcttggctcactacagcctcgaactcctggtctcaagcrgtcctcctgtcttagcctcccaaagtgctgggattacagttgtgagattgtgcccagcccttctgctttaattttcactctgggctcctcaacatggtcc

SEQ ID NO: 9142 - DNA, 201 bp, Homo sapiens
catgcttgattgagtgctcctgtgtgctgggccctggcctggattagaatgcctctgctgtgggctttgggtttgtcaggatggaatcctacagcctcctygggggaaagcacacctcatgctgagcgctgtgttaggcacaggctgggatggagcacttcttctggtccttcattcttctggcaaagctggcttcctaga

SEQ ID NO: 9143 - DNA, 201 bp, Homo sapiens
cggccacgccaagggccgcttgtccggcgacgagggctccgaggacggcgacgactatgacacacctcccatcctcaaggagctgcaggcgctcaacacckaggaggcggcggagcagcgggcggaggtggaccggatgctcagtgaggacccttggagggctgctaaaatgatcaagggttacatgcagcaacacaacat

SEQ ID NO: 9144 - DNA, 201 bp, Homo sapiens
ttttttttttttttttgagagacagggtctacctctgtcacccgagctagagtgcagtggtgcagtcttggctcactacagcctcgaactcctggtctcawgcagtcctcctgtcttagcctcccaaagtgctgggattacagttgtgagattgtgcccagcccttctgctttaattttcactctgggctcctcaacatgg

SEQ ID NO: 9145 - DNA, 201 bp, Homo sapiens
tccaagctcacgtcgctccagcaagaactcctgagcgccctgctgagctccggggtcaccaaggaggtgctggttcaggccttggaggagttgctgccatycccgaacttcggggtgaagctggagacgctgcccctgtcccctggcagcggggccgagcccgacaccaagccggtcttccatactctcaccaacggccac

SEQ ID NO: 9146 - DNA, 201 bp, Homo sapiens
atgactcttaacattagagagggctaaacaagggcagtgagaagactggcaggcagcagaaatcattttctttttgatctcacacaccagggcattccccstaagaggcagtgagatgtagcctggccctggaactagaaacagaggtggctgctgtgctagtgcctgagatgcacgatgctggggtcaaagacttgtgtc

SEQ ID NO: 9147 - DNA, 201 bp, Homo sapiens
tttttttttttttttttgagagacagggtctacctctgtcacccgagctagagtgcagtggtgcagtcttggctcactacagcctcgaactcctggtctcwagcagtcctcctgtcttagcctcccaaagtgctgggattacagttgtgagattgtgcccagcccttctgctttaattttcactctgggctcctcaacatg

SEQ ID NO: 9148 - DNA, 201 bp, Homo sapiens
gtgcagtcttggctcactacagcctcgaactcctggtctcaagcagtcctcctgtcttagcctcccaaagtgctgggattacagttgtgagattgtgcccrgcccttctgctttaattttcactctgggctcctcaacatggtccttgtcccaagcccagggactggcttctctttctctgagtgtagttatgtatctggg

SEQ ID NO: 9149 - DNA, 201 bp, Homo sapiens
gctgcctttcttctgtcttttttttttttttttttttttgagagacagggtctacctctgtcacccgagctagagtgcagtggtgcagtcttggctcactrcagcctcgaactcctggtctcaagcagtcctcctgtcttagcctcccaaagtgctgggattacagttgtgagattgtgcccagcccttctgctttaattt

SEQ ID NO: 9150 - DNA, 201 bp, Homo sapiens
acctctgtcacccgagctagagtgcagtggtgcagtcttggctcactacagcctcgaactcctggtctcaagcagtcctcctgtcttagcctcccaaagtkctgggattacagttgtgagattgtgcccagcccttctgctttaattttcactctgggctcctcaacatggtccttgtcccaagcccagggactggcttct

SEQ ID NO: 9151 - DNA, 201 bp, Homo sapiens
cagttatgggacactgaatattatcagtggctgcctttcttctgtcttttttttttttttttttttttgagagacagggtctacctctgtcacccgagctrgagtgcagtggtgcagtcttggctcactacagcctcgaactcctggtctcaagcagtcctcctgtcttagcctcccaaagtgctgggattacagttgtga

SEQ ID NO: 9152 - DNA, 201 bp, Homo sapiens
gtgtaatagatcctattactgtttctggagcaacagttatgggacactgaatattatcagtggctgcctttcttctgtcttttttttttttttttttttttgagagacagggtctacctctgtcacccgagctagagtgcagtggtgcagtcttggctcactacagcctcgaactcctggtctcaagcagtcctcctgtct

SEQ ID NO: 9153 - DNA, 201 bp, Homo sapiens
tgtccccctccaaagcccacggcctgggctccaacttggtcactgaggtccgtgtctacaactggtttgcaaaccgcaggaaggaggaggcattccggcaraagctggccatggacgcctatagctccaaccagactcacagcctgaaccctctgctctcccacggctccccccaccaccagcccagctcctctcctccaa

SEQ ID NO: 9154 - DNA, 201 bp, Homo sapiens
cagcccgaagcccagtttcccttctatgcagtattgccacaatgcctctcccacgatgtcaaggactcctgtctgtcctggaggtgggagacaaggaaccwccgaagaggaagcaagaaagccgtactgtctatgttgtgatccttcatcgaacaaactgatgcgaaaacttgaatctgttactgaaatgaggagagaagg

SEQ ID NO: 9155 - DNA, 201 bp, Homo sapiens; identical to SEQ ID NO: 9133

SEQ ID NO: 9156 - DNA, 201 bp, Homo sapiens; identical to SEQ ID NO: 9134

SEQ ID NO: 9157 - DNA, 201 bp, Homo sapiens; identical to SEQ ID NO: 9135

SEQ ID NO: 9158 - DNA, 201 bp, Homo sapiens
ttgaatctgttactgaaatgaggagagaaggacatgtgctattgaactgagccaaacacactgtaaatatccacagactccctcccctgcccccatcccamatgatcttgagatttcttttaaagaagtaaatttgtccaatggctgtaaactataaactactgtaattaagtgcaatttcccctctgtgtcctctcccct

SEQ ID NO: 9159 - DNA, 201 bp, Homo sapiens; identical to SEQ ID NO: 9136

SEQ ID NO: 9160 - DNA, 201 bp, Homo sapiens
aagcaagaaagccgtactgtctatgttgtgatccttcatcgaacaaactgatgcgaaaacttgaatctgttactgaaatgaggagagaaggacatgtgctrttgaactgagccaaacacactgtaaatatccacagactccctcccctgcccccatcccacatgatcttgagatttcttttaaagaagtaaatttgtccaa

SEQ ID NO: 9161 - DNA, 201 bp, Homo sapiens
catcaacagtgtggccggcagcctggcagccctgcagcccgtccagttctcccagcagctgcacagccctcaccagcagcccctcatgcagcagagcccargcagccacatggcccagcagcccttcatggcagctgtgactcagctgcagaactcacacatgtacgcacacaagcaggaacccccccagtattcccacac

SEQ ID NO: 9162 - DNA, 201 bp, Homo sapiens
ggagctcagccgtgcactccctaagaaaccccagggcagggaaactggctgtttgatagcagaagaaaaagttgcagtctcagaaagccttccattaaaasaatttattttatcactacccagagtctcatatttctgtctctgatactttccctgccatggttccaccgagaacccctggcccctggtctccttggaatt

SEQ ID NO: 9163 - DNA, 201 bp, Homo sapiens
atgcccacacaccacttacttcgtgcgcaacaacaaggaccctgttttccacaccatcaccctctgggcagctgtcatggaaaagcccagtgacctgaccrgcacctgcgagaggtccctgcttacctgacggacgtcctgctggcacctcagacaatccactctcaggaggcgcagcccgaagcccagtttcccttctat

SEQ ID NO: 9164 - DNA, 201 bp, Homo sapiens; identical to SEQ ID NO: 9143

SEQ ID NO: 9165 - DNA, 201 bp, Homo sapiens; identical to SEQ ID NO: 9145

SEQ ID NO: 9166 - DNA, 201 bp, Homo sapiens; identical to SEQ ID NO: 9153

SEQ ID NO: 9167 - DNA, 112 bp, Homo sapiens
gtcatctaggggtgtagagaggtgggtggccttctcttgccgtcatgctcccagtgtctgtgtaggctttactgctgattgaggtgaagaagagttgaatsccccagtaaga

SEQ ID NO: 9168 - DNA, 201 bp, Homo sapiens
acctcatcatgacacccctctctggagtcatggcaattgcacaaagcctcaacacctcccaagcacagagtgtccctgtcatcaacagtgtggccggcagsctggcagccctgcagcccgtccagttctcccagcagctgcacagccctcaccagcagcccctcatgcagcagagcccaggcagccacatggcccagcagc

SEQ ID NO: 9169 - DNA, 201 bp, Homo sapiens
gatgcccacacaccacttacttcgtgcgcaacaacaaggaccctgttttccacaccatcaccctctgggcagctgtcatggaaaagcccagtgacctgacmagcacctgcgagaggtccctgcttacctgacggacgtcctgctggcacctcagacaatccactctcaggaggcgcagcccgaagcccagtttcccttcta

SEQ ID NO: 9170 - DNA, 201 bp, Homo sapiens
gcccattctactcagtgtatcccagtgtcctggagatgtgatggtgaaaatgattgtgacagtggagaagatgaagaaaactgtggcaatataacatgtastcccgacgagttcacctgctccagtggccgctgcatctccaggaactttgtatgcaatggccaggatgactgcagcgatggcagtgatgagctggactgt

SEQ ID NO: 9171 - DNA, 201 bp, Homo sapiens
ggactggagtgatgagcccctgaaagagtgtcatataaacgaatgcttggtaaataatggtggatgttctcatatctgcaaagacctagttataggctacragtgtgactgtgcagctgggtttgaactgatagataggaaaacctgtggagatattgatgaatgccaaaatccaggaatctgcagtcaaatttgtatcaa

SEQ ID NO: 9172 - DNA, 201 bp, Homo sapiens
gtgtctactggatagatggggaaaatgaagcagtctatggtgccaataaattcactggatcagagctagccactctagtcaacaacctgaatgatgcccargacatcattgtctatcatgaacttgtacagccatcaggtaaaaattggtgtgaagaagacatggagaatggaggatgtgaatacctatgcctgccagcac

SEQ ID NO: 9173 - DNA, 201 bp, Homo sapiens
tggcctaacggaattacacttgaccttataaaaagtcgcctctattggcttgattctaagttgcacatgttatccagcgtggacttgaatggccaagatcrtaggatagtactaaagtctctggagttcctagctcatcctcttgcactaacaatatttgaggatcgtgtctactggatagatggggaaaatgaagcagtc

SEQ ID NO: 9174 - DNA, 201 bp, Homo sapiens
tttactggtcagactggggtgaaccagctaaaatagaaaaagcaggaatgaatggattcgatagacgtccactggtgacagcggatatccagtggcctaayggaattacacttgaccttataaaaagtcgcctctattggcttgattctaagttgcacatgttatccagcgtggacttgaatggccaagatcgtaggatag

SEQ ID NO: 9175 - DNA, 201 bp, Homo sapiens
cggaaccgggagaaaagccaaatgtgaaccctcccaattccagtgcacaaatggtcgctgtattacgctgttgtggaaatgtgatggggatgaagactgtrttgacggcagtgatgaaaagaactgtgtaaagaagacgtgtgctgaatctgacttcgtgtgcaacaatggccagtgtgttcccagccgatggaagtgtga

SEQ ID NO: 9176 - DNA, 201 bp, Homo sapiens
attctactcagtgtatcccagtgtcctggagatgtgatggtgaaaatgattgtgacagtggagaagatgaagaaaactgtggcaatataacatgtagtccygacgagttcacctgctccagtggccgctgcatctccaggaactttgtatgcaatggccaggatgactgcagcgatggcagtgatgagctggactgtgccc

SEQ ID NO: 9177 - DNA, 201 bp, Homo sapiens
agattggcttagagaggaaagaatatatccaactagttgaacagctaagaaacactgtggctctcgatgctgacattgctgcccagaaactattctgggcygatctaagccaaaaggctatcttcagtgcctcaattgatgacaaggttggtagacatgttaaaatgatcgacaatgtctataatcctgcagccattgctg

SEQ ID NO: 9178 - DNA, 201 bp, Homo sapiens
cttcccccgccaactccttcccctccttctccccctttcccctccccgcccccaccttcttcctcctttcggaaggactggtaacttgtcgtgcggagcgracggcggcggcggcggcggcggcggcaccatccaggcgggcaccatgggcacgtccgcgctctgggcgctctggctgctgctcgcgctgtgctgggcgcc

SEQ ID NO: 9179 - DNA, 201 bp, Homo sapiens
ggacaaaacgggttactaagatgaaattgccaaaaaaatttataaactaattttgtacgtatgaatgatatctttgacctcaatggaggtttgcaaagacygagtgttcaaactactgtacattttttttcaagtgctaaaaaattaaaccaagcagcttaaccatggtttgtgcctgttcctctaggatgaactcctatc

SEQ ID NO: 9180 - DNA, 201 bp, Homo sapiens
tctctttttcttcctctcggctggaagaacatcaagatacctttgcgtggatcaagcttgtgtacttgaccgtttttatattacttttgtaaatattcttrtccacattctacttcagctttggatgtggttaccgagtatctgtaacccttgaatttctagacagtattgccacctctggccaaatatgcactttcccta

SEQ ID NO: 9181 - DNA, 201 bp, Homo sapiens; identical to SEQ ID NO: 9170

SEQ ID NO: 9182 - DNA, 201 bp, Homo sapiens; identical to SEQ ID NO: 9171

SEQ ID NO: 9183 - DNA, 201 bp, Homo sapiens; identical to SEQ ID NO: 9172

SEQ ID NO: 9184 - DNA, 201 bp, Homo sapiens; identical to SEQ ID NO: 9173

SEQ ID NO: 9185 - DNA, 201 bp, Homo sapiens; identical to SEQ ID NO: 9174

SEQ ID NO: 9186 - DNA, 201 bp, Homo sapiens; identical to SEQ ID NO: 9175

SEQ ID NO: 9187 - DNA, 201 bp, Homo sapiens; identical to SEQ ID NO: 9176

SEQ ID NO: 9188 - DNA, 201 bp, Homo sapiens; identical to SEQ ID NO: 9177

SEQ ID NO: 9189 - DNA, 201 bp, Homo sapiens; identical to SEQ ID NO: 9178

SEQ ID NO: 9190 - DNA, 201 bp, Homo sapiens; identical to SEQ ID NO: 9180

SEQ ID NO: 9191 - DNA, 201 bp, Homo sapiens; identical to SEQ ID NO: 9170

SEQ ID NO: 9192 - DNA, 201 bp, Homo sapiens; identical to SEQ ID NO: 9171

SEQ ID NO: 9193 - DNA, 201 bp, Homo sapiens; identical to SEQ ID NO: 9172

SEQ ID NO: 9194 - DNA, 201 bp, Homo sapiens; identical to SEQ ID NO: 9173

SEQ ID NO: 9195 - DNA, 201 bp, Homo sapiens; identical to SEQ ID NO: 9174

SEQ ID NO: 9196 - DNA, 201 bp, Homo sapiens; identical to SEQ ID NO: 9175

SEQ ID NO: 9197 - DNA, 201 bp, Homo sapiens; identical to SEQ ID NO: 9176

SEQ ID NO: 9198 - DNA, 201 bp, Homo sapiens; identical to SEQ ID NO: 9177

SEQ ID NO: 9199 - DNA, 201 bp, Homo sapiens; identical to SEQ ID NO: 9178

SEQ ID NO: 9200 - DNA, 201 bp, Homo sapiens; identical to SEQ ID NO: 9180

SEQ ID NO: 9201 - DNA, 201 bp, Homo sapiens; identical to SEQ ID NO: 9170

SEQ ID NO: 9202 - DNA, 201 bp, Homo sapiens; identical to SEQ ID NO: 9171

SEQ ID NO: 9203 - DNA, 201 bp, Homo sapiens; identical to SEQ ID NO: 9172

SEQ ID NO: 9204 - DNA, 201 bp, Homo sapiens; identical to SEQ ID NO: 9173

SEQ ID NO: 9205 - DNA, 201 bp, Homo sapiens; identical to SEQ ID NO: 9174

SEQ ID NO: 9206 - DNA, 201 bp, Homo sapiens; identical to SEQ ID NO: 9175

SEQ ID NO: 9207 - DNA, 201 bp, Homo sapiens; identical to SEQ ID NO: 9176

SEQ ID NO: 9208 - DNA, 201 bp, Homo sapiens; identical to SEQ ID NO: 9177

SEQ ID NO: 9209 - DNA, 201 bp, Homo sapiens; identical to SEQ ID NO: 9178

SEQ ID NO: 9210 - DNA, 201 bp, Homo sapiens; identical to SEQ ID NO: 9179

SEQ ID NO: 9211 - DNA, 201 bp, Homo sapiens; identical to SEQ ID NO: 9180

SEQ ID NO: 9212 - DNA, 201 bp, Homo sapiens
ccatcgagcggcacttgacaatgatcaaaatgaggccttacgacgccaacaagaggcaccgcgtcttcctcctgatcgggatgtgctggctcattgccttyacgctgggcgccctgcccattctgggctggaactgcctgcacaatctccctgactgctctaccatcctgcccctctactccaagaagtacattgccttct

SEQ ID NO: 9213 - DNA, 201 bp, Homo sapiens
atcgagcggcacttgacaatgatcaaaatgaggccttacgacgccaacaagaggcaccgcgtcttcctcctgatcgggatgtgctggctcattgccttcaygctgggcgccctgcccattctgggctggaactgcctgcacaatctccctgactgctctaccatcctgcccctctactccaagaagtacattgccttctgc

SEQ ID NO: 9214 - DNA, 201 bp, Homo sapiens
actgcctgcacaatctccctgactgctctaccatcctgcccctctactccaagaagtacattgccttctgcatcagcatcttcacggccatcctggtgacsatcgtgatcctctacgcacgcatctacttcctggtgaagtccagcagccgtaaggtggccaaccacaacaactcggagcggtccatggcactgctgcgga

SEQ ID NO: 9215 - DNA, 201 bp, Homo sapiens
accatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatc

SEQ ID NO: 9216 - DNA, 201 bp, Homo sapiens; identical to SEQ ID NO: 9212

SEQ ID NO: 9217 - DNA, 201 bp, Homo sapiens; identical to SEQ ID NO: 9213

SEQ ID NO: 9218 - DNA, 201 bp, Homo sapiens; identical to SEQ ID NO: 9214

SEQ ID NO: 9219 - DNA, 201 bp, Homo sapiens; identical to SEQ ID NO: 9215

SEQ ID NO: 9220 - DNA, 201 bp, Homo sapiens
tgctgcttctcatgtgcttcatgcccgagaccccgcgcttcctgctgactcagcacaggcgccaggaggccatggccgccctgcggttcctgtggggctcygagcagggctgggaagacccccccatcggggctgagcagagctttcacctggccctgctgcggcagcccggcatctacaagcccttcatcatcggcgtct

SEQ ID NO: 9221 - DNA, 201 bp, Homo sapiens
ccctccatgcgcaagactaaagcagcggaagaggaggtgggcctctaggatctttgtcttctggctggaggtgcttttggaggttgggtgctgggcattcrgtcgctcctctcacgcggctgccttatcgggaaggaaatttgtttgccaaataaagactgacacagaaaatcaggtcagtgtctctgggctttgtgcaag

SEQ ID NO: 9222 - DNA, 201 bp, Homo sapiens
tgtgtgcagctaatggtcgtcgtcggcatcctcctggcctacctggcaggctgggtgctggagtggcgctggctggctgtgctgggctgcgtgcccccctycctcatgctgcttctcatgtgcttcatgcccgagaccccgcgcttcctgctgactcagcacaggcgccaggaggccatggccgccctgcggttcctgtgg

SEQ ID NO: 9223 - DNA, 201 bp, Homo sapiens
ggctggctgtgctgggctgcgtgcccccctccctcatgctgcttctcatgtgcttcatgcccgagaccccgcgcttcctgctgactcagcacaggcgccargaggccatggccgccctgcggttcctgtggggctccgagcagggctgggaagacccccccatcggggctgagcagagctttcacctggccctgctgcggc

SEQ ID NO: 9224 - DNA, 201 bp, Homo sapiens
atcgggaaggaaatttgtttgccaaataaagactgacacagaaaatcaggtcagtgtctctgggctttgtgcaagctcagtttgaaaagggtttattcccwtcactgcccaggacaccctgtggctttacttgctcatggtcagccaagcttacccttcacactgagaagtcatttctggctacttccttgggctcagttc

SEQ ID NO: 9225 - DNA, 201 bp, Homo sapiens
atgacgcccgaggacccagaggaaacccagccgcttctggggcctcctggcggcaggtctacatctccgaaatcgcctacccagcagtccgggggttgctsggctcctgtgtgcagctaatggtcgtcgtcggcatcctcctggcctacctggcaggctgggtgctggagtggcgctggctggctgtgctgggctgcgtgc

SEQ ID NO: 9226 - DNA, 201 bp, Homo sapiens
gccgccctgcggttcctgtggggctccgagcagggctgggaagacccccccatcggggctgagcagagctttcacctggccctgctgcggcagcccggcayctacaagcccttcatcatcggcgtctccctgatggccttccagcagctgtcgggggtcaacgccgtcatgttctatgcagagaccatctttgaagaggcc

SEQ ID NO: 9227 - DNA, 201 bp, Homo sapiens
gctccgagcagggctgggaagacccccccatcggggctgagcagagctttcacctggccctgctgcggcagcccggcatctacaagcccttcatcatcggygtctccctgatggccttccagcagctgtcgggggtcaacgccgtcatgttctatgcagagaccatctttgaagaggccaagttcaaggacagcagcctgg

SEQ ID NO: 9228 - DNA, 201 bp, Homo sapiens
tggagcaagcctgtgactccaagctgggcccaagcccagagcccctgcctgccccaggggagccagaatccagccccttggagccttggtctgcagggtcyctccttcctgtcatgctccctccagcccatgacccggggctaggaggctcactgcctcctgttccagctcctgctgctgctctgaggactcaggaacacc

SEQ ID NO: 9229 - DNA, 201 bp, Homo sapiens
ggcccatcccctggctcctcatgtcagagatcttccctctgcatgtcaagggcgtggcgacaggcatctgcgtcctcaccaactggctcatggcctttctygtgaccaaggagttcagcagcctcatggaggtcctcaggccctatggagccttctggcttgcctccgctttctgcatcttcagtgtccttttcactttgt

SEQ ID NO: 9230 - DNA, 201 bp, Homo sapiens; identical to SEQ ID NO: 9220

SEQ ID NO: 9231 - DNA, 201 bp, Homo sapiens; identical to SEQ ID NO: 9223

SEQ ID NO: 9232 - DNA, 201 bp, Homo sapiens; identical to SEQ ID NO: 9222

SEQ ID NO: 9233 - DNA, 201 bp, Homo sapiens; identical to SEQ ID NO: 9226

SEQ ID NO: 9234 - DNA, 201 bp, Homo sapiens
agcgcgccgcgcccccggccccgcgcctggacgacgccgccgcctcctggttcggggtctacatctccgaaatcgcctacccagcagtccgggggttgctsggctcctgtgtgcagctaatggtcgtcgtcggcatcctcctggcctacctggcaggctgggtgctggagtggcgctggctggctgtgctgggctgcgtgc

SEQ ID NO: 9235 - DNA, 201 bp, Homo sapiens; identical to SEQ ID NO: 9227

SEQ ID NO: 9236 - DNA, 201 bp, Homo sapiens
ccttggaccgctccgccctaggggcggttccagcgcgcttcgctaatcggttctatgctcccattggtctgctttaatgtgaagggcgggtcctagctgaktcgctagccccgccttgcgttcctattggctgctcctgctctgcggttccgatcccgcccagcaccgtcccccaccccccgccgcccattggctgcgaga

SEQ ID NO: 9237 - DNA, 201 bp, Homo sapiens; identical to SEQ ID NO: 9220

SEQ ID NO: 9238 - DNA, 201 bp, Homo sapiens; identical to SEQ ID NO: 9221

SEQ ID NO: 9239 - DNA, 201 bp, Homo sapiens; identical to SEQ ID NO: 9222

SEQ ID NO: 9240 - DNA, 201 bp, Homo sapiens; identical to SEQ ID NO: 9223

SEQ ID NO: 9241 - DNA, 201 bp, Homo sapiens; identical to SEQ ID NO: 9224

SEQ ID NO: 9242 - DNA, 201 bp, Homo sapiens; identical to SEQ ID NO: 9226

SEQ ID NO: 9243 - DNA, 201 bp, Homo sapiens
tggggggccgcctcctcaccggcctggcctgcggtgttgcctccctagtggccccggtctacatctccgaaatcgcctacccagcagtccgggggttgctsggctcctgtgtgcagctaatggtcgtcgtcggcatcctcctggcctacctggcaggctgggtgctggagtggcgctggctggctgtgctgggctgcgtgc

SEQ ID NO: 9244 - DNA, 201 bp, Homo sapiens; identical to SEQ ID NO: 9227

SEQ ID NO: 9245 - DNA, 201 bp, Homo sapiens; identical to SEQ ID NO: 9228

SEQ ID NO: 9246 - DNA, 201 bp, Homo sapiens; identical to SEQ ID NO: 9229

SEQ ID NO: 9247 - DNA, 201 bp, Homo sapiens; identical to SEQ ID NO: 9220

SEQ ID NO: 9248 - DNA, 201 bp, Homo sapiens; identical to SEQ ID NO: 9222

SEQ ID NO: 9249 - DNA, 201 bp, Homo sapiens; identical to SEQ ID NO: 9223

SEQ ID NO: 9250 - DNA, 201 bp, Homo sapiens; identical to SEQ ID NO: 9226

SEQ ID NO: 9251 - DNA, 201 bp, Homo sapiens; identical to SEQ ID NO: 9243

SEQ ID NO: 9252 - DNA, 201 bp, Homo sapiens; identical to SEQ ID NO: 9228

SEQ ID NO: 9253 - DNA, 201 bp, Homo sapiens; identical to SEQ ID NO: 9227

SEQ ID NO: 9254 - DNA, 201 bp, Homo sapiens; identical to SEQ ID NO: 9229

SEQ ID NO: 9255 - DNA, 201 bp, Homo sapiens
gcagatgaggttcctgcctactgtgtgccaccccaagaagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcggaaggtaccaagttt

SEQ ID NO: 9256 - DNA, 201 bp, Homo sapiens
gtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgc

SEQ ID NO: 9257 - DNA, 201 bp, Homo sapiens
caatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccag

SEQ ID NO: 9258 - DNA, 201 bp, Homo sapiens
aacaactgctcagttccttgtgaatgcccagagggactctgccaccctgtctctgggtcctgccagccaggctctggcagtcgggacactgccctcatcgygggcagccttgtgcctctgctgctgctcttcctgggtcttgcctgctgtgcctgctgctgctgggccccccgatcagacctcaaggacaggccagcgaga

SEQ ID NO: 9259 - DNA, 201 bp, Homo sapiens
tgggctccacgctgccctgccgttccctcagctcccacaagctaccctgggtgacagtctcacatcacgacccggaggtccccttcaaccacagcttcatygagccgccctctgccggctgggccactgatgactccttctcatccgatcctgagtctggagaggcagatgaggttcctgcctactgtgtgccaccccaag

SEQ ID NO: 9260 - DNA, 201 bp, Homo sapiens
gcgcacctccagcctagctcgggccaagcggccatcggtctccttcgcggaaggtaccaagtttgcaccacagagtcgccgaagctcaggggagctctccmgcccgctccgaaagcccaagaggctctcccggggggcgcagtcgggtcctgagggccgggaagccgaagagtccacaggcccagacgaagcagaagcccc

SEQ ID NO: 9261 - DNA, 201 bp, Homo sapiens
gccaagcggccatcggtctccttcgcggaaggtaccaagtttgcaccacagagtcgccgaagctcaggggagctctccagcccgctccgaaagcccaagargctctcccggggggcgcagtcgggtcctgagggccgggaagccgaagagtccacaggcccagacgaagcagaagcccccgagtcctttccggcggctgcc

SEQ ID NO: 9262 - DNA, 201 bp, Homo sapiens
gggccgggaagccgaagagtccacaggcccagacgaagcagaagcccccgagtcctttccggcggctgccagtcccggggattcagccactggccaccggyggcccccacttggtagccggacagtggctgagcacgtggaagccattgagggcagcgtccaggagagctcgggccctgtgaccacgatctacatgctggc

SEQ ID NO: 9263 - DNA, 201 bp, Homo sapiens
ccccttcaaccacagcttcatcgagccgccctctgccggctgggccactgatgactccttctcatccgatcctgagtctggagaggcagatgaggttcctrcctactgtgtgccaccccaagaagggatggtccctgtggcccaggcagggtcgtcagaggccagcctggctgcaggtgctttcccgccccctgaggacgc

SEQ ID NO: 9264 - DNA, 201 bp, Homo sapiens
caggggagctctccagcccgctccgaaagcccaagaggctctcccggggggcgcagtcgggtcctgagggccgggaagccgaagagtccacaggcccagasgaagcagaagcccccgagtcctttccggcggctgccagtcccggggattcagccactggccaccggcggcccccacttggtagccggacagtggctgagc

SEQ ID NO: 9265 - DNA, 201 bp, Homo sapiens
cgcggaaggtaccaagtttgcaccacagagtcgccgaagctcaggggagctctccagcccgctccgaaagcccaagaggctctcccggggggcgcagtcgrgtcctgagggccgggaagccgaagagtccacaggcccagacgaagcagaagcccccgagtcctttccggcggctgccagtcccggggattcagccactgg

SEQ ID NO: 9266 - DNA, 201 bp, Homo sapiens
tctgccaccctgtctctgggtcctgccagccaggctctggcagtcgggacactgccctcatcgtgggcagccttgtgcctctgctgctgctcttcctgggycttgcctgctgtgcctgctgctgctgggccccccgatcagacctcaaggacaggccagcgagagatggagctaccgtgtccaggatgaagctgcaggtct

SEQ ID NO: 9267 - DNA, 201 bp, Homo sapiens
ttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggg

SEQ ID NO: 9268 - DNA, 201 bp, Homo sapiens
agagtccacaggcccagacgaagcagaagcccccgagtcctttccggcggctgccagtcccggggattcagccactggccaccggcggcccccacttggtrgccggacagtggctgagcacgtggaagccattgagggcagcgtccaggagagctcgggccctgtgaccacgatctacatgctggcagggaagccccgcgg

SEQ ID NO: 9269 - DNA, 201 bp, Homo sapiens
tgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacg

SEQ ID NO: 9270 - DNA, 201 bp, Homo sapiens
ctgcaggtgctttcccgccccctgaggacgcctccacgccattcgccatcccgcgcacctccagcctagctcgggccaagcggccatcggtctccttcgcrgaaggtaccaagtttgcaccacagagtcgccgaagctcaggggagctctccagcccgctccgaaagcccaagaggctctcccggggggcgcagtcgggtc

SEQ ID NO: 9271 - DNA, 201 bp, Homo sapiens
gggctgggggctggcaccgagagttcaaggagagcccaggagccagtctctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagac

SEQ ID NO: 9272 - DNA, 201 bp, Homo sapiens
ggcttccgtccattcttccggtggagatggctgcggccgtggcggggatgctgcgagggggtctcctgccccaggcgggccggctgcctaccctccagacygtccgctatggctccaaggctgttacccgccaccgtcgtgtgatgcactttcagcggcagaagctgatggctgtgactgaatatatccccccgaaaccag

SEQ ID NO: 9273 - DNA, 201 bp, Homo sapiens
agagaaattaagtggcttgctcaaggtcatgcagttagtaagtggcagaacagggacttgaaccaagccctctgctctgaagaccgcgtcctgaatttctwcactagagcttcctcatcaggttacccagaagtgggtcccatccaccatccaggtgtgcttggatgttagttctccaccctcgaggtgtacgctgtgaaa

SEQ ID NO: 9274 - DNA, 201 bp, Homo sapiens
ggacaaccgaatgatagccgtctgccagaatgtggctctgagtgcagaggacaagcttcttatgcgacaccagctgcggaaacacaagatcctgatgaagrtcttccccaaccaggtcctgaagcccttcctggaggattccaagtaccaaaatctgctgcccctttttgtggggcacaacatgctgctggtcagtgaaga

SEQ ID NO: 9275 - DNA, 201 bp, Homo sapiens
cctcatcaggttacccagaagtgggtcccatccaccatccaggtgtgcttggatgttagttctccaccctcgaggtgtacgctgtgaaaagtttgggagcmctgctttataataaaatgaaatatattctacttcctttattttgtggtttacacggttgtcctccctctaaacttactctcaggggcttctctgtcatct

SEQ ID NO: 9276 - DNA, 201 bp, Homo sapiens
ggactcgtagccagcctgtttagccagccctgcgcataaatacactctgcgttattggctgtgctctcctcaatgggacatgtggaagaacttggggtcgrggagtgtgtttgtcacttggttttcactagtaatgatattgtcaggtatagggccacttggagatgcagaggattccatttcagatgtcagtcaccggct

SEQ ID NO: 9277 - DNA, 201 bp, Homo sapiens
tccaaggcagagatcctgaaaagatagggctattgtcccctgcctccttggtcactgcctcttgctgcacgggctcctgagcccacccccttggggcacarcctgccactgccacagtagctcaaccaagcagttgtgctgagaatggcacctggtgagagcctgctgtgtgccaggctttgtgctgagtgctgtacatgt

SEQ ID NO: 9278 - DNA, 201 bp, Homo sapiens
acaacctgccactgccacagtagctcaaccaagcagttgtgctgagaatggcacctggtgagagcctgctgtgtgccaggctttgtgctgagtgctgtacrtgtattagttcctttactgctgaccacattgtacccatttcacagagaaggagcagagaaattaagtggcttgctcaaggtcatgcagttagtaagtggc

SEQ ID NO: 9279 - DNA, 201 bp, Homo sapiens
cagaacagggacttgaaccaagccctctgctctgaagaccgcgtcctgaatttcttcactagagcttcctcatcaggttacccagaagtgggtcccatccmccatccaggtgtgcttggatgttagttctccaccctcgaggtgtacgctgtgaaaagtttgggagcactgctttataataaaatgaaatatattctactt

SEQ ID NO: 9280 - DNA, 201 bp, Homo sapiens
tctcggctcactgcaacctccacctcccgggttcaagcgattctcctgcctcagcctctcaagtagctgggattacaggccggctgcctaccctccagacygtccgctatggctccaaggctgttacccgccaccgtcgtgtgatgcactttcagcggcagaagctgatggctgtgactgaatatatccccccgaaaccag

SEQ ID NO: 9281 - DNA, 201 bp, Homo sapiens; identical to SEQ ID NO: 9274

SEQ ID NO: 9282 - DNA, 201 bp, Homo sapiens; identical to SEQ ID NO: 9273

SEQ ID NO: 9283 - DNA, 201 bp, Homo sapiens; identical to SEQ ID NO: 9275

SEQ ID NO: 9284 - DNA, 201 bp, Homo sapiens; identical to SEQ ID NO: 9276

SEQ ID NO: 9285 - DNA, 201 bp, Homo sapiens; identical to SEQ ID NO: 9277

SEQ ID NO: 9286 - DNA, 201 bp, Homo sapiens; identical to SEQ ID NO: 9278

SEQ ID NO: 9287 - DNA, 201 bp, Homo sapiens; identical to SEQ ID NO: 9279

SEQ ID NO: 9288 - DNA, 196 bp, Homo sapiens
gcttccgtccattcttccggtggagatggctgcggccgtggcggggatgctgcgagggggtctcctgccccaggccggctgcctaccctccagacygtccgctatggctccaaggctgttacccgccaccgtcgtgtgatgcactttcagcggcagaagctgatggctgtgactgaatatatccccccgaaaccag

SEQ ID NO: 9289 - DNA, 201 bp, Homo sapiens; identical to SEQ ID NO: 9274

SEQ ID NO: 9290 - DNA, 201 bp, Homo sapiens; identical to SEQ ID NO: 9273

SEQ ID NO: 9291 - DNA, 201 bp, Homo sapiens; identical to SEQ ID NO: 9275

SEQ ID NO: 9292 - DNA, 201 bp, Homo sapiens; identical to SEQ ID NO: 9276

SEQ ID NO: 9293 - DNA, 201 bp, Homo sapiens; identical to SEQ ID NO: 9277

SEQ ID NO: 9294 - DNA, 201 bp, Homo sapiens; identical to SEQ ID NO: 9278

SEQ ID NO: 9295 - DNA, 201 bp, Homo sapiens; identical to SEQ ID NO: 9279

SEQ ID NO: 9296 - DNA, 201 bp, Homo sapiens; identical to SEQ ID NO: 9272

SEQ ID NO: 9297 - DNA, 201 bp, Homo sapiens; identical to SEQ ID NO: 9274

SEQ ID NO: 9298 - DNA, 201 bp, Homo sapiens; identical to SEQ ID NO: 9273

SEQ ID NO: 9299 - DNA, 201 bp, Homo sapiens; identical to SEQ ID NO: 9275

SEQ ID NO: 9300 - DNA, 201 bp, Homo sapiens; identical to SEQ ID NO: 9276

SEQ ID NO: 9301 - DNA, 201 bp, Homo sapiens; identical to SEQ ID NO: 9277

SEQ ID NO: 9302 - DNA, 201 bp, Homo sapiens; identical to SEQ ID NO: 9278

SEQ ID NO: 9303 - DNA, 201 bp, Homo sapiens; identical to SEQ ID NO: 9279

SEQ ID NO: 9304 - DNA, 201 bp, Homo sapiens
gtctgcatctgccacgtgactgagccgggcatgttcttcgggcccctgtgtgagtgccatgagtgggtgtgcgagacctacgacgggagcacctgtgcagrccatggtaagtgtgactgtggcaagtgcaagtgtgaccagggatggtatggggatgcttgccagtacccaactaactgtgacttgacaaagaagaaaagt

SEQ ID NO: 9305 - DNA, 201 bp, Homo sapiens
cctcccttctctttgctgggttgtcagctgttcctcaaagcttctcgccatctctgaggagctggccgggcgccgcctgcaggctgtcccgggccgagtcsgagcgacgctgccgcgcacctgggcagcccccgggggccgcgctgtgccacggccggggccgctgcgactgcggcgtctgcatctgccacgtgactgagc

SEQ ID NO: 9306 - DNA, 201 bp, Homo sapiens
tgtgaagacctcgatggtgtggtctgtggaggccacggcacatgttcctgtggtcgctgtgtttgtgagagaggatggtttggaaagctctgccaacatcygcggaagtgtaacatgacggaagaacaaagcaagaatctgtgtgaatcagcagatggcatattgtgctcggggaagggttcttgtcattgtgggaagtgc

SEQ ID NO: 9307 - DNA, 201 bp, Homo sapiens
acgatgaaacagaagaaatatgtggaggccatgggaagtgttactgtggaaactgctactgcaaggctggttggcatggagataaatgtgaattccagtgygatatcaccccctgggaaagcaagcgaagatgcacgtctccagatggcaaaatctgcagtaacagagggacttgtgtatgtggtgaatgtacctgtcacg

SEQ ID NO: 9308 - DNA, 201 bp, Homo sapiens
gtgaagacctcgatggtgtggtctgtggaggccacggcacatgttcctgtggtcgctgtgtttgtgagagaggatggtttggaaagctctgccaacatccrcggaagtgtaacatgacggaagaacaaagcaagaatctgtgtgaatcagcagatggcatattgtgctcggggaagggttcttgtcattgtgggaagtgca

SEQ ID NO: 9309 - DNA, 201 bp, Homo sapiens
tattaaggatcagaaagttaaactttacggaccacgtacgtccctgtctcatattcttctttgttggtttctgtttaatactttaaagctgtaaaaaaaawttaaaaaattccttctgagctcccaggccatacaaaagcaacttaagggtggatttggctggcagctgggcagtactttgtcagcctcagctccactgga

SEQ ID NO: 9310 - DNA, 201 bp, Homo sapiens
tgacggaagaacaaagcaagaatctgtgtgaatcagcagatggcatattgtgctcggggaagggttcttgtcattgtgggaagtgcatttgttctgctgargagtggtatatttctggggagttctgtgactgtgatgacagagactgcgacaaacatgatggtctcatttgtacagggaatggaatatgtagctgtggaa

SEQ ID NO: 9311 - DNA, 201 bp, Homo sapiens
cccagccatctgctggtggcacctctccctcctgccgcctccctcggtgaaccccaccttgcagaagtgcagctcgcccggagcagcccaggagctcagcrtgcgtcccccaggcttcaggaacttcttgctgctggcgtcctcccttctctttgctgggttgtcagctgttcctcaaagcttctcgccatctctgaggag

SEQ ID NO: 9312 - DNA, 201 bp, Homo sapiens
atggtatggggatgcttgccagtacccaactaactgtgacttgacaaagaagaaaagtaaccaaatgtgcaagaattcacaagacatcatctgctctaatkcaggtacatgtcactgtggcaggtgtaagtgtgataattcagatggaagtggacttgtgtatggtaaattttgtgagtgtgacgatagagaatgcataga

SEQ ID NO: 9313 - DNA, 201 bp, Homo sapiens; identical to SEQ ID NO: 9304

SEQ ID NO: 9314 - DNA, 201 bp, Homo sapiens; identical to SEQ ID NO: 9305

SEQ ID NO: 9315 - DNA, 201 bp, Homo sapiens; identical to SEQ ID NO: 9306

SEQ ID NO: 9316 - DNA, 201 bp, Homo sapiens
acaggttaaaaagaccattgtatgtttttctatttctgaattacgaatgaaatccgagtacctattagaaatgagttatgcaaatttagatgcaaataacrttagaaaaaaaagattcttccataattaacataagtggttcctaacgagagcaatttttccacccaaaagtcatttggcaacatctacagacaattttga

SEQ ID NO: 9317 - DNA, 201 bp, Homo sapiens; identical to SEQ ID NO: 9307

SEQ ID NO: 9318 - DNA, 201 bp, Homo sapiens
atggaatggaaatgcatgtgaaatctggcttggctcagaatatccttaacaattacatgagagaggtctggattcttattttttctgggccattagaacakataaatgcgaaggaaaccatgtatattcaccactaggacaggttaaaaagaccattgtatgtttttctatttctgaattacgaatgaaatccgagtacct

SEQ ID NO: 9319 - DNA, 201 bp, Homo sapiens; identical to SEQ ID NO: 9308

SEQ ID NO: 9320 - DNA, 201 bp, Homo sapiens; identical to SEQ ID NO: 9310

SEQ ID NO: 9321 - DNA, 201 bp, Homo sapiens; identical to SEQ ID NO: 9311

SEQ ID NO: 9322 - DNA, 201 bp, Homo sapiens; identical to SEQ ID NO: 9312

SEQ ID NO: 9323 - DNA, 201 bp, Homo sapiens; identical to SEQ ID NO: 9304

SEQ ID NO: 9324 - DNA, 201 bp, Homo sapiens; identical to SEQ ID NO: 9305

SEQ ID NO: 9325 - DNA, 201 bp, Homo sapiens; identical to SEQ ID NO: 9306

SEQ ID NO: 9326 - DNA, 201 bp, Homo sapiens; identical to SEQ ID NO: 9316

SEQ ID NO: 9327 - DNA, 201 bp, Homo sapiens; identical to SEQ ID NO: 9307

SEQ ID NO: 9328 - DNA, 201 bp, Homo sapiens; identical to SEQ ID NO: 9318

SEQ ID NO: 9329 - DNA, 201 bp, Homo sapiens; identical to SEQ ID NO: 9308

SEQ ID NO: 9330 - DNA, 201 bp, Homo sapiens; identical to SEQ ID NO: 9310

SEQ ID NO: 9331 - DNA, 201 bp, Homo sapiens; identical to SEQ ID NO: 9312

SEQ ID NO: 9332 - DNA, 201 bp, Homo sapiens
ggatgtgcttgagcccggcagctcaccttcagacccaacagacactgggaattttggctttaagaatatgctggacacccgagtggagggagatgtggatktaccaaagacggtgaaggtgaagggaacggcagggctctcgcagaacagcactctggaggtccagacactcagtgtggctcccaaggccctggagacctt

SEQ ID NO: 9333 - DNA, 201 bp, Homo sapiens
gcttgagcccggcagctcaccttcagacccaacagacactgggaattttggctttaagaatatgctggacacccgagtggagggagatgtggatgtaccaragacggtgaaggtgaagggaacggcagggctctcgcagaacagcactctggaggtccagacactcagtgtggctcccaaggccctggagaccttgcagaa

SEQ ID NO: 9334 - DNA, 174 bp, Homo sapiens
gcataaagcagcctgtcctggcaagggatggtcatcctctcaacctacagacccagtgagccctaggccctcarcccagacccagctgctggataggacccagccccgctcccagagacaatgaccatgtttgaaaatgtcacccgggccctggccagacagctaaaccctcga

SEQ ID NO: 9335 - DNA, 201 bp, Homo sapiens
aaaagtcaggagaggagaaggtcatccttatccaggcatctgatgttggggacgtacacgaaggcttcaggacactaaaagaagaagttcagagagagacycaacaagtggagaagctgagccgagtagggcaaagctccctgctcagctccctcagcaaacttctagggaagaaaaaggagctacaagaccttgagctcg

SEQ ID NO: 9336 - DNA, 201 bp, Homo sapiens
tctgatgttggggacgtacacgaaggcttcaggacactaaaagaagaagttcagagagagacccaacaagtggagaagctgagccgagtagggcaaagctmcctgctcagctccctcagcaaacttctagggaagaaaaaggagctacaagaccttgagctcgcacttgaaggggctctagacaagggacatgaagtgacc

SEQ ID NO: 9337 - DNA, 201 bp, Homo sapiens
acccagctgctggataggacccagccccgctcccagagacaatgaccatgtttgaaaatgtcacccgggccctggccagacagctaaaccctcgaggggayctgacaccacttgacagcctcatcgacttcaagcgcttccatcccttctgcctggtgctgaggaagaggaagagcacgctcttctggggggcccggtacg

SEQ ID NO: 9338 - DNA, 201 bp, Homo sapiens
acccagccccgctcccagagacaatgaccatgtttgaaaatgtcacccgggccctggccagacagctaaaccctcgaggggacctgacaccacttgacagrctcatcgacttcaagcgcttccatcccttctgcctggtgctgaggaagaggaagagcacgctcttctggggggcccggtacgtccgcaccgactacacgc

SEQ ID NO: 9339 - DNA, 201 bp, Homo sapiens
gcagcagaccacccattcctgaaggagatgcaagatcaaggggagaacctgtatgtggtgatggaggtggtggagacggtgcaggaggtcacactggagcragccggcaaggcagaggcctgcttctccctccccttcttcgccccattggggctacagggatccataaatcacaaggaggctgtaaccatccccaagggc

SEQ ID NO: 9340 - DNA, 201 bp, Homo sapiens
tggtgctgaggaagaggaagagcacgctcttctggggggcccggtacgtccgcaccgactacacgctgctggatgtgcttgagcccggcagctcaccttcrgacccaacagacactgggaattttggctttaagaatatgctggacacccgagtggagggagatgtggatgtaccaaagacggtgaaggtgaagggaacgg

SEQ ID NO: 9341 - DNA, 201 bp, Homo sapiens
ggtcatcatcgtgggactggacaatgaaggaaagaccaccattctctaccggttcttgaccagtgaggtggtccatatgtgtcccaccattggcagcaacrtggaggagatcattctgccgaagacccacttcttcctgtgggacatagtgagacctgaggctctgagctttatctggaacacatactactccaacactga

SEQ ID NO: 9342 - DNA, 192 bp, Homo sapiens
atgggacagctgatcgccaagttaatgagcatcttcgggaaccaggagcacacggtcatcatcgtgggactggacaatgaaggaaagaccaycattctctaccggttcttgaccagtgaggtggtccatatgtgtcccaccattggcagcaacgtggaggagatcattctgccgaagacccacttcttcctg

SEQ ID NO: 9343 - DNA, 115 bp, Homo sapiens
ccatttccttactctcagcaccatcaaagaccactcgtggcatatacaaggctgctgtgccctcaccagggaagggttagtggctgccctacctggatctytagggcctggctga

SEQ ID NO: 9344 - DNA, 201 bp, Homo sapiens
gacaatgaaggaaagaccaccattctctaccggttcttgaccagtgaggtggtccatatgtgtcccaccattggcagcaacgtggaggagatcattctgcygaagacccacttcttcctgtgggacatagtgagacctgaggctctgagctttatctggaacacatactactccaacactgagtttatcatccttgtgatt

SEQ ID NO: 9345 - DNA, 201 bp, Homo sapiens
caccattctctaccggttcttgaccagtgaggtggtccatatgtgtcccaccattggcagcaacgtggaggagatcattctgccgaagacccacttcttcmtgtgggacatagtgagacctgaggctctgagctttatctggaacacatactactccaacactgagtttatcatccttgtgattgacagcacggaccggga

SEQ ID NO: 9346 - DNA, 201 bp, Homo sapiens
gggacatagtgagacctgaggctctgagctttatctggaacacatactactccaacactgagtttatcatccttgtgattgacagcacggaccgggatcgkctgctgaccactcgggaggagctatataaaatgctggcccatgaggctctacaggatgcttcagtcctgatatttgccaataagcaggacgtgaaggact

SEQ ID NO: 9347 - DNA, 201 bp, Homo sapiens
aacactgagtttatcatccttgtgattgacagcacggaccgggatcggctgctgaccactcgggaggagctatataaaatgctggcccatgaggctctacrggatgcttcagtcctgatatttgccaataagcaggacgtgaaggactccatgaggatggtggagatctcccatttccttactctcagcaccatcaaagac

SEQ ID NO: 9348 - DNA, 201 bp, Homo sapiens
gccaagttaatgagcatcttcgggaaccaggagcacacggtcatcatcgtgggactggacaatgaaggaaagaccaccattctctaccggttcttgaccartgaggtggtccatatgtgtcccaccattggcagcaacgtggaggagatcattctgccgaagacccacttcttcctgtgggacatagtgagacctgaggct

SEQ ID NO: 9349 - DNA, 201 bp, Homo sapiens
gacctgaggctctgagctttatctggaacacatactactccaacactgagtttatcatccttgtgattgacagcacggaccgggatcggctgctgaccacycgggaggagctatataaaatgctggcccatgaggctctacaggatgcttcagtcctgatatttgccaataagcaggacgtgaaggactccatgaggatgg

SEQ ID NO: 9350 - DNA, 201 bp, Homo sapiens; identical to SEQ ID NO: 9341

SEQ ID NO: 9351 - DNA, 192 bp, Homo sapiens; identical to SEQ ID NO: 9342

SEQ ID NO: 9352 - DNA, 201 bp, Homo sapiens; identical to SEQ ID NO: 9344

SEQ ID NO: 9353 - DNA, 201 bp, Homo sapiens; identical to SEQ ID NO: 9345

SEQ ID NO: 9354 - DNA, 201 bp, Homo sapiens; identical to SEQ ID NO: 9346

SEQ ID NO: 9355 - DNA, 201 bp, Homo sapiens; identical to SEQ ID NO: 9347

SEQ ID NO: 9356 - DNA, 201 bp, Homo sapiens; identical to SEQ ID NO: 9348

SEQ ID NO: 9357 - DNA, 201 bp, Homo sapiens; identical to SEQ ID NO: 9349

SEQ ID NO: 9358 - DNA, 201 bp, Homo sapiens
gcccaactttacagggaaaagcagttaccgtgtatacaaattacccatttcctggagaaacatttaatagagaaaaattccgttctctggattgggaaaayccaacagaaagagaagatgattctgataaatactgtaaacttaatctgcaacaatctggttcatttcagtattatttccttcaaggaaatgagaaaagtg

SEQ ID NO: 9359 - DNA, 201 bp, Homo sapiens
tttcagtattatttccttcaaggaaatgagaaaagtggtggaggttacatagttgtggaccccattttacgtgttggtgctgataatcatgtgctaccctwggactgtgttactcttcagacatttttagctaagtgtttgggaccttttgatgaatgggaaagcagacttagggttgcaaaagaatcaggctacaacatg

SEQ ID NO: 9360 - DNA, 201 bp, Homo sapiens
tcagcccttaaatatgcaggtcttcaaggtttaatgtctgtattggcagaaataagaccaaagaatgacttggggcatcctttttgtaataatttgagatstggagattggatgattgactatgtcagtaaccggcttatttcacgatcaggaactattgctgaagttggtaaatggttgcaggctatgttcttctacctg

SEQ ID NO: 9361 - DNA, 201 bp, Homo sapiens
tggctgagctaaatcagatcctttaccgatgtgaatcagaagaaaaggaagatggtggagggtgctatgacataccaaactggtcagcccttaaatatgcmggtcttcaaggtttaatgtctgtattggcagaaataagaccaaagaatgacttggggcatcctttttgtaataatttgagatctggagattggatgattg

SEQ ID NO: 9362 - DNA, 201 bp, Homo sapiens
gatgttggacagctagtggaaaaattaaaaaaggaatggaatgttatttgtattactgatgttgtctacaatcatactgctgctaatagtaaatggatccrggaacatccagaatgtgcctataatcttgtgaattctccacacttaaaacctgcctgggtcttagacagagcactttggcgtttctcctgtgatgttgca

SEQ ID NO: 9363 - DNA, 201 bp, Homo sapiens
gaggaaatcgtttcaattgtggcacatggatggataaaatgggagaaagtgacagagctagaaacagaggaatcccagccacaccaagagatgggtctgcygtggaaattgtgggcctgagtaaatctgctgttcgctggttgctggaattatccaaaaaaaatattttcccttatcatgaagtcacagtaaaaagacatg

SEQ ID NO: 9364 - DNA, 201 bp, Homo sapiens
ttgcactaacgactttcataccacatgacaaggggccagcagcaattgaagaatgctgtaattggtttcataaaagaatggaggaattaaattcagagaakcatcgactcattaactatcatcaggaacaggcagttaattgccttttgggaaatgtgttttatgaacgactggctggccatggtccaaaactaggacctg

SEQ ID NO: 9365 - DNA, 201 bp, Homo sapiens
ctaacgactttcataccacatgacaaggggccagcagcaattgaagaatgctgtaattggtttcataaaagaatggaggaattaaattcagagaagcatcractcattaactatcatcaggaacaggcagttaattgccttttgggaaatgtgttttatgaacgactggctggccatggtccaaaactaggacctgtcact

SEQ ID NO: 9366 - DNA, 201 bp, Homo sapiens
atatattcaagaaatagaatttgaaaacttgtctccaggaagtgttattatattcagagttagtcttgatccacatgcacaagtcgctgttggaattcttygaaatcatctgacacaattcagtcctcactttaaatctggcagcctagctgttgacaatgcagatcctatattaaaaattccttttgcttctcttgcctc

SEQ ID NO: 9367 - DNA, 201 bp, Homo sapiens
gatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaaggttgttctttctgcttctcaggtgtatgtggatcaagttgatgaagacatagtggc

SEQ ID NO: 9368 - DNA, 201 bp, Homo sapiens
cgtataactccctcggcgggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagggtatgagctacagttccgattaggcccaacttt

SEQ ID NO: 9369 - DNA, 201 bp, Homo sapiens
aataaaccagaggactgtccttatctctgggcacacatgaaaaaatacactgaaataactgcaacttatttccagggagtacgtcttgataactgccactsaacacctcttcacgtagctgagtacatgttggatgctgctaggaatttgcaacccaatttatatgtagtagctgaactgttcacaggaagtgaagatctg

SEQ ID NO: 9370 - DNA, 201 bp, Homo sapiens
gaaaactttagatccagatgatatggtttactgtggaatttatgacaatgcattagacaatgacaactacaatcttgctaaaggtttcaattatcaccaasgacctgagtggctgtggcctattgggtattttcttcgtgcaaaattatatttttccagattgatgggcccggagactactgcaaagactatagttttggt

SEQ ID NO: 9371 - DNA, 201 bp, Homo sapiens
ccctttgcccttcacggcgcccggccctccttgggctgcggcttctgtgcgaggctgggcagccagcccttccccttctgtttctccccgtcccctccccscgaccgtagcaccagagtcgcgggtcctgcagtgccccagaagccgcacgtataactccctcggcgggtaactcattcgactgtggagttcttttaattc

SEQ ID NO: 9372 - DNA, 201 bp, Homo sapiens
gacgctatgtagaagccaggaatattattttagcatttgcgggtaccctgaggcatggtctcattcctaatctactgggtgaaggaatttatgccagatasaattgtcgggatgctgtgtggtggtggctgcagtgtatccaggattactgtaaaatggttccaaatggtctagacattctcaagtgcccagtttccagaa

SEQ ID NO: 9373 - DNA, 201 bp, Homo sapiens
aatacaaagaaaagggaatacctgctttgattgaaaatgatcaccatatgaattccatccgaaaaataatttgggaggatatttttccaaagcttaaactytgggaatttttccaagtagatgtcaacaaagcggttgagcaatttagaagacttcttacacaagaaaataggcgagtaaccaagtctgatccaaaccaac

SEQ ID NO: 9374 - DNA, 201 bp, Homo sapiens
tagatttcaatttgaatcagaaagaaatatcattaccaatgaaatgtgtttgagttcagtaagaattattcaaatgcctagaaatccatagtttggaaaakaaaaatcatgtcatcttctatttgtacagaaatgaaaataaaatatgaaaataatgaaagaaatgaaaagatagcttttaattgtggtatatataatctt

SEQ ID NO: 9375 - DNA, 162 bp, Homo sapiens
caaagataattgggaaaacatgagactggtcatattgatgaatattgtaacatgtgaattgtgatccatttctgatatgtcttgaactactgtgtctagtrggcaaatgtcattgttacctctgtgtgttaagaaaataaaaatattttctaaaggtctgta

SEQ ID NO: 9376 - DNA, 113 bp, Homo sapiens
acatgtgaattgtgatccatttctgatatgtcttgaactactgtgtctagtgggcaaatgtcattgttacctctgtgtgttaagaaaataaaaatattttytaaaggtctgta

SEQ ID NO: 9377 - DNA, 201 bp, Homo sapiens
aagcattaggaaatttatttcctaaaaacagttttgtaaaattagtattgagttctattgagtattataagatagcttacattttcaaaatggaaattgtyggtcatatttctagaactttaaagaaaaaagaatgttatattagttttctaaaactcaactatctttagtcatgttcaaaaatctattgctagatcatag

SEQ ID NO: 9378 - DNA, 201 bp, Homo sapiens
tacagatgattctgctcctttgcctgctggcacactggatcagccattgtttgaagtcatacaggaagcaatgcaaaaacacatgcagggcatacagttcygagaaaggaatgctggtccccagatagatcgaaacatgaaggacgaaggttttaatataactgcaggagttgatgaagaaacaggatttgtttatggagg

SEQ ID NO: 9379 - DNA, 201 bp, Homo sapiens
ttcaacctttgtgaaacacctttcattgggttcagttcaactgtgtggagtaggaaaattcccttccctgccaattctttcacctgccctaatggatgtaycttataggttaaatgagatcacaaaagaaaaggagcaatgttgtgtttctctagctgcaggcttacctcatttttcttctggtattttccgctgctgggg

SEQ ID NO: 9380 - DNA, 201 bp, Homo sapiens
gtcctgcagtgccccagaagccgcacgtataactccctcggcgggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagggtatgagc

SEQ ID NO: 9381 - DNA, 201 bp, Homo sapiens
agttttaactagcttagttttctggtttccaaaactaaaatagattaaatcctacaaatttaaggacagttgtgacagtaatctgaccactatctataaayacattggacattggtttccaaatctccctttcttcttcagttccttccttgttcaatatatacccttctctaaactgtgcgggtaaaaggaatgactgtc

SEQ ID NO: 9382 - DNA, 201 bp, Homo sapiens
taaacagattcgaattttacttctgaacgaaatggagaaactggaaaagaccctcttcagacttgaacaagggtatgagctacagttccgattaggcccarctttacagggaaaagcagttaccgtgtatacaaattacccatttcctggagaaacatttaatagagaaaaattccgttctctggattgggaaaatccaac

SEQ ID NO: 9383 - DNA, 201 bp, Homo sapiens
cattctcaagtgcccagtttccagaatgtatcctacagatgattctgctcctttgcctgctggcacactggatcagccattgtttgaagtcatacaggaarcaatgcaaaaacacatgcagggcatacagttccgagaaaggaatgctggtccccagatagatcgaaacatgaaggacgaaggttttaatataactgcagg

SEQ ID NO: 9384 - DNA, 201 bp, Homo sapiens
ctgctgattactggacgctatgtagaagccaggaatattattttagcatttgcgggtaccctgaggcatggtctcattcctaatctactgggtgaaggaawttatgccagatacaattgtcgggatgctgtgtggtggtggctgcagtgtatccaggattactgtaaaatggttccaaatggtctagacattctcaagtgc

SEQ ID NO: 9385 - DNA, 201 bp, Homo sapiens
aaaataatggtattttaaaataatgctactttcaaagtagcatttttttagttagtttacaggttacatacccaaaaccttaactatgactaagaaattamagaagaaaaccagcaaactaaaacttctgggcagcaaaaatatataaatgcttcagatgtcaaatacccatgcttgaaagctcgtgtaatttactttaag

SEQ ID NO: 9386 - DNA, 201 bp, Homo sapiens
tcagttggaagaaagtagtggcaagaattctttcattgctatataatattcagtggctcatttatacctaataaaataatggtattttaaaataatgctaytttcaaagtagcatttttttagttagtttacaggttacatacccaaaaccttaactatgactaagaaattaaagaagaaaaccagcaaactaaaacttct

SEQ ID NO: 9387 - DNA, 201 bp, Homo sapiens
tgtttctctagctgcaggcttacctcatttttcttctggtattttccgctgctggggaagggatacttttattgcacttagaggtatactgctgattactrgacgctatgtagaagccaggaatattattttagcatttgcgggtaccctgaggcatggtctcattcctaatctactgggtgaaggaatttatgccagata

SEQ ID NO: 9388 - DNA, 201 bp, Homo sapiens
cttaaattcaataaaatcactggaagtttttcatgataacttattttaagatgccttaaaaatcttaaagtcacaaaaggaaaaaggtttttaacatttayatgagttaacattttttcatagaacttatttcctagatagaattttttactgttttttactgttttcttaagaaaacagttaaatcattatgcattcagt

SEQ ID NO: 9389 - DNA, 201 bp, Homo sapiens; identical to SEQ ID NO: 9358

SEQ ID NO: 9390 - DNA, 201 bp, Homo sapiens; identical to SEQ ID NO: 9359

SEQ ID NO: 9391 - DNA, 201 bp, Homo sapiens; identical to SEQ ID NO: 9360

SEQ ID NO: 9392 - DNA, 201 bp, Homo sapiens; identical to SEQ ID NO: 9361

SEQ ID NO: 9393 - DNA, 201 bp, Homo sapiens; identical to SEQ ID NO: 9362

SEQ ID NO: 9394 - DNA, 201 bp, Homo sapiens; identical to SEQ ID NO: 9363

SEQ ID NO: 9395 - DNA, 201 bp, Homo sapiens; identical to SEQ ID NO: 9364

SEQ ID NO: 9396 - DNA, 201 bp, Homo sapiens; identical to SEQ ID NO: 9365

SEQ ID NO: 9397 - DNA, 201 bp, Homo sapiens; identical to SEQ ID NO: 9366

SEQ ID NO: 9398 - DNA, 201 bp, Homo sapiens
gatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaagggttttattcaggtgtatgtggatcaagttgatgaagacatagtggcagtaacaag

SEQ ID NO: 9399 - DNA, 201 bp, Homo sapiens
gagcagactaatctcttgggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagggtatgagctacagttccgattaggcccaacttt

SEQ ID NO: 9400 - DNA, 201 bp, Homo sapiens; identical to SEQ ID NO: 9369

SEQ ID NO: 9401 - DNA, 201 bp, Homo sapiens; identical to SEQ ID NO: 9370

SEQ ID NO: 9402 - DNA, 201 bp, Homo sapiens; identical to SEQ ID NO: 9372

SEQ ID NO: 9403 - DNA, 201 bp, Homo sapiens; identical to SEQ ID NO: 9373

SEQ ID NO: 9404 - DNA, 201 bp, Homo sapiens; identical to SEQ ID NO: 9374

SEQ ID NO: 9405 - DNA, 162 bp, Homo sapiens; identical to SEQ ID NO: 9375

SEQ ID NO: 9406 - DNA, 113 bp, Homo sapiens; identical to SEQ ID NO: 9376

SEQ ID NO: 9407 - DNA, 201 bp, Homo sapiens; identical to SEQ ID NO: 9377

SEQ ID NO: 9408 - DNA, 201 bp, Homo sapiens; identical to SEQ ID NO: 9378

SEQ ID NO: 9409 - DNA, 201 bp, Homo sapiens; identical to SEQ ID NO: 9379

SEQ ID NO: 9410 - DNA, 201 bp, Homo sapiens
gggagattgcccacctgttatctttgagcagactaatctcttgggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagggtatgagc

SEQ ID NO: 9411 - DNA, 201 bp, Homo sapiens; identical to SEQ ID NO: 9381

SEQ ID NO: 9412 - DNA, 201 bp, Homo sapiens; identical to SEQ ID NO: 9382

SEQ ID NO: 9413 - DNA, 201 bp, Homo sapiens; identical to SEQ ID NO: 9383

SEQ ID NO: 9414 - DNA, 201 bp, Homo sapiens; identical to SEQ ID NO: 9384

SEQ ID NO: 9415 - DNA, 201 bp, Homo sapiens; identical to SEQ ID NO: 9385

SEQ ID NO: 9416 - DNA, 201 bp, Homo sapiens; identical to SEQ ID NO: 9386

SEQ ID NO: 9417 - DNA, 201 bp, Homo sapiens; identical to SEQ ID NO: 9387

SEQ ID NO: 9418 - DNA, 201 bp, Homo sapiens; identical to SEQ ID NO: 9388

SEQ ID NO: 9419 - DNA, 201 bp, Homo sapiens; identical to SEQ ID NO: 9358

SEQ ID NO: 9420 - DNA, 201 bp, Homo sapiens; identical to SEQ ID NO: 9359

SEQ ID NO: 9421 - DNA, 201 bp, Homo sapiens; identical to SEQ ID NO: 9360

SEQ ID NO: 9422 - DNA, 201 bp, Homo sapiens; identical to SEQ ID NO: 9361

SEQ ID NO: 9423 - DNA, 201 bp, Homo sapiens; identical to SEQ ID NO: 9362

SEQ ID NO: 9424 - DNA, 201 bp, Homo sapiens; identical to SEQ ID NO: 9363

SEQ ID NO: 9425 - DNA, 201 bp, Homo sapiens; identical to SEQ ID NO: 9364

SEQ ID NO: 9426 - DNA, 201 bp, Homo sapiens; identical to SEQ ID NO: 9365

SEQ ID NO: 9427 - DNA, 201 bp, Homo sapiens; identical to SEQ ID NO: 9366

SEQ ID NO: 9428 - DNA, 201 bp, Homo sapiens; identical to SEQ ID NO: 9398

SEQ ID NO: 9429 - DNA, 201 bp, Homo sapiens
ccccattggtggctggcgacccgaatttgggaatggggagattgcccacctgttatctttgagcagactaatctcttaagccaaaatgggacacagtaaayagattcgaattttacttctgaacgaaatggagaaactggaaaagaccctcttcagacttgaacaagggtatgagctacagttccgattaggcccaacttt

SEQ ID NO: 9430 - DNA, 201 bp, Homo sapiens; identical to SEQ ID NO: 9369

SEQ ID NO: 9431 - DNA, 201 bp, Homo sapiens; identical to SEQ ID NO: 9370

SEQ ID NO: 9432 - DNA, 201 bp, Homo sapiens; identical to SEQ ID NO: 9372

SEQ ID NO: 9433 - DNA, 201 bp, Homo sapiens; identical to SEQ ID NO: 9373

SEQ ID NO: 9434 - DNA, 201 bp, Homo sapiens; identical to SEQ ID NO: 9374

SEQ ID NO: 9435 - DNA, 162 bp, Homo sapiens; identical to SEQ ID NO: 9375

SEQ ID NO: 9436 - DNA, 113 bp, Homo sapiens; identical to SEQ ID NO: 9376

SEQ ID NO: 9437 - DNA, 201 bp, Homo sapiens; identical to SEQ ID NO: 9377

SEQ ID NO: 9438 - DNA, 201 bp, Homo sapiens; identical to SEQ ID NO: 9378

SEQ ID NO: 9439 - DNA, 201 bp, Homo sapiens; identical to SEQ ID NO: 9379

SEQ ID NO: 9440 - DNA, 201 bp, Homo sapiens
cctctgttctcatctccccattggtggctggcgacccgaatttgggaatggggagattgcccacctgttatctttgagcagactaatctcttaagccaaartgggacacagtaaacagattcgaattttacttctgaacgaaatggagaaactggaaaagaccctcttcagacttgaacaagggtatgagctacagttccg

SEQ ID NO: 9441 - DNA, 201 bp, Homo sapiens; identical to SEQ ID NO: 9381

SEQ ID NO: 9442 - DNA, 201 bp, Homo sapiens; identical to SEQ ID NO: 9382

SEQ ID NO: 9443 - DNA, 201 bp, Homo sapiens; identical to SEQ ID NO: 9383

SEQ ID NO: 9444 - DNA, 201 bp, Homo sapiens; identical to SEQ ID NO: 9384

SEQ ID NO: 9445 - DNA, 201 bp, Homo sapiens; identical to SEQ ID NO: 9385

SEQ ID NO: 9446 - DNA, 201 bp, Homo sapiens; identical to SEQ ID NO: 9386

SEQ ID NO: 9447 - DNA, 201 bp, Homo sapiens; identical to SEQ ID NO: 9387

SEQ ID NO: 9448 - DNA, 201 bp, Homo sapiens; identical to SEQ ID NO: 9388

SEQ ID NO: 9449 - DNA, 201 bp, Homo sapiens; identical to SEQ ID NO: 9358

SEQ ID NO: 9450 - DNA, 201 bp, Homo sapiens; identical to SEQ ID NO: 9359

SEQ ID NO: 9451 - DNA, 201 bp, Homo sapiens; identical to SEQ ID NO: 9360

SEQ ID NO: 9452 - DNA, 201 bp, Homo sapiens; identical to SEQ ID NO: 9361

SEQ ID NO: 9453 - DNA, 201 bp, Homo sapiens; identical to SEQ ID NO: 9362

SEQ ID NO: 9454 - DNA, 201 bp, Homo sapiens; identical to SEQ ID NO: 9363

SEQ ID NO: 9455 - DNA, 201 bp, Homo sapiens; identical to SEQ ID NO: 9364

SEQ ID NO: 9456 - DNA, 201 bp, Homo sapiens; identical to SEQ ID NO: 9365

SEQ ID NO: 9457 - DNA, 201 bp, Homo sapiens; identical to SEQ ID NO: 9366

SEQ ID NO: 9458 - DNA, 201 bp, Homo sapiens; identical to SEQ ID NO: 9398

SEQ ID NO: 9459 - DNA, 184 bp, Homo sapiens
gggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagaaactgggtctcactatgttgcccaggttgatat

SEQ ID NO: 9460 - DNA, 201 bp, Homo sapiens; identical to SEQ ID NO: 9369

SEQ ID NO: 9461 - DNA, 201 bp, Homo sapiens; identical to SEQ ID NO: 9370

SEQ ID NO: 9462 - DNA, 201 bp, Homo sapiens; identical to SEQ ID NO: 9372

SEQ ID NO: 9463 - DNA, 201 bp, Homo sapiens; identical to SEQ ID NO: 9373

SEQ ID NO: 9464 - DNA, 201 bp, Homo sapiens; identical to SEQ ID NO: 9374

SEQ ID NO: 9465 - DNA, 162 bp, Homo sapiens; identical to SEQ ID NO: 9375

SEQ ID NO: 9466 - DNA, 113 bp, Homo sapiens; identical to SEQ ID NO: 9376

SEQ ID NO: 9467 - DNA, 201 bp, Homo sapiens; identical to SEQ ID NO: 9377

SEQ ID NO: 9468 - DNA, 201 bp, Homo sapiens; identical to SEQ ID NO: 9378

SEQ ID NO: 9469 - DNA, 201 bp, Homo sapiens; identical to SEQ ID NO: 9379

SEQ ID NO: 9470 - DNA, 159 bp, Homo sapiens
gggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagaaactgggt

SEQ ID NO: 9471 - DNA, 201 bp, Homo sapiens; identical to SEQ ID NO: 9381

SEQ ID NO: 9472 - DNA, 201 bp, Homo sapiens
ctgaaagtactgggattacaagcataagccaccgggcatggccccaattctgagcattaatttatttattgggtatgagctacagttccgattaggcccarctttacagggaaaagcagttaccgtgtatacaaattacccatttcctggagaaacatttaatagagaaaaattccgttctctggattgggaaaatccaac

SEQ ID NO: 9473 - DNA, 201 bp, Homo sapiens; identical to SEQ ID NO: 9383

SEQ ID NO: 9474 - DNA, 201 bp, Homo sapiens; identical to SEQ ID NO: 9384

SEQ ID NO: 9475 - DNA, 201 bp, Homo sapiens; identical to SEQ ID NO: 9385

SEQ ID NO: 9476 - DNA, 201 bp, Homo sapiens; identical to SEQ ID NO: 9386

SEQ ID NO: 9477 - DNA, 201 bp, Homo sapiens; identical to SEQ ID NO: 9387

SEQ ID NO: 9478 - DNA, 201 bp, Homo sapiens; identical to SEQ ID NO: 9388

SEQ ID NO: 9479 - DNA, 201 bp, Homo sapiens; identical to SEQ ID NO: 9358

SEQ ID NO: 9480 - DNA, 201 bp, Homo sapiens; identical to SEQ ID NO: 9359

SEQ ID NO: 9481 - DNA, 201 bp, Homo sapiens; identical to SEQ ID NO: 9360

SEQ ID NO: 9482 - DNA, 201 bp, Homo sapiens; identical to SEQ ID NO: 9361

SEQ ID NO: 9483 - DNA, 201 bp, Homo sapiens; identical to SEQ ID NO: 9362

SEQ ID NO: 9484 - DNA, 201 bp, Homo sapiens; identical to SEQ ID NO: 9363

SEQ ID NO: 9485 - DNA, 201 bp, Homo sapiens; identical to SEQ ID NO: 9364

SEQ ID NO: 9486 - DNA, 201 bp, Homo sapiens; identical to SEQ ID NO: 9365

SEQ ID NO: 9487 - DNA, 201 bp, Homo sapiens; identical to SEQ ID NO: 9366

SEQ ID NO: 9488 - DNA, 201 bp, Homo sapiens; identical to SEQ ID NO: 9367

SEQ ID NO: 9489 - DNA, 201 bp, Homo sapiens
cattaggtttgcggagttattttaaacataattgaaaaatcaaggttttttaatactttaaataaaacatctgtttttcaatgtggtaatttaagtcctaygatgagtttattaacatgtgctttttatttagggtatgagctacagttccgattaggcccaactttacagggaaaagcagttaccgtgtatacaaattac

SEQ ID NO: 9490 - DNA, 201 bp, Homo sapiens; identical to SEQ ID NO: 9369

SEQ ID NO: 9491 - DNA, 201 bp, Homo sapiens; identical to SEQ ID NO: 9370

SEQ ID NO: 9492 - DNA, 201 bp, Homo sapiens; identical to SEQ ID NO: 9372

SEQ ID NO: 9493 - DNA, 201 bp, Homo sapiens; identical to SEQ ID NO: 9373

SEQ ID NO: 9494 - DNA, 201 bp, Homo sapiens; identical to SEQ ID NO: 9374

SEQ ID NO: 9495 - DNA, 162 bp, Homo sapiens; identical to SEQ ID NO: 9375

SEQ ID NO: 9496 - DNA, 113 bp, Homo sapiens; identical to SEQ ID NO: 9376

SEQ ID NO: 9497 - DNA, 201 bp, Homo sapiens; identical to SEQ ID NO: 9377

SEQ ID NO: 9498 - DNA, 201 bp, Homo sapiens; identical to SEQ ID NO: 9378

SEQ ID NO: 9499 - DNA, 201 bp, Homo sapiens; identical to SEQ ID NO: 9379

SEQ ID NO: 9500 - DNA, 201 bp, Homo sapiens; identical to SEQ ID NO: 9381

SEQ ID NO: 9501 - DNA, 201 bp, Homo sapiens
taaaacatctgtttttcaatgtggtaatttaagtcctacgatgagtttattaacatgtgctttttatttagggtatgagctacagttccgattaggcccarctttacagggaaaagcagttaccgtgtatacaaattacccatttcctggagaaacatttaatagagaaaaattccgttctctggattgggaaaatccaac

SEQ ID NO: 9502 - DNA, 201 bp, Homo sapiens; identical to SEQ ID NO: 9383

SEQ ID NO: 9503 - DNA, 201 bp, Homo sapiens; identical to SEQ ID NO: 9384

SEQ ID NO: 9504 - DNA, 201 bp, Homo sapiens; identical to SEQ ID NO: 9385

SEQ ID NO: 9505 - DNA, 201 bp, Homo sapiens; identical to SEQ ID NO: 9386

SEQ ID NO: 9506 - DNA, 201 bp, Homo sapiens; identical to SEQ ID NO: 9387

SEQ ID NO: 9507 - DNA, 201 bp, Homo sapiens; identical to SEQ ID NO: 9388

SEQ ID NO: 9508 - DNA, 201 bp, Homo sapiens; identical to SEQ ID NO: 9358

SEQ ID NO: 9509 - DNA, 201 bp, Homo sapiens; identical to SEQ ID NO: 9359

SEQ ID NO: 9510 - DNA, 201 bp, Homo sapiens; identical to SEQ ID NO: 9360

SEQ ID NO: 9511 - DNA, 201 bp, Homo sapiens; identical to SEQ ID NO: 9361

SEQ ID NO: 9512 - DNA, 201 bp, Homo sapiens; identical to SEQ ID NO: 9362

SEQ ID NO: 9513 - DNA, 201 bp, Homo sapiens; identical to SEQ ID NO: 9363

SEQ ID NO: 9514 - DNA, 201 bp, Homo sapiens; identical to SEQ ID NO: 9364

SEQ ID NO: 9515 - DNA, 201 bp, Homo sapiens; identical to SEQ ID NO: 9365

SEQ ID NO: 9516 - DNA, 201 bp, Homo sapiens; identical to SEQ ID NO: 9366

SEQ ID NO: 9517 - DNA, 201 bp, Homo sapiens; identical to SEQ ID NO: 9398

SEQ ID NO: 9518 - DNA, 201 bp, Homo sapiens
aaacacacttcgaacatgggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagggtatgagctacagttccgattaggcccaacttt

SEQ ID NO: 9519 - DNA, 201 bp, Homo sapiens; identical to SEQ ID NO: 9369

SEQ ID NO: 9520 - DNA, 201 bp, Homo sapiens; identical to SEQ ID NO: 9370

SEQ ID NO: 9521 - DNA, 201 bp, Homo sapiens; identical to SEQ ID NO: 9372

SEQ ID NO: 9522 - DNA, 201 bp, Homo sapiens; identical to SEQ ID NO: 9373

SEQ ID NO: 9523 - DNA, 201 bp, Homo sapiens; identical to SEQ ID NO: 9374

SEQ ID NO: 9524 - DNA, 162 bp, Homo sapiens; identical to SEQ ID NO: 9375

SEQ ID NO: 9525 - DNA, 113 bp, Homo sapiens; identical to SEQ ID NO: 9376

SEQ ID NO: 9526 - DNA, 201 bp, Homo sapiens; identical to SEQ ID NO: 9377

SEQ ID NO: 9527 - DNA, 201 bp, Homo sapiens; identical to SEQ ID NO: 9378

SEQ ID NO: 9528 - DNA, 201 bp, Homo sapiens; identical to SEQ ID NO: 9379

SEQ ID NO: 9529 - DNA, 201 bp, Homo sapiens
ctctttcattgctctgctaggcataaaacacacttcgaacatgggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagggtatgagc

SEQ ID NO: 9530 - DNA, 201 bp, Homo sapiens; identical to SEQ ID NO: 9381

SEQ ID NO: 9531 - DNA, 201 bp, Homo sapiens; identical to SEQ ID NO: 9382

SEQ ID NO: 9532 - DNA, 201 bp, Homo sapiens; identical to SEQ ID NO: 9383

SEQ ID NO: 9533 - DNA, 201 bp, Homo sapiens; identical to SEQ ID NO: 9384

SEQ ID NO: 9534 - DNA, 201 bp, Homo sapiens; identical to SEQ ID NO: 9385

SEQ ID NO: 9535 - DNA, 201 bp, Homo sapiens; identical to SEQ ID NO: 9386

SEQ ID NO: 9536 - DNA, 201 bp, Homo sapiens; identical to SEQ ID NO: 9387

SEQ ID NO: 9537 - DNA, 201 bp, Homo sapiens; identical to SEQ ID NO: 9388

SEQ ID NO: 9538 - DNA, 201 bp, Homo sapiens; identical to SEQ ID NO: 9358

SEQ ID NO: 9539 - DNA, 201 bp, Homo sapiens; identical to SEQ ID NO: 9359

SEQ ID NO: 9540 - DNA, 201 bp, Homo sapiens; identical to SEQ ID NO: 9360

SEQ ID NO: 9541 - DNA, 201 bp, Homo sapiens; identical to SEQ ID NO: 9361

SEQ ID NO: 9542 - DNA, 201 bp, Homo sapiens; identical to SEQ ID NO: 9362

SEQ ID NO: 9543 - DNA, 201 bp, Homo sapiens; identical to SEQ ID NO: 9363

SEQ ID NO: 9544 - DNA, 201 bp, Homo sapiens; identical to SEQ ID NO: 9364

SEQ ID NO: 9545 - DNA, 201 bp, Homo sapiens; identical to SEQ ID NO: 9365

SEQ ID NO: 9546 - DNA, 201 bp, Homo sapiens; identical to SEQ ID NO: 9366

SEQ ID NO: 9547 - DNA, 201 bp, Homo sapiens; identical to SEQ ID NO: 9398

SEQ ID NO: 9548 - DNA, 201 bp, Homo sapiens; identical to SEQ ID NO: 9489

SEQ ID NO: 9549 - DNA, 201 bp, Homo sapiens; identical to SEQ ID NO: 9369

SEQ ID NO: 9550 - DNA, 201 bp, Homo sapiens; identical to SEQ ID NO: 9370

SEQ ID NO: 9551 - DNA, 201 bp, Homo sapiens; identical to SEQ ID NO: 9372

SEQ ID NO: 9552 - DNA, 201 bp, Homo sapiens; identical to SEQ ID NO: 9373

SEQ ID NO: 9553 - DNA, 201 bp, Homo sapiens; identical to SEQ ID NO: 9374

SEQ ID NO: 9554 - DNA, 162 bp, Homo sapiens; identical to SEQ ID NO: 9375

SEQ ID NO: 9555 - DNA, 113 bp, Homo sapiens; identical to SEQ ID NO: 9376

SEQ ID NO: 9556 - DNA, 201 bp, Homo sapiens; identical to SEQ ID NO: 9377

SEQ ID NO: 9557 - DNA, 201 bp, Homo sapiens; identical to SEQ ID NO: 9378

SEQ ID NO: 9558 - DNA, 201 bp, Homo sapiens; identical to SEQ ID NO: 9379

SEQ ID NO: 9559 - DNA, 201 bp, Homo sapiens; identical to SEQ ID NO: 9381

SEQ ID NO: 9560 - DNA, 201 bp, Homo sapiens; identical to SEQ ID NO: 9501

SEQ ID NO: 9561 - DNA, 201 bp, Homo sapiens; identical to SEQ ID NO: 9383

SEQ ID NO: 9562 - DNA, 201 bp, Homo sapiens; identical to SEQ ID NO: 9384

SEQ ID NO: 9563 - DNA, 201 bp, Homo sapiens; identical to SEQ ID NO: 9385

SEQ ID NO: 9564 - DNA, 201 bp, Homo sapiens; identical to SEQ ID NO: 9386

SEQ ID NO: 9565 - DNA, 201 bp, Homo sapiens; identical to SEQ ID NO: 9387

SEQ ID NO: 9566 - DNA, 201 bp, Homo sapiens; identical to SEQ ID NO: 9388

SEQ ID NO: 9567 - DNA, 201 bp, Homo sapiens; identical to SEQ ID NO: 9358

SEQ ID NO: 9568 - DNA, 201 bp, Homo sapiens; identical to SEQ ID NO: 9359

SEQ ID NO: 9569 - DNA, 201 bp, Homo sapiens; identical to SEQ ID NO: 9360

SEQ ID NO: 9570 - DNA, 201 bp, Homo sapiens; identical to SEQ ID NO: 9361

SEQ ID NO: 9571 - DNA, 201 bp, Homo sapiens; identical to SEQ ID NO: 9362

SEQ ID NO: 9572 - DNA, 201 bp, Homo sapiens; identical to SEQ ID NO: 9363

SEQ ID NO: 9573 - DNA, 201 bp, Homo sapiens; identical to SEQ ID NO: 9364

SEQ ID NO: 9574 - DNA, 201 bp, Homo sapiens; identical to SEQ ID NO: 9365

SEQ ID NO: 9575 - DNA, 201 bp, Homo sapiens; identical to SEQ ID NO: 9366

SEQ ID NO: 9576 - DNA, 201 bp, Homo sapiens; identical to SEQ ID NO: 9398

SEQ ID NO: 9577 - DNA, 201 bp, Homo sapiens; identical to SEQ ID NO: 9368

SEQ ID NO: 9578 - DNA, 201 bp, Homo sapiens; identical to SEQ ID NO: 9369

SEQ ID NO: 9579 - DNA, 201 bp, Homo sapiens; identical to SEQ ID NO: 9370

SEQ ID NO: 9580 - DNA, 201 bp, Homo sapiens; identical to SEQ ID NO: 9371

SEQ ID NO: 9581 - DNA, 201 bp, Homo sapiens; identical to SEQ ID NO: 9372

SEQ ID NO: 9582 - DNA, 201 bp, Homo sapiens; identical to SEQ ID NO: 9373

SEQ ID NO: 9583 - DNA, 201 bp, Homo sapiens; identical to SEQ ID NO: 9374

SEQ ID NO: 9584 - DNA, 162 bp, Homo sapiens; identical to SEQ ID NO: 9375

SEQ ID NO: 9585 - DNA, 113 bp, Homo sapiens; identical to SEQ ID NO: 9376

SEQ ID NO: 9586 - DNA, 201 bp, Homo sapiens; identical to SEQ ID NO: 9377

SEQ ID NO: 9587 - DNA, 201 bp, Homo sapiens; identical to SEQ ID NO: 9378

SEQ ID NO: 9588 - DNA, 201 bp, Homo sapiens; identical to SEQ ID NO: 9379

SEQ ID NO: 9589 - DNA, 201 bp, Homo sapiens; identical to SEQ ID NO: 9380

SEQ ID NO: 9590 - DNA, 201 bp, Homo sapiens; identical to SEQ ID NO: 9381

SEQ ID NO: 9591 - DNA, 201 bp, Homo sapiens; identical to SEQ ID NO: 9382

SEQ ID NO: 9592 - DNA, 201 bp, Homo sapiens; identical to SEQ ID NO: 9383

SEQ ID NO: 9593 - DNA, 201 bp, Homo sapiens; identical to SEQ ID NO: 9384

SEQ ID NO: 9594 - DNA, 201 bp, Homo sapiens; identical to SEQ ID NO: 9385

SEQ ID NO: 9595 - DNA, 201 bp, Homo sapiens; identical to SEQ ID NO: 9386

SEQ ID NO: 9596 - DNA, 201 bp, Homo sapiens; identical to SEQ ID NO: 9387

SEQ ID NO: 9597 - DNA, 201 bp, Homo sapiens; identical to SEQ ID NO: 9388

SEQ ID NO: 9598 - DNA, 201 bp, Homo sapiens
cccaacgacaccttctacttctccatcctgaggaaccccgtgttccagctggagtcctccttcatctactacaaaacctacgcccccgccttccggggcgycccgagcctggacgcgttcctggcctcgccgcggacgttctacaacgacagccgccacctcaggaacgtctacgccaagaacaacatgtggttcgacttc

SEQ ID NO: 9599 - DNA, 201 bp, Homo sapiens
aggggccgaggcggtgggacctcgggggagctcaagcctcgactgtcccctcgctggaggccagaggccaagatgatgtccatgctgggcggcttgcagaratacttccgggtcatcctcctcctcctcctggccctgactctgctcctgctggccggattcctgcactcggacttagagctggacacacccctgtttggg

SEQ ID NO: 9600 - DNA, 201 bp, Homo sapiens
cgccgaggtggagcggcgcttccggctggtgctcatcgccgagcacctggacgagtccctggtgctgctgcggcgccggctgcgctgggcgctggacgacrtggtggccttcaggctcaactcccgcagcgcgcgctccgtggcccgcctgtcgcccgagacccgggagcgcgcgcggagctggtgcgcgctggactggcg

SEQ ID NO: 9601 - DNA, 201 bp, Homo sapiens
gctacccctggctcttcctggcgcgctacgtggaaggcgtggggtcgcagcagcgcttcaacatcatgtgcaaccacctgaggttcaacctgcctcaggtkcagaaagtcatgcccaacgacaccttctacttctccatcctgaggaaccccgtgttccagctggagtcctccttcatctactacaaaacctacgcccccg

SEQ ID NO: 9602 - DNA, 201 bp, Homo sapiens
tggggagcccagagccggcaggggccgaggcggtgggacctcgggggagctcaagcctcgactgtcccctcgctggaggccagaggccaagatgatgtccwtgctgggcggcttgcagagatacttccgggtcatcctcctcctcctcctggccctgactctgctcctgctggccggattcctgcactcggacttagagct

SEQ ID NO: 9603 - DNA, 201 bp, Homo sapiens
cctcaagaacatcccgttcctgggggcgtagaggggccgggccggggacgaggcctcctgcggacaccagctcctctctccgccgtcaccggggaggccgrggatccttgcagggcttctggggcgttgggaaacccaggcccgccggcgtggactctgccctcagcttcacagtcaccgaagaaatgaagttacaggagg

SEQ ID NO: 9604 - DNA, 201 bp, Homo sapiens
catcgccgaggtggagcggcgcttccggctggtgctcatcgccgagcacctggacgagtccctggtgctgctgcggcgccggctgcgctgggcgctggacracgtggtggccttcaggctcaactcccgcagcgcgcgctccgtggcccgcctgtcgcccgagacccgggagcgcgcgcggagctggtgcgcgctggactg

SEQ ID NO: 9605 - DNA, 201 bp, Homo sapiens
ggaacgtctacgccaagaacaacatgtggttcgacttcggcttcgaccccaacgcgcagtgcgaggagggctacgtgcgcgcgcgcatcgccgaggtggarcggcgcttccggctggtgctcatcgccgagcacctggacgagtccctggtgctgctgcggcgccggctgcgctgggcgctggacgacgtggtggccttca

SEQ ID NO: 9606 - DNA, 201 bp, Homo sapiens; identical to SEQ ID NO: 9598

SEQ ID NO: 9607 - DNA, 201 bp, Homo sapiens; identical to SEQ ID NO: 9599

SEQ ID NO: 9608 - DNA, 201 bp, Homo sapiens; identical to SEQ ID NO: 9600

SEQ ID NO: 9609 - DNA, 201 bp, Homo sapiens; identical to SEQ ID NO: 9601

SEQ ID NO: 9610 - DNA, 201 bp, Homo sapiens; identical to SEQ ID NO: 9602

SEQ ID NO: 9611 - DNA, 147 bp, Homo sapiens
cctcaagaacatcccgttcctgggggcgtagaggggccgggccggggacgaggcctcctgcggacaccagctcctctctccgccgtcaccggggaggccgrggatccttgcagggcttctggggcgttgggaaacccaggcccgccg

SEQ ID NO: 9612 - DNA, 201 bp, Homo sapiens; identical to SEQ ID NO: 9604

SEQ ID NO: 9613 - DNA, 201 bp, Homo sapiens; identical to SEQ ID NO: 9605

SEQ ID NO: 9614 - DNA, 201 bp, Homo sapiens
gctgagggtagatgcggttactatgtggaaaagaagaaacggttctgcaggatggtggtggccgcagggaaaagattttgtggtgaacacgctggagccayggaggaagaagatgctcggaaaagaatcctgtgtcctttagatccaaaacacacagtatatgaagatcaactagcaaagcatttgaaaaaatgtaactca

SEQ ID NO: 9615 - DNA, 201 bp, Homo sapiens
agctgagggtagatgcggttactatgtggaaaagaagaaacggttctgcaggatggtggtggccgcagggaaaagattttgtggtgaacacgctggagccrtggaggaagaagatgctcggaaaagaatcctgtgtcctttagatccaaaacacacagtatatgaagatcaactagcaaagcatttgaaaaaatgtaactc

SEQ ID NO: 9616 - DNA, 201 bp, Homo sapiens; identical to SEQ ID NO: 9614

SEQ ID NO: 9617 - DNA, 201 bp, Homo sapiens
aaatgttttgttaactgctttaccaaatcattcttcatcaccagaaacaactgcttaatggaaaagaaatttgagcatcatctgtcttccaccaaaaaaawttttttaattatatttttatatcaaaaaaatatatactttaaatagcaaataatatgaactttaaaaaatgctgtggcctcattaaactttggtaatagc

SEQ ID NO: 9618 - DNA, 201 bp, Homo sapiens; identical to SEQ ID NO: 9615

SEQ ID NO: 9619 - DNA, 201 bp, Homo sapiens
cacaagattcaaggtggatggaaaacacagaaagaaaaattcagtgtttgaaagacttcaaattgatattcaacacttgtgtttgaacaagattcctgtgytaagagaagaaaaactacctgtggtaggaattggaaagcatctgtgtggtatggcaacaggcttcttagtgttgaagaaaagaagaaaatagggcatctt

SEQ ID NO: 9620 - DNA, 201 bp, Homo sapiens; identical to SEQ ID NO: 9614

SEQ ID NO: 9621 - DNA, 201 bp, Homo sapiens; identical to SEQ ID NO: 9617

SEQ ID NO: 9622 - DNA, 201 bp, Homo sapiens; identical to SEQ ID NO: 9615

SEQ ID NO: 9623 - DNA, 201 bp, Homo sapiens
cacaagattcaaggtggatggaaaacacagaaagaaaaattcagtgtttgaaagacttcaaattgatattcaacacttgtgtttgaacaagattcctgtgytaagagaagaaaaactacctgtggtaggaattggaaagcatctgtgtggtatggcaacagatcttgcattacgatgtttggttgaaacctatgctgccag

SEQ ID NO: 9624 - DNA, 201 bp, Homo sapiens
gcaaatactggattcgaccttggtcaatcagcaatttacaaagatgccctattttcttcttttcttcaacactaagaagcctaaattgaataaacacacayaaaacattgttaaaattttgcaaaagtttataaaaaattatttttgtcactatttattgagagactgttaactaacccataatgtactaagtactttgtc

SEQ ID NO: 9625 - DNA, 201 bp, Homo sapiens
gctattaccaaagtttaatgaggccacagcattttttaaagttcatattatttgctatttaaagtatatatttttttgatataaaaatataattaaaaaawtttttttggtggaagacagatgatgctcaaatttcttttccattaagcagttgtttctggtgatgaagaatgatttggtaaagcagttaacaaaacattt

SEQ ID NO: 9626 - DNA, 201 bp, Homo sapiens
atggcaacttcatagaactggtttgctgaaaattcctgaattcattggaagattccagaacctcattgtgttagatttatctcgaaacacaatttcagagwtaccaccagggattggactgcttactagacttcaggaactgattctcagctacaacaaaatcaagactgtccccaaggaactaagtaattgtgccagctt

SEQ ID NO: 9627 - DNA, 201 bp, Homo sapiens
ctatgattcagctattcaaaacctaatgaagttggtgactatgacaatgtggagaaatcatgacagaaaatgtggtttgtactggggctgtcaatgctgtwaaggaagtttgggaaaaaagaataaagaaactcaatgaagacctgaagcgagagaaggaatttcaacacaagctagtgcggatctgggaagaacgagtaa

SEQ ID NO: 9628 - DNA, 201 bp, Homo sapiens; identical to SEQ ID NO: 9624

SEQ ID NO: 9629 - DNA, 201 bp, Homo sapiens; identical to SEQ ID NO: 9625

SEQ ID NO: 9630 - DNA, 201 bp, Homo sapiens; identical to SEQ ID NO: 9626

SEQ ID NO: 9631 - DNA, 201 bp, Homo sapiens; identical to SEQ ID NO: 9627

SEQ ID NO: 9632 - DNA, 201 bp, Homo sapiens
tttactgcaatgatgagagcatcaagtacccactgaaaactggtgagacaataaatgacgctgtgctctgtgccgtggggatcgtcattgccatcctcgcratcatcacgggggaattctaccggatctattacctgaagaagtcgcggtcgacgattcagaacccctacgtggcagcactctataagcaagtgggctgct

SEQ ID NO: 9633 - DNA, 201 bp, Homo sapiens
tttttgtaaaatgactgctgacagcaagttcttgctgctctccaatctcatcagacagtagaatgtagggaaaaacttttgcccgactgatttttaaaaargaaaaaaaaaatgttttactatgtggccttccaaaataggtagtgtttgcctatgtggaaacaacagcaaactaacaccaagtgccagagtcctggatgt

SEQ ID NO: 9634 - DNA, 201 bp, Homo sapiens
aagacgacgctctccctgcctgcccctgctatccggaaggaaatcctttcacctgtggacattattgacaggaacaatcaccacaacatgatgtaggtgcyacccacctcctgagctgtttttgtaaaatgactgctgacagcaagttcttgctgctctccaatctcatcagacagtagaatgtagggaaaaacttttgcc

SEQ ID NO: 9635 - DNA, 201 bp, Homo sapiens
cacatgatgccagaaatagcactgaatcaagaaaatagccattgcggagctgccctcttgagtctttctgtccatcccattctattctgtactgtgacttyagttcaggaagttttgttttgtgttttaaataaaaggaaagagcaagtttgctcagtcaagtgatcagatcccgaatctagattcccagttctaaggcct

SEQ ID NO: 9636 - DNA, 201 bp, Homo sapiens
acgagtgaatttcacaaacagcacaatttcagaagaaatcgagggcacaggccctcacttttcttcttttgacgcatcatcctgtgatgttgaaatgtcarttgcaggatgctgatgttgtgcacgtcaatcaccgggcacttgcatactcttagaaacagttcgacttcggttactgccttctcccttgaaatccttgct

SEQ ID NO: 9637 - DNA, 201 bp, Homo sapiens
gatgcagaggtgatgacagcaaagtccaggaagccaggaagtccttcttctctggccatgcctccttctccatgtacactatgctgtatttggtgctatayctgcaggcccgcttcacttggcgaggagcccgcctgctccggcccctcctgcagttcaccttgatcatgatggccttctacacgggactgtctcgcgtat

SEQ ID NO: 9638 - DNA, 201 bp, Homo sapiens
atttctgaaacaatttagctatatccactatgattataaactgtgtctcgacctgtgttatttacattagctgcttaaaaaagcattgagttaattttttwaaatatcaactaaaatatcatagttctgtggtagacattgttttataatgaaataactgcaactagagaaaactgtataaaaacattaaattgtcagtat

SEQ ID NO: 9639 - DNA, 201 bp, Homo sapiens; identical to SEQ ID NO: 9632

SEQ ID NO: 9640 - DNA, 201 bp, Homo sapiens; identical to SEQ ID NO: 9633

SEQ ID NO: 9641 - DNA, 201 bp, Homo sapiens; identical to SEQ ID NO: 9634

SEQ ID NO: 9642 - DNA, 201 bp, Homo sapiens; identical to SEQ ID NO: 9635

SEQ ID NO: 9643 - DNA, 201 bp, Homo sapiens; identical to SEQ ID NO: 9636

SEQ ID NO: 9644 - DNA, 201 bp, Homo sapiens; identical to SEQ ID NO: 9637

SEQ ID NO: 9645 - DNA, 201 bp, Homo sapiens; identical to SEQ ID NO: 9638

SEQ ID NO: 9646 - DNA, 201 bp, Homo sapiens; identical to SEQ ID NO: 9632

SEQ ID NO: 9647 - DNA, 201 bp, Homo sapiens; identical to SEQ ID NO: 9633

SEQ ID NO: 9648 - DNA, 201 bp, Homo sapiens; identical to SEQ ID NO: 9634

SEQ ID NO: 9649 - DNA, 201 bp, Homo sapiens
cacatgatgccagaaatagcactgaatcaagaaaatagccattgcggagctgccctcttgagtctttctgtccatcccattctattctgtactgtgacttyagttcaggaagttttgttttgtattcccagttctaaggccttatcacctcccctgcccataggccaacaaccatagttcctcacattagtgattagcaga

SEQ ID NO: 9650 - DNA, 201 bp, Homo sapiens; identical to SEQ ID NO: 9636

SEQ ID NO: 9651 - DNA, 201 bp, Homo sapiens; identical to SEQ ID NO: 9637

SEQ ID NO: 9652 - DNA, 201 bp, Homo sapiens; identical to SEQ ID NO: 9632

SEQ ID NO: 9653 - DNA, 201 bp, Homo sapiens; identical to SEQ ID NO: 9633

SEQ ID NO: 9654 - DNA, 201 bp, Homo sapiens; identical to SEQ ID NO: 9634

SEQ ID NO: 9655 - DNA, 201 bp, Homo sapiens; identical to SEQ ID NO: 9649

SEQ ID NO: 9656 - DNA, 201 bp, Homo sapiens; identical to SEQ ID NO: 9636

SEQ ID NO: 9657 - DNA, 201 bp, Homo sapiens; identical to SEQ ID NO: 9637

SEQ ID NO: 9658 - DNA, 201 bp, Homo sapiens
ggagggcttgcggctagccggaggaagctttggagccggaagccatggcacactaccccacaaggctgaagaccagaaaaacttattcatgggttggcagscccttgttggatcgaaaactgcactaccaaacctatagagaaatgtgtgtgaaaacagaaggttgttccaccgagattcacatccagattggacagtttg

SEQ ID NO: 9659 - DNA, 201 bp, Homo sapiens
acatctccggtgtccctgggacagggaagactgccactgttcatgaagtgatacgctgcctgcagcaggcagcccaagccaatgatgttcctccctttcartacattgaggtcaatggcatgaagctgacggagccccaccaagtctatgtgcaaatcttgcagaagctaacaggccaaaaagcaacagccaaccatgcgg

SEQ ID NO: 9660 - DNA, 201 bp, Homo sapiens
atctgaaaaatgagaagacactctttgtgaaactatcctggaatgagaagaaattcaggccactttcctcagaactatttgcggagttgaataaaccacamgagagtgcagccaagtgccagaaacccgtgagagccaagagtaagagtgcagagagcccttcttggaccccagcagaacatgtggccaaaaggattgaat

SEQ ID NO: 9661 - DNA, 201 bp, Homo sapiens
aaagagattctgccagcagcagagatttcagactctagcagtgacgaagaagaggcttccacaccgccccttccaaggagagcacccagaactgtgtccakgaacctgcgatcttccttgaagtcatccttacataccctcacgaaggtgccaaagaagagtctcaagcctagaacgccacgttgtgccgctcctcagatc

SEQ ID NO: 9662 - DNA, 201 bp, Homo sapiens
cgaagaagaggcttccacaccgccccttccaaggagagcacccagaactgtgtccaggaacctgcgatcttccttgaagtcatccttacataccctcacgraggtgccaaagaagagtctcaagcctagaacgccacgttgtgccgctcctcagatccgtagtcgaagcctggctgcccaggagccagccagtgtgctgga

SEQ ID NO: 9663 - DNA, 201 bp, Homo sapiens
ccaggaaggtagcagcactgtctggagatgcacgacggtgcctggacatctgcaggcgtgccacagagatctgtgagttctcccagcagaagcctgactcmcctggcctggtcaccatagcccactcaatggaagctgtggatgagatgttttcatcatcatacatcacggccatcaaaaattcctctgttctggaacaga

SEQ ID NO: 9664 - DNA, 201 bp, Homo sapiens
aggagagcacccagaactgtgtccaggaacctgcgatcttccttgaagtcatccttacataccctcacgaaggtgccaaagaagagtctcaagcctagaaygccacgttgtgccgctcctcagatccgtagtcgaagcctggctgcccaggagccagccagtgtgctggaggaagcccgactgaggctgcatgtttctgct

SEQ ID NO: 9665 - DNA, 201 bp, Homo sapiens
gggtgcatgtacatctccggtgtccctgggacagggaagactgccactgttcatgaagtgatacgctgcctgcagcaggcagcccaagccaatgatgttcstccctttcaatacattgaggtcaatggcatgaagctgacggagccccaccaagtctatgtgcaaatcttgcagaagctaacaggccaaaaagcaacagcc

SEQ ID NO: 9666 - DNA, 201 bp, Homo sapiens
cccagaactgtgtccaggaacctgcgatcttccttgaagtcatccttacataccctcacgaaggtgccaaagaagagtctcaagcctagaacgccacgttrtgccgctcctcagatccgtagtcgaagcctggctgcccaggagccagccagtgtgctggaggaagcccgactgaggctgcatgtttctgctgtacctgag

SEQ ID NO: 9667 - DNA, 201 bp, Homo sapiens
gcagagttccgtcgatcaggactggaggaagccacgtttcaacagatatatagtcaacatgtggcactgtgcagaatggagggactgccgtaccccaccaygtcagagaccatggccgtgtgttctcacctgggctcctgtcgcctcctgcttgtggagcccagcaggaacgatctgctccttcgggtgcggctcaacgtc

SEQ ID NO: 9668 - DNA, 201 bp, Homo sapiens
acgatcatggctcactgcagccttgacttctcaggcttaggtgaccccccaacctcatcctcccaggtggctgaaactacaggcacatgccaccatgcccrgctgattttttgtagagacagggcttcaccatgttgccaagctagtctacaaagcatctgattttggaagtacatggaattgttgtaacaaagtatattg

SEQ ID NO: 9669 - DNA, 201 bp, Homo sapiens
agtggcacgatcatggctcactgcagccttgacttctcaggcttaggtgaccccccaacctcatcctcccaggtggctgaaactacaggcacatgccaccrtgcccagctgattttttgtagagacagggcttcaccatgttgccaagctagtctacaaagcatctgattttggaagtacatggaattgttgtaacaaagt

SEQ ID NO: 9670 - DNA, 201 bp, Homo sapiens
gaaactatcctggaatgagaagaaattcaggccactttcctcagaactatttgcggagttgaataaaccacaagagagtgcagccaagtgccagaaacccrtgagagccaagagtaagagtgcagagagcccttcttggaccccagcagaacatgtggccaaaaggattgaatcaaggcactccgcctccaaatctcgcca

SEQ ID NO: 9671 - DNA, 201 bp, Homo sapiens
tggagtgcagtggcacgatcatggctcactgcagccttgacttctcaggcttaggtgaccccccaacctcatcctcccaggtggctgaaactacaggcacrtgccaccatgcccagctgattttttgtagagacagggcttcaccatgttgccaagctagtctacaaagcatctgattttggaagtacatggaattgttgt

SEQ ID NO: 9672 - DNA, 201 bp, Homo sapiens
aggtgaccccccaacctcatcctcccaggtggctgaaactacaggcacatgccaccatgcccagctgattttttgtagagacagggcttcaccatgttgcyaagctagtctacaaagcatctgattttggaagtacatggaattgttgtaacaaagtatattgaatggaaatggctctcatgtattttggaattttccatt

SEQ ID NO: 9673 - DNA, 201 bp, Homo sapiens
atcagtgggggacagagatcttcagtggtgccatccgtgattctgaaaccagaaaacatcaaaaagagggatgcaaaagaagcaaaagcccagaatgaagygacctctactccccatcgtatccgcagaaagagttctgtcttgactatgaatcggattaggcagcagcttcggtttctaggtaatagtaaaagtgaccaa

SEQ ID NO: 9674 - DNA, 201 bp, Homo sapiens
caggcttaggtgaccccccaacctcatcctcccaggtggctgaaactacaggcacatgccaccatgcccagctgattttttgtagagacagggcttcaccrtgttgccaagctagtctacaaagcatctgattttggaagtacatggaattgttgtaacaaagtatattgaatggaaatggctctcatgtattttggaatt

SEQ ID NO: 9675 - DNA, 201 bp, Homo sapiens
gcaccgcctgatccccctcacctgggcctgtatggctaggcagactcctcatcttggagaacagagaaggacgacagcttctttgttgcgcaaactgactrcagcctccaatggaggggtcattgaggagttatcttgtgttagatccaataactatgtgcaggaaccagagtgcaggaggaatcttgttcagtgcctcct

SEQ ID NO: 9676 - DNA, 201 bp, Homo sapiens
acctgcaaaagcttgggcttggagaagggaaattaaagagggtgctttactgttgccctgaaattttcaccatgcgccagcaggacattaacgacactgtyaggcttctcaaggagaagtgccttttcacggtacagcaagtcaccaagattttgcacagttgcccctctgttcttcgagaggacctgggtcaactggaat

SEQ ID NO: 9677 - DNA, 105 bp, Homo sapiens
accgytgcttccggcgccgtaactgctgccatcttctccgcgctatggctgcgttcggccgtcaggtccttgattggcaccgcctgatccccctcacctgggcct

SEQ ID NO: 9678 - DNA, 201 bp, Homo sapiens
agaaaagcagctcggtgactccgtccacatcgccacagttgagtcagatggcagtggcagtcctttgccagtggaaggagttcctgctaaggggaggtgcrggaggactaatttattattgtgcaactgccagtcctgcgcattccagctacgctaagcgccctgcccaggcacgtaacaaaacatagacctgttttgaag

SEQ ID NO: 9679 - DNA, 201 bp, Homo sapiens
attatgcaaatgaggaagcgctccagttacctgcaaaagcttgggcttggagaagggaaattaaagagggtgctttactgttgccctgaaattttcaccaygcgccagcaggacattaacgacactgtcaggcttctcaaggagaagtgccttttcacggtacagcaagtcaccaagattttgcacagttgcccctctgtt

SEQ ID NO: 9680 - DNA, 201 bp, Homo sapiens
aaggggaggtgcaggaggactaatttattattgtgcaactgccagtcctgcgcattccagctacgctaagcgccctgcccaggcacgtaacaaaacatagrcctgttttgaagtggcttgttacccaagggtgcctcactcatctgcgccaccaggaagatgaactgtgagggctcctataaggggcaggaagagcaaagc

SEQ ID NO: 9681 - DNA, 122 bp, Homo sapiens
accgctgcttccggcgccgtawctgctgccatcttctccgcgctatggctgcgttcggccgtcaggtccttgattggcaccgcctgatccccctcacctgggcctgtatggctaggcagact

SEQ ID NO: 9682 - DNA, 201 bp, Homo sapiens
gactcctgtggtacaagggtccttggagctagagagggtcatgagttccctcctggacatgggtttcagcaatgcccatattaatgaattgctcagtgtayggcgaggtgccagtcttcaacagttgctggacatcatttcagaatttattctcttgggtctgaatccagagcctgtgtgtgtggtcttgaagaaaagtcc

SEQ ID NO: 9683 - DNA, 201 bp, Homo sapiens
tcagtggctagaccaggttcatgtctgtttccccttggggacttctgaaccttcctgcccgggagtctgtaacacagcagcacaggaccgcgcttcctttwgcagtgctgagtaagcaggcagcggcactctgagatcccggggctgggcagtcgccccccacttcccagcagctctgtggtagtggggcgggagcagcag

SEQ ID NO: 9684 - DNA, 201 bp, Homo sapiens
taagcatccagacattgtaaagacagcctcgtcttacagcgtgactgcaaagaaaaagacttttgttttgcaaaagaaaagcagctcggtgactccgtccwcatcgccacagttgagtcagatggcagtggcagtcctttgccagtggaaggagttcctgctaaggggaggtgcaggaggactaatttattattgtgcaac

SEQ ID NO: 9685 - DNA, 201 bp, Homo sapiens
aatttattattgtgcaactgccagtcctgcgcattccagctacgctaagcgccctgcccaggcacgtaacaaaacatagacctgttttgaagtggcttgtyacccaagggtgcctcactcatctgcgccaccaggaagatgaactgtgagggctcctataaggggcaggaagagcaaagctgtcctaggccaaccagagat

SEQ ID NO: 9686 - DNA, 201 bp, Homo sapiens
tcacacacacacacacacacacaaacacacatacgcacgcacgatctcacttcgatctatacactggaggattaaaacaaacaaacaaaaaaaacatttcyttcgctccccctccctctccactctgagaagcagaggagccgcacggcgaggggccgcagaccgtctggaaatgcgaatcctaaagcgtttcctcgcttg

SEQ ID NO: 9687 - DNA, 201 bp, Homo sapiens
accgcggccgccgcagccggcgaaagaggcaaagtcccgcacgccggaggacatgcgcctcggctagcggccccgggccccaccaccgtgcggctttctcsagattattcctctctcgctgtctctgactgtctctctctgtctctgtctctgtctctctctctctcacacacacacacacacacacaaacacacatacgc

SEQ ID NO: 9688 - DNA, 201 bp, Homo sapiens
tgaattgtttcgccatctgcatacagtttctcaaatccttccacaagttacttcagctaccgagagtgataaggtgcccttgcatgcttctctgccagtgsctgggggtgatttgctattagagcccagccttgctcagtattctgatgtgctgtccactactcatgctgcttcagagacgctggaatttggtagtgaatc

SEQ ID NO: 9689 - DNA, 201 bp, Homo sapiens
acttctgagctgagtcatagtgccaaatctgatgccggtttagtgggtggtggtgaagatggtgacactgatgatgatggtgatgatgatgatgacagagrtagtgatggcttatccattcataagtgtatgtcatgctcatcctatagagaatcacaggaaaaggtaatgaatgattcagacacccacgaaaacagtctt

SEQ ID NO: 9690 - DNA, 201 bp, Homo sapiens
cttttcactggggaaaatgcaatatgtcatctgatggatcagagcatagtttagaaggacaaaaatttccacttgagatgcaaatctactgctttgatgcrgaccgattttcaagttttgaggaagcagtcaaaggaaaagggaagttaagagctttatccattttgtttgaggttgggacagaagaaaatttggatttca

SEQ ID NO: 9691 - DNA, 201 bp, Homo sapiens
tgctgtttccttctaaggcaacttctgagctgagtcatagtgccaaatctgatgccggtttagtgggtggtggtgaagatggtgacactgatgatgatggdgatgatgatgatgacagagatagtgatggcttatccattcataagtgtatgtcatgctcatcctatagagaatcacaggaaaaggtaatgaatgattcag

SEQ ID NO: 9692 - DNA, 201 bp, Homo sapiens
tccagactaattacactgagatacgtgttgatgaatctgagaagacaaccaagtccttttctgcaggcccagtgatgtcacagggtccctcagttacagayctggaaatgccacattattctacctttgcctacttcccaactgaggtaacacctcatgcttttaccccatcctccagacaacaggatttggtctccacgg

SEQ ID NO: 9693 - DNA, 201 bp, Homo sapiens
aacaaacaaaaaaaacatttccttcgctccccctccctctccactctgagaagcagaggagccgcacggcgaggggccgcagaccgtctggaaatgcgaakcctaaagcgtttcctcgcttgcattcagctcctctgtgtttgccgcctggattgggctaatggatactacagacaacagagaaaacttgttgaagagatt

SEQ ID NO: 9694 - DNA, 201 bp, Homo sapiens
aaaaaacatttccttcgctccccctccctctccactctgagaagcagaggagccgcacggcgaggggccgcagaccgtctggaaatgcgaatcctaaagcktttcctcgcttgcattcagctcctctgtgtttgccgcctggattgggctaatggatactacagacaacagagaaaacttgttgaagagattggctggtcc

SEQ ID NO: 9695 - DNA, 201 bp, Homo sapiens
acttcagctaccgagagtgataaggtgcccttgcatgcttctctgccagtggctgggggtgatttgctattagagcccagccttgctcagtattctgatgwgctgtccactactcatgctgcttcagagacgctggaatttggtagtgaatctggtgttctttataaaacgcttatgttttctcaagttgaaccacccagc

SEQ ID NO: 9696 - DNA, 201 bp, Homo sapiens
agctaccgagagtgataaggtgcccttgcatgcttctctgccagtggctgggggtgatttgctattagagcccagccttgctcagtattctgatgtgctgwccactactcatgctgcttcagagacgctggaatttggtagtgaatctggtgttctttataaaacgcttatgttttctcaagttgaaccacccagcagtga

SEQ ID NO: 9697 - DNA, 201 bp, Homo sapiens
gaatccatccacctctctggacagtaatggtgcagcattgcctgatggaaatatagctgagagcttagagtctttagtttaacacagaaaggggtgggggractcacatctgagcattgttttcctcttcctaaaattaggcaggaaaatcagtctagttctgttatctgttgatttcccatcacctgacagtaactttca

SEQ ID NO: 9698 - DNA, 201 bp, Homo sapiens
gctacacctgttttatcaattgatgaaccattaaatacactaataaataagcttatacattccgatgaaattttaacctccaccaaaagttctgttactgrtaaggtatttgctggtattccaacagttgcttctgatacatttgtatctactgatcattctgttcctataggaaatgggcatgttgccattacagctgtt

SEQ ID NO: 9699 - DNA, 201 bp, Homo sapiens
aagcatctggtgacacttcgcttaaacctgtgcttagtgcaaactcagagccagcatcctctgaccctgcttctagtgaaatgttatctccttcaactcarctcttattttatgagacctcagcttcttttagtactgaagtattgctacaaccttcctttcaggcttctgatgttgacaccttgcttaaaactgttcttc

SEQ ID NO: 9700 - DNA, 201 bp, Homo sapiens
cactaatgaaaaagatgctgatgggatcctggcagcaggtgactcagaaataactcctggattcccacagtccccaacatcatctgttactagcgagaackcagaagtgttccacgtttcagaggcagaggccagtaatagtagccatgagtctcgtattggtctagctgaggggttggaatccgagaagaaggcagttat

SEQ ID NO: 9701 - DNA, 201 bp, Homo sapiens
gttcatgatgagcatggaggagtgacggcaggaactttctgtgctctgacaacccttatgcaccaactagaaaaagaaaattccgtggatgtttaccaggkagccaagatgatcaatctgatgaggccaggagtctttgctgacattgagcagtatcagtttctctacaaagtgatcctcagccttgtgagcacaaggcag

SEQ ID NO: 9702 - DNA, 201 bp, Homo sapiens
ttctgttactggtaaggtatttgctggtattccaacagttgcttctgatacatttgtatctactgatcattctgttcctataggaaatgggcatgttgccrttacagctgtttctccccacagagatggttctgtaacctcaacaaagttgctgtttccttctaaggcaacttctgagctgagtcatagtgccaaatctga

SEQ ID NO: 9703 - DNA, 201 bp, Homo sapiens
tggtattccaacagttgcttctgatacatttgtatctactgatcattctgttcctataggaaatgggcatgttgccattacagctgtttctccccacagaratggttctgtaacctcaacaaagttgctgtttccttctaaggcaacttctgagctgagtcatagtgccaaatctgatgccggtttagtgggtggtggtga

SEQ ID NO: 9704 - DNA, 201 bp, Homo sapiens
taataaataagcttatacattccgatgaaattttaacctccaccaaaagttctgttactggtaaggtatttgctggtattccaacagttgcttctgatacrtttgtatctactgatcattctgttcctataggaaatgggcatgttgccattacagctgtttctccccacagagatggttctgtaacctcaacaaagttgc

SEQ ID NO: 9705 - DNA, 201 bp, Homo sapiens
cggccccgggccccaccaccgtgcggctttctccagattattcctctctcgctgtctctgactgtctctctctgtctctgtctctgtctctctctctctcwcacacacacacacacacacaaacacacatacgcacgcacgatctcacttcgatctatacactggaggattaaaacaaacaaacaaaaaaaacatttcctt

SEQ ID NO: 9706 - DNA, 201 bp, Homo sapiens
ttgctgtttccttctaaggcaacttctgagctgagtcatagtgccaaatctgatgccggtttagtgggtggtggtgaagatggtgacactgatgatgatgrtgatgatgatgatgacagagatagtgatggcttatccattcataagtgtatgtcatgctcatcctatagagaatcacaggaaaaggtaatgaatgattca

SEQ ID NO: 9707 - DNA, 201 bp, Homo sapiens
atgcgcctcggctagcggccccgggccccaccaccgtgcggctttctccagattattcctctctcgctgtctctgactgtctctctctgtctctgtctctstctctctctctctcacacacacacacacacacacaaacacacatacgcacgcacgatctcacttcgatctatacactggaggattaaaacaaacaaacaa

SEQ ID NO: 9708 - DNA, 201 bp, Homo sapiens; identical to SEQ ID NO: 9694

SEQ ID NO: 9709 - DNA, 201 bp, Homo sapiens; identical to SEQ ID NO: 9686

SEQ ID NO: 9710 - DNA, 201 bp, Homo sapiens; identical to SEQ ID NO: 9687

SEQ ID NO: 9711 - DNA, 201 bp, Homo sapiens; identical to SEQ ID NO: 9697

SEQ ID NO: 9712 - DNA, 201 bp, Homo sapiens; identical to SEQ ID NO: 9701

SEQ ID NO: 9713 - DNA, 201 bp, Homo sapiens; identical to SEQ ID NO: 9690

SEQ ID NO: 9714 - DNA, 201 bp, Homo sapiens; identical to SEQ ID NO: 9692

SEQ ID NO: 9715 - DNA, 201 bp, Homo sapiens; identical to SEQ ID NO: 9705

SEQ ID NO: 9716 - DNA, 201 bp, Homo sapiens; identical to SEQ ID NO: 9693

SEQ ID NO: 9717 - DNA, 193 bp, Homo sapiens
agagcggcagccgcgcccctccgccccccgcgcgaccccgggtccgaggcacgctcccagcggagcggtcctgcgcccccgccccctccaggmgccgcggcgcgcacagccgggctggagcgcgcacccggcactgaggcttcgctgctctcggagcgctcagaccgcggccgccgcagccggcgaaagaggc

SEQ ID NO: 9718 - DNA, 201 bp, Homo sapiens; identical to SEQ ID NO: 9707

SEQ ID NO: 9719 - DNA, 201 bp, Homo sapiens; identical to SEQ ID NO: 9694

SEQ ID NO: 9720 - DNA, 201 bp, Homo sapiens; identical to SEQ ID NO: 9686

SEQ ID NO: 9721 - DNA, 201 bp, Homo sapiens; identical to SEQ ID NO: 9687

SEQ ID NO: 9722 - DNA, 201 bp, Homo sapiens; identical to SEQ ID NO: 9695

SEQ ID NO: 9723 - DNA, 201 bp, Homo sapiens; identical to SEQ ID NO: 9696

SEQ ID NO: 9724 - DNA, 201 bp, Homo sapiens; identical to SEQ ID NO: 9698

SEQ ID NO: 9725 - DNA, 201 bp, Homo sapiens; identical to SEQ ID NO: 9697

SEQ ID NO: 9726 - DNA, 201 bp, Homo sapiens; identical to SEQ ID NO: 9699

SEQ ID NO: 9727 - DNA, 201 bp, Homo sapiens; identical to SEQ ID NO: 9700

SEQ ID NO: 9728 - DNA, 201 bp, Homo sapiens; identical to SEQ ID NO: 9688

SEQ ID NO: 9729 - DNA, 201 bp, Homo sapiens; identical to SEQ ID NO: 9701

SEQ ID NO: 9730 - DNA, 201 bp, Homo sapiens; identical to SEQ ID NO: 9703

SEQ ID NO: 9731 - DNA, 201 bp, Homo sapiens; identical to SEQ ID NO: 9702

SEQ ID NO: 9732 - DNA, 201 bp, Homo sapiens; identical to SEQ ID NO: 9689

SEQ ID NO: 9733 - DNA, 201 bp, Homo sapiens; identical to SEQ ID NO: 9704

SEQ ID NO: 9734 - DNA, 201 bp, Homo sapiens; identical to SEQ ID NO: 9690

SEQ ID NO: 9735 - DNA, 201 bp, Homo sapiens; identical to SEQ ID NO: 9691

SEQ ID NO: 9736 - DNA, 201 bp, Homo sapiens; identical to SEQ ID NO: 9692

SEQ ID NO: 9737 - DNA, 201 bp, Homo sapiens; identical to SEQ ID NO: 9705

SEQ ID NO: 9738 - DNA, 201 bp, Homo sapiens; identical to SEQ ID NO: 9693

SEQ ID NO: 9739 - DNA, 201 bp, Homo sapiens; identical to SEQ ID NO: 9706

SEQ ID NO: 9740 - DNA, 201 bp, Homo sapiens; identical to SEQ ID NO: 9707

SEQ ID NO: 9741 - DNA, 193 bp, Homo sapiens; identical to SEQ ID NO: 9717

SEQ ID NO: 9742 - DNA, 201 bp, Homo sapiens; identical to SEQ ID NO: 9686

SEQ ID NO: 9743 - DNA, 201 bp, Homo sapiens; identical to SEQ ID NO: 9687

SEQ ID NO: 9744 - DNA, 201 bp, Homo sapiens; identical to SEQ ID NO: 9688

SEQ ID NO: 9745 - DNA, 201 bp, Homo sapiens; identical to SEQ ID NO: 9689

SEQ ID NO: 9746 - DNA, 201 bp, Homo sapiens; identical to SEQ ID NO: 9690

SEQ ID NO: 9747 - DNA, 201 bp, Homo sapiens; identical to SEQ ID NO: 9691

SEQ ID NO: 9748 - DNA, 201 bp, Homo sapiens; identical to SEQ ID NO: 9692

SEQ ID NO: 9749 - DNA, 201 bp, Homo sapiens; identical to SEQ ID NO: 9693

SEQ ID NO: 9750 - DNA, 201 bp, Homo sapiens; identical to SEQ ID NO: 9694

SEQ ID NO: 9751 - DNA, 201 bp, Homo sapiens; identical to SEQ ID NO: 9695

SEQ ID NO: 9752 - DNA, 201 bp, Homo sapiens; identical to SEQ ID NO: 9696

SEQ ID NO: 9753 - DNA, 201 bp, Homo sapiens; identical to SEQ ID NO: 9697

SEQ ID NO: 9754 - DNA, 201 bp, Homo sapiens; identical to SEQ ID NO: 9698

SEQ ID NO: 9755 - DNA, 201 bp, Homo sapiens; identical to SEQ ID NO: 9699

SEQ ID NO: 9756 - DNA, 201 bp, Homo sapiens; identical to SEQ ID NO: 9700

SEQ ID NO: 9757 - DNA, 201 bp, Homo sapiens; identical to SEQ ID NO: 9702

SEQ ID NO: 9758 - DNA, 201 bp, Homo sapiens; identical to SEQ ID NO: 9703

SEQ ID NO: 9759 - DNA, 201 bp, Homo sapiens; identical to SEQ ID NO: 9701

SEQ ID NO: 9760 - DNA, 201 bp, Homo sapiens; identical to SEQ ID NO: 9704

SEQ ID NO: 9761 - DNA, 201 bp, Homo sapiens; identical to SEQ ID NO: 9705

SEQ ID NO: 9762 - DNA, 201 bp, Homo sapiens; identical to SEQ ID NO: 9706

SEQ ID NO: 9763 - DNA, 201 bp, Homo sapiens; identical to SEQ ID NO: 9707

SEQ ID NO: 9764 - DNA, 201 bp, Homo sapiens; identical to SEQ ID NO: 9694

SEQ ID NO: 9765 - DNA, 201 bp, Homo sapiens; identical to SEQ ID NO: 9686

SEQ ID NO: 9766 - DNA, 201 bp, Homo sapiens; identical to SEQ ID NO: 9687

SEQ ID NO: 9767 - DNA, 201 bp, Homo sapiens
aatggactaggtttgaatcttgactccaccatttggttattggttacatgacatacaatatataaattatttaacttaccaatgcttccatttttcttccrtgaaattgacatagtagctgcacctgccttataacattactatggaaattaaatgagggattgacttattactcataaaagtaattgaggagccaggcgc

SEQ ID NO: 9768 - DNA, 201 bp, Homo sapiens
aaaatttaaaaattgcaaaaatttatttaaaatataatattgaaccaaaaggcaatgattatttaaatacattatgatggatattatagatttcacaaaartcatgtttttgaatgatatatatacatataaaaggctcatgataaggtattaatggttttaaaaagaaacatgttaagtggtataaccagtattattttt

SEQ ID NO: 9769 - DNA, 201 bp, Homo sapiens
tgaaattgacatagtagctgcacctgccttataacattactatggaaattaaatgagggattgacttattactcataaaagtaattgaggagccaggcgcrgtggctcatgcctgtaatcccagcacttcgggaggccgagatgggcagatcactagaggtcaggagttccagaccagcctggccaacatggtgaaatgcc

SEQ ID NO: 9770 - DNA, 201 bp, Homo sapiens; identical to SEQ ID NO: 9693

SEQ ID NO: 9771 - DNA, 201 bp, Homo sapiens; identical to SEQ ID NO: 9705

SEQ ID NO: 9772 - DNA, 193 bp, Homo sapiens; identical to SEQ ID NO: 9717

SEQ ID NO: 9773 - DNA, 201 bp, Homo sapiens; identical to SEQ ID NO: 9707

SEQ ID NO: 9774 - DNA, 201 bp, Homo sapiens
gttttcttacatgtctagagaaagtctaaattggtagactttctgggaagcagtttgcttgtttttattaagaattttaaatgatttacactaaatacccwacatttaaatttaaagccatttagtctaaaaatttaaaaattgcaaaaatttatttaaaatataatattgaaccaaaaggcaatgattatttaaatacat

SEQ ID NO: 9775 - DNA, 201 bp, Homo sapiens
tcctcatgaacgtgaagagggggacctacctgccgcagacgtacatcatccaggaggagatggtggtcacggagcatgtcagtgacaaggaggccctgggktccttcatctaccacctgtgcaacgggaaagacacctaccggctccggcgccgggcaacgcggaggcggatcaacaagcgtggggccaagaactgcaatg

SEQ ID NO: 9776 - DNA, 201 bp, Homo sapiens
gagggggacctacctgccgcagacgtacatcatccaggaggagatggtggtcacggagcatgtcagtgacaaggaggccctggggtccttcatctaccacytgtgcaacgggaaagacacctaccggctccggcgccgggcaacgcggaggcggatcaacaagcgtggggccaagaactgcaatgccatccgccacttcga

SEQ ID NO: 9777 - DNA, 201 bp, Homo sapiens
caaggcgtcggcgtcggcccctgcgccggcctcggccaccgagatcctgctgacgccggctagggaggagcagcccccacaacatcgatccaagagggggrgctcagtgggcggcgtgtgctacctgtcgatgggcatggtcgtgctgctcatgggcctcgtgttcgcctctgtctacatctacagatacttcttccttgc

SEQ ID NO: 9778 - DNA, 201 bp, Homo sapiens
gtggagctcattgctttctccaagcttggaactgttttgaaagataacacagagggaaagggagagccacctggtacttgtccaccctgcctcctctgttytgaaattccatccccctcagcttaggggaatgcacctttttccctttccttctcacttttgcatgtttttactgatcattcgatatgctaaccgttctca

SEQ ID NO: 9779 - DNA, 201 bp, Homo sapiens
gggggggctcagtgggcggcgtgtgctacctgtcgatgggcatggtcgtgctgctcatgggcctcgtgttcgcctctgtctacatctacagatacttcttycttgcctcagctggcccgagataacttcttccgctgtggtgtgctgtatgaggactccctgtcctcccaggtccggactcagatggagctggaagaggat

SEQ ID NO: 9780 - DNA, 201 bp, Homo sapiens
ccaggagcacaagcagggtcccctcagtcaaggcagtgggatgggcggctgaggaacggggcaggcaaggtcactgctcagtcacgtccacgggggacgasccgtgggttctgctgagtaggtggagctcattgctttctccaagcttggaactgttttgaaagataacacagagggaaagggagagccacctggtacttg

SEQ ID NO: 9781 - DNA, 201 bp, Homo sapiens
cacttcgagaacaccttcgtggtggagacgctcatctgcggggtggtgtgaggccctcctcccccagaaccccctgccgtgttcctcttttcttctttccrgctgctctctggccctcctccttccccctgcttagcttgtactttggacgcgtttctatagaggtgacatgtctctccattcctctccaaccctgcccac

SEQ ID NO: 9782 - DNA, 201 bp, Homo sapiens
agtgctatgtcatcgaactcaacaccaccattgtgctgccccctcgcaacttctgggagctcctcatgaacgtgaagagggggacctacctgccgcagacrtacatcatccaggaggagatggtggtcacggagcatgtcagtgacaaggaggccctggggtccttcatctaccacctgtgcaacgggaaagacacctacc

SEQ ID NO: 9783 - DNA, 201 bp, Homo sapiens
tccatgacttccagcggagggggacctacctgccgcagacgtacatcatccaggaggagatggtggtcacggagcatgtcagtgacaaggaggccctgggktccttcatctaccacctgtgcaacgggaaagacacctaccggctccggcgccgggcaacgcggaggcggatcaacaagcgtggggccaagaactgcaatg

SEQ ID NO: 9784 - DNA, 201 bp, Homo sapiens; identical to SEQ ID NO: 9776

SEQ ID NO: 9785 - DNA, 201 bp, Homo sapiens; identical to SEQ ID NO: 9777

SEQ ID NO: 9786 - DNA, 201 bp, Homo sapiens
gggggggctcagtgggcggcgtgtgctacctgtcgatgggcatggtcgtgctgctcatgggcctcgtgttcgcctctgtctacatctacagatacttcttycttgcgcagctggcccgagataacttcttccgctgtggtgtgctgtatgaggactccctgtcctcccaggtccggactcagatggagctggaagaggatg

SEQ ID NO: 9787 - DNA, 201 bp, Homo sapiens
tctggccctcctccttccccctgcttagcttgtactttggacgcgtttctatagaggtgacatgtctctccattcctctccaacccctgcctcctctgttytgaaattccatccccctcagcttaggggaatgcacctttttccctttccttctcacttttgcatgtttttactgatcattcgatatgctaaccgttctca

SEQ ID NO: 9788 - DNA, 201 bp, Homo sapiens
gctcagtgggcggcgtgtgctacctgtcgatgggcatggtcgtgctgctcatgggcctcgtgttcgcctctgtctacatctacagatacttcttccttgcrcagctggcccgagataacttcttccgctgtggtgtgctgtatgaggactccctgtcctcccaggtccggactcagatggagctggaagaggatgtgaaaa

SEQ ID NO: 9789 - DNA, 201 bp, Homo sapiens
actacgagcgcatcaacgtgcctgtgccccagtttggcggcggtgaccctgcagacatcatccatgacttccagcggagggggacctacctgccgcagacrtacatcatccaggaggagatggtggtcacggagcatgtcagtgacaaggaggccctggggtccttcatctaccacctgtgcaacgggaaagacacctacc

SEQ ID NO: 9790 - DNA, 201 bp, Homo sapiens
cacttcgagaacaccttcgtggtggagacgctcatctgcggggtggtgtgaggccctcctcccccagaaccccctgccgtgttcctcttttcttctttccrgctgctctctggccctcctccttccccctgcttagcttgtactttggacgcgtttctatagaggtgacatgtctctccattcctctccaacccctgcctc

SEQ ID NO: 9791 - DNA, 201 bp, Homo sapiens; identical to SEQ ID NO: 9775

SEQ ID NO: 9792 - DNA, 201 bp, Homo sapiens; identical to SEQ ID NO: 9776

SEQ ID NO: 9793 - DNA, 201 bp, Homo sapiens; identical to SEQ ID NO: 9777

SEQ ID NO: 9794 - DNA, 201 bp, Homo sapiens; identical to SEQ ID NO: 9786

SEQ ID NO: 9795 - DNA, 201 bp, Homo sapiens; identical to SEQ ID NO: 9787

SEQ ID NO: 9796 - DNA, 201 bp, Homo sapiens; identical to SEQ ID NO: 9788

SEQ ID NO: 9797 - DNA, 201 bp, Homo sapiens; identical to SEQ ID NO: 9782

SEQ ID NO: 9798 - DNA, 201 bp, Homo sapiens; identical to SEQ ID NO: 9790

SEQ ID NO: 9799 - DNA, 201 bp, Homo sapiens; identical to SEQ ID NO: 9775

SEQ ID NO: 9800 - DNA, 201 bp, Homo sapiens; identical to SEQ ID NO: 9776

SEQ ID NO: 9801 - DNA, 201 bp, Homo sapiens; identical to SEQ ID NO: 9777

SEQ ID NO: 9802 - DNA, 201 bp, Homo sapiens; identical to SEQ ID NO: 9786

SEQ ID NO: 9803 - DNA, 201 bp, Homo sapiens; identical to SEQ ID NO: 9778

SEQ ID NO: 9804 - DNA, 201 bp, Homo sapiens; identical to SEQ ID NO: 9788

SEQ ID NO: 9805 - DNA, 201 bp, Homo sapiens; identical to SEQ ID NO: 9782

SEQ ID NO: 9806 - DNA, 201 bp, Homo sapiens; identical to SEQ ID NO: 9780

SEQ ID NO: 9807 - DNA, 201 bp, Homo sapiens; identical to SEQ ID NO: 9781

SEQ ID NO: 9808 - DNA, 201 bp, Homo sapiens
ggctgagtgcgtccctgataactgcgtctaagaccagagccccgcagcccctggggccccccggagccatggggtgtcgggggctcctgtgcaggctcatrctgcaggcggccgagggcacagggggtttcgcgctgctcctgaccgcggtgaggccgcgccgaccatctctgcactgaagggccctctggtggccggcac

SEQ ID NO: 9809 - DNA, 201 bp, Homo sapiens
gggcttctcggaccccaggccaacctcctcttcttcctccccagataacgtcctcctctcccagccacccggccaactccttctactacccgcggctgaargccctgcctcccatcgccagggtgacactgctgcggctgcgacagagccccagggccttcatccctcccgccccagtcctgcccagcagggacaatgaga

SEQ ID NO: 9810 - DNA, 201 bp, Homo sapiens
tacgtcagtaacgggctgcgcgactttgcggagcgcggcgaggcctgggcgctgatgaaggagatcgaggcggcgggggaggcgctgcagagcgtgcacgmggtgttttcggcgcccgccgtccccagcggcaccgggcagacgtcggcggagctggaggtgcagcgcaggcactcgctggtctcgtttgtggtgcgcatc

SEQ ID NO: 9811 - DNA, 201 bp, Homo sapiens
ggtccagcccgccaacaacgggagcccctgccccgagctcgaagaagaggctgagtgcgtccctgataactgcgtctaagaccagagccccgcagcccctrgggccccccggagccatggggtgtcgggggctcctgtgcaggctcatgctgcaggcggccgagggcacagggggtttcgcgctgctcctgaccgcggtga

SEQ ID NO: 9812 - DNA, 201 bp, Homo sapiens
caacccggggtcacagcaccgcagggaggacagcgggacgcgcgtcccgaggaggccgccccttcctggcctcggtttccagcccgtgttccgtgggatgrctgagaggagtacatgggaccctgtccccaacagtggtgcagagggcacgctggacgctgggcagtggccccagtgaggccatacgcataccagaaggtg

SEQ ID NO: 9813 - DNA, 201 bp, Homo sapiens
tcttcctccccagataacgtcctcctctcccagccacccggccaactccttctactacccgcggctgaaggccctgcctcccatcgccagggtgacactgstgcggctgcgacagagccccagggccttcatccctcccgccccagtcctgcccagcagggacaatgagattgtagacagcgcctcagttccagaaacgcc

SEQ ID NO: 9814 - DNA, 201 bp, Homo sapiens
cagcccggccgccgccctgggcaaggccctctgcgctctcctcctggccactctcggcgccgccggccagcctcttgggggagagtccatctgttccgccrgagccccggccaaatacagcatcaccttcacgggcaagtggagccagacggccttccccaagcagtaccccctgttccgcccccctgcgcagtggtcttc

SEQ ID NO: 9815 - DNA, 201 bp, Homo sapiens
aattatgtctccttataagttattgctgctccaggagattgtccttcatcgtccaggggcctggctcccacgtggttgcagatacctcagacctggtgctytaggctgtgctgagcccactctcccgagggcgcatccaagcgggggccacttgagaagtgaataaatggggcggtttcggaagcgtcagtgtttccatgt

SEQ ID NO: 9816 - DNA, 201 bp, Homo sapiens
gccgccgccctgggcaaggccctctgcgctctcctcctggccactctcggcgccgccggccagcctcttgggggagagtccatctgttccgccagagcccyggccaaatacagcatcaccttcacgggcaagtggagccagacggccttccccaagcagtaccccctgttccgcccccctgcgcagtggtcttcgctgctg

SEQ ID NO: 9817 - DNA, 201 bp, Homo sapiens
gggtgatggaaaaccccagcccggccgccgccctgggcaaggccctctgcgctctcctcctggccactctcggcgccgccggccagcctcttgggggagartccatctgttccgccagagccccggccaaatacagcatcaccttcacgggcaagtggagccagacggccttccccaagcagtaccccctgttccgccccc

SEQ ID NO: 9818 - DNA, 201 bp, Homo sapiens; identical to SEQ ID NO: 9808

SEQ ID NO: 9819 - DNA, 201 bp, Homo sapiens
cctcccccaacttcgccaccatcccgcaggacacggtgaccgagataacgtcctcctctcccagccacccggccaactccttctactacccgcggctgaargccctgcctcccatcgccagggtgacactgctgcggctgcgacagagccccagggccttcatccctcccgccccagtcctgcccagcagggacaatgaga

SEQ ID NO: 9820 - DNA, 201 bp, Homo sapiens; identical to SEQ ID NO: 9810

SEQ ID NO: 9821 - DNA, 201 bp, Homo sapiens; identical to SEQ ID NO: 9811

SEQ ID NO: 9822 - DNA, 201 bp, Homo sapiens
cacggtgaccgagataacgtcctcctctcccagccacccggccaactccttctactacccgcggctgaaggccctgcctcccatcgccagggtgacactgstgcggctgcgacagagccccagggccttcatccctcccgccccagtcctgcccagcagggacaatgagattgtagacagcgcctcagttccagaaacgcc

SEQ ID NO: 9823 - DNA, 201 bp, Homo sapiens; identical to SEQ ID NO: 9814

SEQ ID NO: 9824 - DNA, 201 bp, Homo sapiens; identical to SEQ ID NO: 9815

SEQ ID NO: 9825 - DNA, 201 bp, Homo sapiens; identical to SEQ ID NO: 9816

SEQ ID NO: 9826 - DNA, 201 bp, Homo sapiens; identical to SEQ ID NO: 9817

SEQ ID NO: 9827 - DNA, 201 bp, Homo sapiens; identical to SEQ ID NO: 9819

SEQ ID NO: 9828 - DNA, 201 bp, Homo sapiens; identical to SEQ ID NO: 9814

SEQ ID NO: 9829 - DNA, 201 bp, Homo sapiens; identical to SEQ ID NO: 9810

SEQ ID NO: 9830 - DNA, 201 bp, Homo sapiens; identical to SEQ ID NO: 9822

SEQ ID NO: 9831 - DNA, 201 bp, Homo sapiens; identical to SEQ ID NO: 9815

SEQ ID NO: 9832 - DNA, 201 bp, Homo sapiens; identical to SEQ ID NO: 9816

SEQ ID NO: 9833 - DNA, 201 bp, Homo sapiens; identical to SEQ ID NO: 9817

SEQ ID NO: 9834 - DNA, 201 bp, Homo sapiens
atggcccagaagaggtttcccatctgcacctgtggataggccagcagtcatcccgggatgagcagggggcctgtgccgtgctggctgtgcacctcaacacrctgctgggagagcggcctgtgcagcaccgcgaggtgcagggcaatgagtctgacctcttcatgagctacttcccacggggcctcaagtaccaggaaggtg

SEQ ID NO: 9835 - DNA, 201 bp, Homo sapiens
ggtggttggggcagccagagaagtaagagggaagtgagaagccgggtggggcaggctggaaggaagacgaacctacgaagcagagatctgaagacagcatrtacacagccattccccagagtggctctccattcccaggctcagtgcaggatccaggcctgcatgtgtggcgggtggagaagctgaagccggtgcctgtgg

SEQ ID NO: 9836 - DNA, 201 bp, Homo sapiens
gagtggctctccattcccaggctcagtgcaggatccaggcctgcatgtgtggcgggtggagaagctgaagccggtgcctgtggcgcaagagaaccagggcrtcttcttctcgggggactcctacctagtgctgcacaatggcccagaagaggtttcccatctgcacctgtggataggccagcagtcatcccgggatgagca

SEQ ID NO: 9837 - DNA, 201 bp, Homo sapiens
aatgagaaggagcggcaggcagccctgcaggtggccgagggcttcatctcgcgcatgcagtacgccccgaacactcaggtggagattctgcctcagggccrtgagagtcccatcttcaagcaatttttcaaggactggaaatgagggtgggcgtcttcctgccccatgctcccctgccccccaccacctgcctgcttgctt

SEQ ID NO: 9838 - DNA, 201 bp, Homo sapiens
ggcttcatctcgcgcatgcagtacgccccgaacactcaggtggagattctgcctcagggccgtgagagtcccatcttcaagcaatttttcaaggactggawatgagggtgggcgtcttcctgccccatgctcccctgccccccaccacctgcctgcttgcttctctggctgcctggtcagtgcagaggtgccccctgcaga

SEQ ID NO: 9839 - DNA, 201 bp, Homo sapiens
acctcacagctgacaaggcaaatgcccaggccgcagctctgtataaggtctctgatgccactggacagatgaacctgaccaaggtggctgactccagcccmtttgcccttgaactgctgatatctgatgactgctttgtgctggacaacgggctctgtggcaagatctatatctggaaggggcgaaaagcgaatgagaagg

SEQ ID NO: 9840 - DNA, 201 bp, Homo sapiens
ttcaagcaatttttcaaggactggaaatgagggtgggcgtcttcctgccccatgctcccctgccccccaccacctgcctgcttgcttctctggctgcctgrtcagtgcagaggtgccccctgcagatgttcaataaaggagacaagtgctttcccagctcttttcctgcaccacctgccctgggctgattctcactgtcac

SEQ ID NO: 9841 - DNA, 201 bp, Homo sapiens
tgagagtcccatcttcaagcaatttttcaaggactggaaatgagggtgggcgtcttcctgccccatgctcccctgccccccaccacctgcctgcttgcttytctggctgcctggtcagtgcagaggtgccccctgcagatgttcaataaaggagacaagtgctttcccagctcttttcctgcaccacctgccctgggctga

SEQ ID NO: 9842 - DNA, 201 bp, Homo sapiens
cagcagtcatcccgggatgagcagggggcctgtgccgtgctggctgtgcacctcaacacgctgctgggagagcggcctgtgcagcaccgcgaggtgcaggrcaatgagtctgacctcttcatgagctacttcccacggggcctcaagtaccaggaaggtggtgtggagtcagcatttcacaagacctccacaggagcccca

SEQ ID NO: 9843 - DNA, 201 bp, Homo sapiens; identical to SEQ ID NO: 9834

SEQ ID NO: 9844 - DNA, 201 bp, Homo sapiens
ttagccggttcgggggcgccccgctccctcctcttctcccacagccggggtcctctcttaggggcgcgccgtctcctggcttcctatctgaagacagcatrtacacagccattccccagagtggctctccattcccaggctcagtgcaggatccaggcctgcatgtgtggcgggtggagaagctgaagccggtgcctgtgg

SEQ ID NO: 9845 - DNA, 201 bp, Homo sapiens; identical to SEQ ID NO: 9836

SEQ ID NO: 9846 - DNA, 201 bp, Homo sapiens; identical to SEQ ID NO: 9837

SEQ ID NO: 9847 - DNA, 201 bp, Homo sapiens; identical to SEQ ID NO: 9838

SEQ ID NO: 9848 - DNA, 201 bp, Homo sapiens; identical to SEQ ID NO: 9839

SEQ ID NO: 9849 - DNA, 201 bp, Homo sapiens; identical to SEQ ID NO: 9840

SEQ ID NO: 9850 - DNA, 201 bp, Homo sapiens; identical to SEQ ID NO: 9841

SEQ ID NO: 9851 - DNA, 201 bp, Homo sapiens; identical to SEQ ID NO: 9842

SEQ ID NO: 9852 - DNA, 201 bp, Homo sapiens; identical to SEQ ID NO: 9834

SEQ ID NO: 9853 - DNA, 201 bp, Homo sapiens
acagctgagtgtgaggaacagtgattcccattgatccttgttccctccgtgggtcacagagtccagaacttaagagccacccaagatctgaagacagcatrtacacagccattccccagagtggctctccattcccaggctcagtgcaggatccaggcctgcatgtgtggcgggtggagaagctgaagccggtgcctgtgg

SEQ ID NO: 9854 - DNA, 201 bp, Homo sapiens; identical to SEQ ID NO: 9836

SEQ ID NO: 9855 - DNA, 201 bp, Homo sapiens; identical to SEQ ID NO: 9837

SEQ ID NO: 9856 - DNA, 201 bp, Homo sapiens; identical to SEQ ID NO: 9838

SEQ ID NO: 9857 - DNA, 201 bp, Homo sapiens; identical to SEQ ID NO: 9839

SEQ ID NO: 9858 - DNA, 201 bp, Homo sapiens; identical to SEQ ID NO: 9840

SEQ ID NO: 9859 - DNA, 201 bp, Homo sapiens; identical to SEQ ID NO: 9841

SEQ ID NO: 9860 - DNA, 201 bp, Homo sapiens; identical to SEQ ID NO: 9842

SEQ ID NO: 9861 - DNA, 201 bp, Homo sapiens; identical to SEQ ID NO: 9834

SEQ ID NO: 9862 - DNA, 201 bp, Homo sapiens
aggccctcaactccggctgggctcccggtggcactttctgccgaccctgagatgtacccgccacgcctgcgggactgacctctagatctgaagacagcatrtacacagccattccccagagtggctctccattcccaggctcagtgcaggatccaggcctgcatgtgtggcgggtggagaagctgaagccggtgcctgtgg

SEQ ID NO: 9863 - DNA, 201 bp, Homo sapiens; identical to SEQ ID NO: 9836

SEQ ID NO: 9864 - DNA, 201 bp, Homo sapiens; identical to SEQ ID NO: 9837

SEQ ID NO: 9865 - DNA, 201 bp, Homo sapiens; identical to SEQ ID NO: 9838

SEQ ID NO: 9866 - DNA, 201 bp, Homo sapiens; identical to SEQ ID NO: 9839

SEQ ID NO: 9867 - DNA, 201 bp, Homo sapiens; identical to SEQ ID NO: 9840

SEQ ID NO: 9868 - DNA, 201 bp, Homo sapiens; identical to SEQ ID NO: 9841

SEQ ID NO: 9869 - DNA, 201 bp, Homo sapiens; identical to SEQ ID NO: 9842

SEQ ID NO: 9870 - DNA, 201 bp, Homo sapiens
aaatttaaaaatctttcagaatacaattcagttttagtttcaaaatgttaacaacttgaattacaaccggttatcagttggacagtaagattttatccctytctcttctgactggtatacctatttcattagtagctaggtgcacatatacatctagcacagctgtgaggacagacagaaggcaaagtttccatgtggcct

SEQ ID NO: 9871 - DNA, 201 bp, Homo sapiens
ccttctttcctactctgggaagaatgtctcctgccactcctcaactgatgatagacttcgaaaacagatgagaagactagcagctagcaagggtgcttgtrgtcacactgtggaacactaaagagctaggaaagagttgagcacaggcaacattacaaacaaaggatttgaaaacaccaagagtacaggtcttctttaagg

SEQ ID NO: 9872 - DNA, 201 bp, Homo sapiens
gtccatgagttgagtgggtatttcttatttgaaagtgtttttctttaatcaaaagtccttagaatgagggaaacaaaatatttatttgttttggaatcccrcttatcaaatcattcaaaactttcagctggagtggggtttgcttttgttttgtttgtgtccataagagaaatggtagaagatgaatcagtatgaagacac

SEQ ID NO: 9873 - DNA, 201 bp, Homo sapiens
gctttaaacagtttaaaaccaactatgagaagagaagctttaaagtgcccatccaggccaacgaaacgcttgtgggtgctgtgataaacaatgtgtctgasgccatggagactcttacccgaatcacagaggagctggtcccagttccaggatctgtgaatggagtcaatgccctgggtctagttgtcttctccatgtgct

SEQ ID NO: 9874 - DNA, 201 bp, Homo sapiens
aaccatatcaactgattgcacaggacaatgaaactgagaaacccatcgacagtgaaaccaagatgtagactaacataaagaaacactttcttgagcaccargtgttaaaaaccattataaaatctttccatctcattacagctcattcgctccagcaagcccgtcatcttccctttcctcccttctgataagactggaaaa

SEQ ID NO: 9875 - DNA, 201 bp, Homo sapiens
ttaacaacttgaattacaaccggttatcagttggacagtaagattttatccctttctcttctgactggtatacctatttcattagtagctaggtgcacatmtacatctagcacagctgtgaggacagacagaaggcaaagtttccatgtggccttgagcaagtcccatctcacctctaggcctcagtgtcctcatctataa

SEQ ID NO: 9876 - DNA, 201 bp, Homo sapiens
gagtttctggctgaaaatggtgaagaatggacttaattatgctaacaaactgaaaaatctagacatagatcctctgatatacaattagagatatttttatrtagaccccaagcattctgtgcataaaaatacactacaaatgttaaagtacgtggctgtcctcttaagacactagtagagcaaagacttaatcatatcaac

SEQ ID NO: 9877 - DNA, 201 bp, Homo sapiens
atcaaatcattcaaaactttcagctggagtggggtttgcttttgttttgtttgtgtccataagagaaatggtagaagatgaatcagtatgaagacactgtyaatgaggttatgagaaaaaaacagcaggggcattagtttcaggcaaggcagctcccaggtttagagattaatttttaccccctaaggaatatccagtcaa

SEQ ID NO: 9878 - DNA, 201 bp, Homo sapiens
ggtgttaaaaaccattataaaatctttccatctcattacagctcattcgctccagcaagcccgtcatcttccctttcctcccttctgataagactggaaartagtcctccaaaacacaagggaggattttgggtggccaaagtgtacaattttcatcccacaattgaaatttttaaatcatttcatgttagtcttaccgaa

SEQ ID NO: 9879 - DNA, 201 bp, Homo sapiens
tttcatgttagtcttaccgaataaggtaccaagatcacaaatagtgttgatcagatcttacaagtttatgtggcacacaatcctataaatgtgattttttwatataagttaaagagacaaatagtaggctaaaaacattttaaaatcaacttttgaaatttaaaaatctttcagaatacaattcagttttagtttcaaaat

SEQ ID NO: 9880 - DNA, 201 bp, Homo sapiens
gaaaacagatgagaagactagcagctagcaagggtgcttgtggtcacactgtggaacactaaagagctaggaaagagttgagcacaggcaacattacaaayaaaggatttgaaaacaccaagagtacaggtcttctttaaggaagaataaaaaagaagaggttcatttttctggctttttttttcacctgaaacacttttt

SEQ ID NO: 9881 - DNA, 201 bp, Homo sapiens
tctcctttcctggggaacttctgatgaggatgttacagatgctggtcttaccacttatcatctccagtcttgtcacaggaatggcggcgctagatagtaargcatcagggaagatgggaatgcgagctgtagtctattatatgactaccaccatcattgctgtggtgattggcataatcattgtcatcatcatccatcctg

SEQ ID NO: 9882 - DNA, 201 bp, Homo sapiens
tgaagaatggacttaattatgctaacaaactgaaaaatctagacatagatcctctgatatacaattagagatatttttatatagaccccaagcattctgtrcataaaaatacactacaaatgttaaagtacgtggctgtcctcttaagacactagtagagcaaagacttaatcatatcaacttaattctgttacacaatat

SEQ ID NO: 9883 - DNA, 201 bp, Homo sapiens
tcaaactctttgcccagttcatcccaatgggggaagtattcccttctttcctactctgggaagaatgtctcctgccactcctcaactgatgatagacttcraaaacagatgagaagactagcagctagcaagggtgcttgtggtcacactgtggaacactaaagagctaggaaagagttgagcacaggcaacattacaaac

SEQ ID NO: 9884 - DNA, 201 bp, Homo sapiens; identical to SEQ ID NO: 9870

SEQ ID NO: 9885 - DNA, 201 bp, Homo sapiens; identical to SEQ ID NO: 9871

SEQ ID NO: 9886 - DNA, 201 bp, Homo sapiens; identical to SEQ ID NO: 9872

SEQ ID NO: 9887 - DNA, 201 bp, Homo sapiens; identical to SEQ ID NO: 9873

SEQ ID NO: 9888 - DNA, 201 bp, Homo sapiens; identical to SEQ ID NO: 9874

SEQ ID NO: 9889 - DNA, 201 bp, Homo sapiens; identical to SEQ ID NO: 9875

SEQ ID NO: 9890 - DNA, 201 bp, Homo sapiens
gagtttctggctgaaaatggtgaagaatggacttaattatgctaacaaactgaaaaatctagacatagatcctctgatatacaattagagatatttttatrtagaccccaagcattctgtgcataaaagttaacattaggctgtggtgcagtaaccatttaatgtcgaggctctatttcggaaatacactacaaatgttaa

SEQ ID NO: 9891 - DNA, 201 bp, Homo sapiens; identical to SEQ ID NO: 9877

SEQ ID NO: 9892 - DNA, 201 bp, Homo sapiens; identical to SEQ ID NO: 9878

SEQ ID NO: 9893 - DNA, 201 bp, Homo sapiens; identical to SEQ ID NO: 9879

SEQ ID NO: 9894 - DNA, 201 bp, Homo sapiens; identical to SEQ ID NO: 9880

SEQ ID NO: 9895 - DNA, 201 bp, Homo sapiens; identical to SEQ ID NO: 9881

SEQ ID NO: 9896 - DNA, 201 bp, Homo sapiens
tgaagaatggacttaattatgctaacaaactgaaaaatctagacatagatcctctgatatacaattagagatatttttatatagaccccaagcattctgtrcataaaagttaacattaggctgtggtgcagtaaccatttaatgtcgaggctctatttcggaaatacactacaaatgttaaagtacgtggctgtcctctta

SEQ ID NO: 9897 - DNA, 201 bp, Homo sapiens; identical to SEQ ID NO: 9883

SEQ ID NO: 9898 - DNA, 201 bp, Homo sapiens
gagccgattcttccagtctacgggaagcctgaaatccacctcctcctccacaggtgcagccgaccaggtggaccctggcgctgcagcggccgcagcgcccscagcgcccgccttcccgccccagctgccgccgcacgtagctacagaaattgacagaagaaagaagagaccattggaaaatgatgggcctgttaaaaagaa

SEQ ID NO: 9899 - DNA, 201 bp, Homo sapiens
atacaagtcatgaaaatttacagaaaactgcttccaaatcagctaacaaacggtccaaaagcatctatacgccgctagaattacaatacatagaaatgaarcagcagcacaaagatgcagttttgtgtgtggaatgtggatataagtatagattctttggggaagatgcagagattgcagcccgagagctcaatatttatt

SEQ ID NO: 9900 - DNA, 201 bp, Homo sapiens
cacctcctcctccacaggtgcagccgaccaggtggaccctggcgctgcagcggccgcagcgcccccagcgcccgccttcccgccccagctgccgccgcacrtagctacagaaattgacagaagaaagaagagaccattggaaaatgatgggcctgttaaaaagaaagtaaagaaagtccaacaaaaggaaggaggaagtga

SEQ ID NO: 9901 - DNA, 201 bp, Homo sapiens
tcctgaactcctcagtccagtggagcattacttaaagatactcaatgaacaagctgccaaagttggggataaaactgaattatttaaagacctttctgacytccctttaataaaaaagaggaaggatgaaattcaaggtgttattgacgagatccgaatgcatttgcaagaaatacgaaaaatactaaaaaatccttctgc

SEQ ID NO: 9902 - DNA, 201 bp, Homo sapiens
ttgatctcagtcagtttggatcatcaaatacaagtcatgaaaatttacagaaaactgcttccaaatcagctaacaaacggtccaaaagcatctatacgccrctagaattacaatacatagaaatgaagcagcagcacaaagatgcagttttgtgtgtggaatgtggatataagtatagattctttggggaagatgcagaga

SEQ ID NO: 9903 - DNA, 201 bp, Homo sapiens
ccaagagttcttcttgattgtcaaaactttatatcacctaaagtcagaatttcaagcaataatacctgctgttaattcccacattcagtcagacttgctcyggaccgttattttagaaattcctgaactcctcagtccagtggagcattacttaaagatactcaatgaacaagctgccaaagttggggataaaactgaatt

SEQ ID NO: 9904 - DNA, 201 bp, Homo sapiens
ttctggcattgttaacttagagaagcctgtgatttgctctttggctgccatcataaaatacctcaaagaattcaacttggaaaagatgctctccaaacctragaattttaaacagctatcaagtaaaatggaatttatgacaattaatggaacaacattaaggaatctggaaatcctacagaatcagactgatatgaaaac

SEQ ID NO: 9905 - DNA, 201 bp, Homo sapiens
ttgtccgagcaaacagaggcgctcatccacagagccacatctgttagtgtgcaggatgacagaattcgagtcgaaaggatggataacatttattttgaatrcagccatgctttccaggcagttacagagttttatgcaaaagatacagttgacatcaaaggttctcaaattatttctggcattgttaacttagagaagcct

SEQ ID NO: 9906 - DNA, 201 bp, Homo sapiens
ttactcacaccaggtggggaattaccacatgggattcttggtcagtgaggatgaaagcaaactggatccaggcgcagcagaacaagtccctgattttgtcrccttcctttaccaaataactagaggaattgcagcaaggagttatggattaaatgtggctaaactagcagatgttcctggagaaattttgaagaaagcagc

SEQ ID NO: 9907 - DNA, 201 bp, Homo sapiens
attcttccagtctacgggaagcctgaaatccacctcctcctccacaggtgcagccgaccaggtggaccctggcgctgcagcggccgcagcgcccccagcgsccgccttcccgccccagctgccgccgcacgtagctacagaaattgacagaagaaagaagagaccattggaaaatgatgggcctgttaaaaagaaagtaaa

SEQ ID NO: 9908 - DNA, 201 bp, Homo sapiens
tccgccagtttgtgaactagaaaaaaattactcacaccaggtggggaattaccacatgggattcttggtcagtgaggatgaaagcaaactggatccaggcrcagcagaacaagtccctgattttgtcaccttcctttaccaaataactagaggaattgcagcaaggagttatggattaaatgtggctaaactagcagatgt

SEQ ID NO: 9909 - DNA, 201 bp, Homo sapiens
tttgagccgattcttccagtctacgggaagcctgaaatccacctcctcctccacaggtgcagccgaccaggtggaccctggcgctgcagcggccgcagcgsccccagcgcccgccttcccgccccagctgccgccgcacgtagctacagaaattgacagaagaaagaagagaccattggaaaatgatgggcctgttaaaaa

SEQ ID NO: 9910 - DNA, 201 bp, Homo sapiens
gctcagattggctcctatgttcctgcagaagaagcgacaattgggattgtggatggcattttcacaaggatgggtgctgcagacaatatatataaaggacrgagtacatttatggaagaactgactgacacagcagaaataatcagaaaagcaacatcacagtccttggttatcttggatgaactaggaagagggacgagc

SEQ ID NO: 9911 - DNA, 201 bp, Homo sapiens
aagcggttttgagccgattcttccagtctacgggaagcctgaaatccacctcctcctccacaggtgcagccgaccaggtggaccctggcgctgcagcggcygcagcgcccccagcgcccgccttcccgccccagctgccgccgcacgtagctacagaaattgacagaagaaagaagagaccattggaaaatgatgggcctg

SEQ ID NO: 9912 - DNA, 201 bp, Homo sapiens
atgggcctgttaaaaagaaagtaaagaaagtccaacaaaaggaaggaggaagtgatctgggaatgtctggcaactctgagccaaagaaatgtctgaggacyaggaatgtttcaaagtctctggaaaaattgaaagaattctgctgcgattctgcccttcctcaaagtagagtccagacagaatctctgcaggagagatttg

SEQ ID NO: 9913 - DNA, 201 bp, Homo sapiens
gttgactgcattttctccctggccaaggtcgctaagcaaggagattactgcagaccaactgtacaagaagaaagaaaaattgtaataaaaaatggaaggcwccctgtgattgatgtgttgctgggagaacaggatcaatatgtcccaaataatacagatttatcagaggactcagagagagtaatgataattaccggacca

SEQ ID NO: 9914 - DNA, 201 bp, Homo sapiens
ttcaagaccagcctggccaacatggcaaaaccccatctttactaaaaatataaagtacatctctactaaaaatacgaaaaaattagctgggcatggtggcrcacacctgtagtcccagctactccggaggctgaggcaggagaatctcttgaacctgggaggcggaggttgcaatgagccgagatcacgtcactgcactcc

SEQ ID NO: 9915 - DNA, 165 bp, Homo sapiens
gtctttaaaaagcataaagaacatcaaggtcaaaaaatgattcttgtatcaaaaccaactgtacaagaagaaagaaaaattgtaataaaaaatggaaggcwccctgtgattgatgtgttgctgggagaacaggatcaatatgtcccaaataatacagatttatca

SEQ ID NO: 9916 - DNA, 201 bp, Homo sapiens
accagagcgttcacggtgagcatgaaaggcagccgcgtggagcgcgcggaagaggcacttgcccacatgggcagctccgtgttcagtggaatcacacttasaaaatttggagggattgtggtgttggcttttgccaaatctcaaattttccagatattctacttcaggatgtatttggccatggtcttactgggagccact

SEQ ID NO: 9917 - DNA, 201 bp, Homo sapiens
tttctggtgaccatggtcctcctgggctgtgagctctggtctgcagtcatcatgtgtgccaccatcgccatggtcttggtcaacatgtttggagttatgtrgctctggggcatcagtctgaacgctgtatccttggtcaacctggtgatgagctgtggcatctccgtggagttctgcagccacataaccagagcgttcacg

SEQ ID NO: 9918 - DNA, 201 bp, Homo sapiens
atatttctggtgaccatggtcctcctgggctgtgagctctggtctgcagtcatcatgtgtgccaccatcgccatggtcttggtcaacatgtttggagttaygtggctctggggcatcagtctgaacgctgtatccttggtcaacctggtgatgagctgtggcatctccgtggagttctgcagccacataaccagagcgttc

SEQ ID NO: 9919 - DNA, 201 bp, Homo sapiens
ttctgcagttaacatcctccttggccatggcaccagggtcggagccacgtacttcatgacctaccacaccgtgctgcagacctctgctgactttattgacrctctgaagaaagcccgacttatagccagtaatgtcaccgaaaccatgggcattaacggcagtgcctaccgagtatttccttacagtgtgttttatgtctt

SEQ ID NO: 9920 - DNA, 201 bp, Homo sapiens
tgggctgtgagctctggtctgcagtcatcatgtgtgccaccatcgccatggtcttggtcaacatgtttggagttatgtggctctggggcatcagtctgaaygctgtatccttggtcaacctggtgatgagctgtggcatctccgtggagttctgcagccacataaccagagcgttcacggtgagcatgaaaggcagccgcg

SEQ ID NO: 9921 - DNA, 201 bp, Homo sapiens
cagtgtgttttatgtcttctacgaacagtacctgaccatcattgacgacactatcttcaacctcggtgtgtccctgggcgcgatatttctggtgaccatgktcctcctgggctgtgagctctggtctgcagtcatcatgtgtgccaccatcgccatggtcttggtcaacatgtttggagttatgtggctctggggcatcag

SEQ ID NO: 9922 - DNA, 201 bp, Homo sapiens
ttgaagatgaactaaatcgtgaaagtgacagtgatgtcttcaccgttgtaattagctatgccatcatgtttctatatatttccctagccttggggcacatsaaaagctgtcgcaggcttctggtggattcgaaggtctcactaggcatcgcgggcatcttgatcgtgctgagctcggtggcttgctccttgggtgtcttca

SEQ ID NO: 9923 - DNA, 201 bp, Homo sapiens
agtagatattggattggatcagtctctttcgatgccagatgactcctacatggtggattatttcaaatccatcagtcagtacctgcatgcgggtccgcctrtgtactttgtcctggaggaagggcacgactacacttcttccaaggggcagaacatggtgtgcggcggcatgggctgcaacaatgattccctggtgcagca

SEQ ID NO: 9924 - DNA, 201 bp, Homo sapiens
actgcaccaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgta

SEQ ID NO: 9925 - DNA, 201 bp, Homo sapiens
ttcctttcggataaccctaaccccaagtgtggcaaagggggacatgctgcctatagttctgcagttaacatcctccttggccatggcaccagggtcggagycacgtacttcatgacctaccacaccgtgctgcagacctctgctgactttattgacgctctgaagaaagcccgacttatagccagtaatgtcaccgaaacc

SEQ ID NO: 9926 - DNA, 201 bp, Homo sapiens
taccatcactcctgtgttttcagattttccagtccatgggatggagcccatgaacaatgccaccaaaggctgtgacgagtctgtggatgaggtcacagcaycatgtagctgccaagactgctctattgtctgtggccccaagccccagcccccacctcctcctgctccctggacgatccttggcttggacgccatgtatgt

SEQ ID NO: 9927 - DNA, 201 bp, Homo sapiens
ctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgttttcacagtcctgtgttt

SEQ ID NO: 9928 - DNA, 201 bp, Homo sapiens
agtggacaatatcactgaccagttctgcaatgcttcagtggttgaccctgcctgcgttcgctgcaggcctctgactccggaaggcaaacagaggcctcagkggggagacttcatgagattcctgcccatgttcctttcggataaccctaaccccaagtgtggcaaagggggacatgctgcctatagttctgcagttaacat

SEQ ID NO: 9929 - DNA, 201 bp, Homo sapiens
gttacaatactacgtcggacagagttttgccaatgcaatgtacaatgcctgccgggatgtggaggccccctcaagtaatgacaaggccctgggactcctgkgtgggaaggacgctgacgcctgtaatgccaccaactggattgaatacatgttcaataaggacaatggacaggcaccttttaccatcactcctgtgttttc

SEQ ID NO: 9930 - DNA, 201 bp, Homo sapiens
acagtcgtcttgctgtcgagtggacaatatcactgaccagttctgcaatgcttcagtggttgaccctgcctgcgttcgctgcaggcctctgactccggaargcaaacagaggcctcaggggggagacttcatgagattcctgcccatgttcctttcggataaccctaaccccaagtgtggcaaagggggacatgctgccta

SEQ ID NO: 9931 - DNA, 201 bp, Homo sapiens
tgattccctggtgcagcagatatttaacgcggcgcagctggacaactatacccgaataggcttcgccccctcgtcctggatcgacgattatttcgactggrtgaagccacagtcgtcttgctgtcgagtggacaatatcactgaccagttctgcaatgcttcagtggttgaccctgcctgcgttcgctgcaggcctctgac

SEQ ID NO: 9932 - DNA, 201 bp, Homo sapiens
ctttcggataaccctaaccccaagtgtggcaaagggggacatgctgcctatagttctgcagttaacatcctccttggccatggcaccagggtcggagccaygtacttcatgacctaccacaccgtgctgcagacctctgctgactttattgacgctctgaagaaagcccgacttatagccagtaatgtcaccgaaaccatg

SEQ ID NO: 9933 - DNA, 201 bp, Homo sapiens
aaaaatcggctagacatcttttgctgtgtcagaggtgctgaagatggaacaagcgtccaggcctcagagagctgtttgtttcgcttcttcaaaaactcctrttctccacttctgctaaaggactggatgagaccaattgtgatagcaatatttgtgggtgttctgtcattcagcatcgcagtcctgaacaaagtagatatt

SEQ ID NO: 9934 - DNA, 201 bp, Homo sapiens
gagactgtagcatttttcttaggagcattgtccgtgatgccagccgtgcacaccttctctctctttgcgggattggcagtcttcattgactttcttctgcmgattacctgtttcgtgagtctcttggggttagacattaaacgtcaagagaaaaatcggctagacatcttttgctgtgtcagaggtgctgaagatggaaca

SEQ ID NO: 9935 - DNA, 201 bp, Homo sapiens
gatgtccatcctgtttttataacctactgaacctgttttgtgagctgacatgtagccctcgacagagtcagtttttgaatgttacagctactgaagattaygttgatcctgttacaaaccagacgaaaacaaatgtgaaagagttacaatactacgtcggacagagttttgccaatgcaatgtacaatgcctgccgggatg

SEQ ID NO: 9936 - DNA, 201 bp, Homo sapiens
ccgttcctggtgctggctgttggagtggacaacatcttcattctggtgcaggcctaccagagagatgaacgtcttcaaggggaaaccctggatcagcagcygggcagggtcctaggagaagtggctcccagtatgttcctgtcatccttttctgagactgtagcatttttcttaggagcattgtccgtgatgccagccgtg

SEQ ID NO: 9937 - DNA, 201 bp, Homo sapiens
tagccttggggcacatcaaaagctgtcgcaggcttctggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatcttca

SEQ ID NO: 9938 - DNA, 201 bp, Homo sapiens
aatctgaccatttccttcactgctgaacgaagtattgaagatgaactaaatcgtgaaagtgacagtgatgtcttcaccgttgtaattagctatgccatcakgtttctatatatttccctagccttggggcacatcaaaagctgtcgcaggcttctggtggattcgaaggtctcactaggcatcgcgggcatcttgatcgtg

SEQ ID NO: 9939 - DNA, 201 bp, Homo sapiens
tacagagaagctccagagggcccaggcctgggaaaaagagtttattaattttgtgaaaaactacaagaatcccaatctgaccatttccttcactgctgaaygaagtattgaagatgaactaaatcgtgaaagtgacagtgatgtcttcaccgttgtaattagctatgccatcatgtttctatatatttccctagccttggg

SEQ ID NO: 9940 - DNA, 201 bp, Homo sapiens
acacttacaaaatttggagggattgtggtgttggcttttgccaaatctcaaattttccagatattctacttcaggatgtatttggccatggtcttactggragccactcacggattaatatttctccctgtcttactcagttacatagggccatcagtaaataaagccaaaagttgtgccactgaagagcgatacaaagga

SEQ ID NO: 9941 - DNA, 201 bp, Homo sapiens
gcttcagacactaaaagacaacctgcagctgcctctacagtttctgtccagatgtccatcctgtttttataacctactgaacctgttttgtgagctgacaygtagccctcgacagagtcagtttttgaatgttacagctactgaagattatgttgatcctgttacaaaccagacgaaaacaaatgtgaaagagttacaata

SEQ ID NO: 9942 - DNA, 201 bp, Homo sapiens
cagctggacaactatacccgaataggcttcgccccctcgtcctggatcgacgattatttcgactgggtgaagccacagtcgtcttgctgtcgagtggacartatcactgaccagttctgcaatgcttcagtggttgaccctgcctgcgttcgctgcaggcctctgactccggaaggcaaacagaggcctcaggggggagac

SEQ ID NO: 9943 - DNA, 201 bp, Homo sapiens
caacaatgattccctggtgcagcagatatttaacgcggcgcagctggacaactatacccgaataggcttcgccccctcgtcctggatcgacgattatttcractgggtgaagccacagtcgtcttgctgtcgagtggacaatatcactgaccagttctgcaatgcttcagtggttgaccctgcctgcgttcgctgcaggcc

SEQ ID NO: 9944 - DNA, 201 bp, Homo sapiens
gtgagtctcttggggttagacattaaacgtcaagagaaaaatcggctagacatcttttgctgtgtcagaggtgctgaagatggaacaagcgtccaggcctsagagagctgtttgtttcgcttcttcaaaaactcctattctccacttctgctaaaggactggatgagaccaattgtgatagcaatatttgtgggtgttctg

SEQ ID NO: 9945 - DNA, 201 bp, Homo sapiens
aatgatacagagaagctccagagggcccaggcctgggaaaaagagtttattaattttgtgaaaaactacaagaatcccaatctgaccatttccttcactgytgaacgaagtattgaagatgaactaaatcgtgaaagtgacagtgatgtcttcaccgttgtaattagctatgccatcatgtttctatatatttccctagcc

SEQ ID NO: 9946 - DNA, 201 bp, Homo sapiens
gtccgggtcacaaccaatccagttgacctctggtcagcccccagcagccaggctcgcctggaaaaagagtactttgaccagcactttgggcctttcttccrgacggagcagctcatcatccgggcccctctcactgacaaacacatttaccagccatacccttcgggagctgatgtaccctttggacctccgcttgacata

SEQ ID NO: 9947 - DNA, 201 bp, Homo sapiens
ttctgcgtccgaaaccctggctgtgtcattttcttctcgctggtcttcattactgcgtgttcgtcaggcctggtgtttgtccgggtcacaaccaatccagytgacctctggtcagcccccagcagccaggctcgcctggaaaaagagtactttgaccagcactttgggcctttcttccggacggagcagctcatcatccgg

SEQ ID NO: 9948 - DNA, 201 bp, Homo sapiens
actgaccagttctgcaatgcttcagtggttgaccctgcctgcgttcgctgcaggcctctgactccggaaggcaaacagaggcctcaggggggagacttcakgagattcctgcccatgttcctttcggataaccctaaccccaagtgtggcaaagggggacatgctgcctatagttctgcagttaacatcctccttggccat

SEQ ID NO: 9949 - DNA, 201 bp, Homo sapiens
tgctgcatcggcaaggccaagttgaacaccggatggtgccaaccatcggttgtttggcagcagctttgaacgtagcgcctgtgaactcaggaatgcacagytgacttgggaagcagtattactagatctggaggcaaccacaggacactaaacttctcccagcctcttcaggaaagaaacctcattctttggcaagcagga

SEQ ID NO: 9950 - DNA, 201 bp, Homo sapiens
ctattctccacttctgctaaaggactggatgagaccaattgtgatagcaatatttgtgggtgttctgtcattcagcatcgcagtcctgaacaaagtagatrttggattggatcagtctctttcgatgccagatgactcctacatggtggattatttcaaatccatcagtcagtacctgcatgcgggtccgcctgtgtactt

SEQ ID NO: 9951 - DNA, 201 bp, Homo sapiens
actacacttcttccaaggggcagaacatggtgtgcggcggcatgggctgcaacaatgattccctggtgcagcagatatttaacgcggcgcagctggacaaytatacccgaataggcttcgccccctcgtcctggatcgacgattatttcgactgggtgaagccacagtcgtcttgctgtcgagtggacaatatcactgacc

SEQ ID NO: 9952 - DNA, 201 bp, Homo sapiens
gcctttcttccggacggagcagctcatcatccgggcccctctcactgacaaacacatttaccagccatacccttcgggagctgatgtaccctttggacctycgcttgacatacagatactgcaccaggttcttgacttacaaatagccatcgaaaacattactgcctcttatgacaatgagactgtgacacttcaagacat

SEQ ID NO: 9953 - DNA, 201 bp, Homo sapiens
aaggcagccgcgtggagcgcgcggaagaggcacttgcccacatgggcagctccgtgttcagtggaatcacacttacaaaatttggagggattgtggtgttsgcttttgccaaatctcaaattttccagatattctacttcaggatgtatttggccatggtcttactgggagccactcacggattaatatttctccctgtct

SEQ ID NO: 9954 - DNA, 201 bp, Homo sapiens
gtgcaggaactctgtccaggattcttctttggcaatgtcagtctctgttgtgatgttcggcagcttcagacactaaaagacaacctgcagctgcctctacrgtttctgtccagatgtccatcctgtttttataacctactgaacctgttttgtgagctgacatgtagccctcgacagagtcagtttttgaatgttacagct

SEQ ID NO: 9955 - DNA, 201 bp, Homo sapiens
tgtgggaaggacgctgacgcctgtaatgccaccaactggattgaatacatgttcaataaggacaatggacaggcaccttttaccatcactcctgtgttttmagattttccagtccatgggatggagcccatgaacaatgccaccaaaggctgtgacgagtctgtggatgaggtcacagcaccatgtagctgccaagactgc

SEQ ID NO: 9956 - DNA, 201 bp, Homo sapiens
tgcaccattttgagtgtgttaaattacttccagaacagccattccgtgctggaccacaagaaaggggacgacttctttgtgtatgccgattaccacacgcrctttctgtactgcgtacgggctcctgcctctctgaatgatacaagtttgctccatgacccttgtctgggtacgtttggtggaccagtgttcccgtggctt

SEQ ID NO: 9957 - DNA, 201 bp, Homo sapiens
gttaaattacttccagaacagccattccgtgctggaccacaagaaaggggacgacttctttgtgtatgccgattaccacacgcactttctgtactgcgtaygggctcctgcctctctgaatgatacaagtttgctccatgacccttgtctgggtacgtttggtggaccagtgttcccgtggcttgtgttgggaggctatga

SEQ ID NO: 9958 - DNA, 201 bp, Homo sapiens
tgctccttgggtgtcttcagctacattgggttgcccttgaccctcattgtgattgaagtcatcccgttcctggtgctggctgttggagtggacaacatctycattctggtgcaggcctaccagagagatgaacgtcttcaaggggaaaccctggatcagcagctgggcagggtcctaggagaagtggctcccagtatgttc

SEQ ID NO: 9959 - DNA, 201 bp, Homo sapiens
atatttgtgggtgttctgtcattcagcatcgcagtcctgaacaaagtagatattggattggatcagtctctttcgatgccagatgactcctacatggtggwttatttcaaatccatcagtcagtacctgcatgcgggtccgcctgtgtactttgtcctggaggaagggcacgactacacttcttccaaggggcagaacatg

SEQ ID NO: 9960 - DNA, 201 bp, Homo sapiens
gaagggcacgactacacttcttccaaggggcagaacatggtgtgcggcggcatgggctgcaacaatgattccctggtgcagcagatatttaacgcggcgcmgctggacaactatacccgaataggcttcgccccctcgtcctggatcgacgattatttcgactgggtgaagccacagtcgtcttgctgtcgagtggacaat

SEQ ID NO: 9961 - DNA, 201 bp, Homo sapiens
tggcttgctccttgggtgtcttcagctacattgggttgcccttgaccctcattgtgattgaagtcatcccgttcctggtgctggctgttggagtggacaayatcttcattctggtgcaggcctaccagagagatgaacgtcttcaaggggaaaccctggatcagcagctgggcagggtcctaggagaagtggctcccagta

SEQ ID NO: 9962 - DNA, 201 bp, Homo sapiens
actaaaagacaacctgcagctgcctctacagtttctgtccagatgtccatcctgtttttataacctactgaacctgttttgtgagctgacatgtagccctygacagagtcagtttttgaatgttacagctactgaagattatgttgatcctgttacaaaccagacgaaaacaaatgtgaaagagttacaatactacgtcgg

SEQ ID NO: 9963 - DNA, 201 bp, Homo sapiens
gacgcctgtaatgccaccaactggattgaatacatgttcaataaggacaatggacaggcaccttttaccatcactcctgtgttttcagattttccagtccrtgggatggagcccatgaacaatgccaccaaaggctgtgacgagtctgtggatgaggtcacagcaccatgtagctgccaagactgctctattgtctgtggc

SEQ ID NO: 9964 - DNA, 201 bp, Homo sapiens
cagcagatatttaacgcggcgcagctggacaactatacccgaataggcttcgccccctcgtcctggatcgacgattatttcgactgggtgaagccacagtygtcttgctgtcgagtggacaatatcactgaccagttctgcaatgcttcagtggttgaccctgcctgcgttcgctgcaggcctctgactccggaaggcaaa

SEQ ID NO: 9965 - DNA, 201 bp, Homo sapiens
gaaaggcagccgcgtggagcgcgcggaagaggcacttgcccacatgggcagctccgtgttcagtggaatcacacttacaaaatttggagggattgtggtgktggcttttgccaaatctcaaattttccagatattctacttcaggatgtatttggccatggtcttactgggagccactcacggattaatatttctccctgt

SEQ ID NO: 9966 - DNA, 201 bp, Homo sapiens
gttctgcagccacataaccagagcgttcacggtgagcatgaaaggcagccgcgtggagcgcgcggaagaggcacttgcccacatgggcagctccgtgttcrgtggaatcacacttacaaaatttggagggattgtggtgttggcttttgccaaatctcaaattttccagatattctacttcaggatgtatttggccatggt

SEQ ID NO: 9967 - DNA, 201 bp, Homo sapiens
aatggacaggcaccttttaccatcactcctgtgttttcagattttccagtccatgggatggagcccatgaacaatgccaccaaaggctgtgacgagtctgkggatgaggtcacagcaccatgtagctgccaagactgctctattgtctgtggccccaagccccagcccccacctcctcctgctccctggacgatccttggc

SEQ ID NO: 9968 - DNA, 201 bp, Homo sapiens
aatttggagggattgtggtgttggcttttgccaaatctcaaattttccagatattctacttcaggatgtatttggccatggtcttactgggagccactcayggattaatatttctccctgtcttactcagttacatagggccatcagtaaataaagccaaaagttgtgccactgaagagcgatacaaaggaacagagcgcg

SEQ ID NO: 9969 - DNA, 201 bp, Homo sapiens
gggcatcagtctgaacgctgtatccttggtcaacctggtgatgagctgtggcatctccgtggagttctgcagccacataaccagagcgttcacggtgagcrtgaaaggcagccgcgtggagcgcgcggaagaggcacttgcccacatgggcagctccgtgttcagtggaatcacacttacaaaatttggagggattgtggt

SEQ ID NO: 9970 - DNA, 201 bp, Homo sapiens
gtcttcaaggggaaaccctggatcagcagctgggcagggtcctaggagaagtggctcccagtatgttcctgtcatccttttctgagactgtagcatttttyttaggagcattgtccgtgatgccagccgtgcacaccttctctctctttgcgggattggcagtcttcattgactttcttctgcagattacctgtttcgtga

SEQ ID NO: 9971 - DNA, 201 bp, Homo sapiens
atccatcagtcagtacctgcatgcgggtccgcctgtgtactttgtcctggaggaagggcacgactacacttcttccaaggggcagaacatggtgtgcggcrgcatgggctgcaacaatgattccctggtgcagcagatatttaacgcggcgcagctggacaactatacccgaataggcttcgccccctcgtcctggatcga

SEQ ID NO: 9972 - DNA, 201 bp, Homo sapiens
acaaagtagatattggattggatcagtctctttcgatgccagatgactcctacatggtggattatttcaaatccatcagtcagtacctgcatgcgggtccrcctgtgtactttgtcctggaggaagggcacgactacacttcttccaaggggcagaacatggtgtgcggcggcatgggctgcaacaatgattccctggtgc

SEQ ID NO: 9973 - DNA, 201 bp, Homo sapiens
tggtgttggcttttgccaaatctcaaattttccagatattctacttcaggatgtatttggccatggtcttactgggagccactcacggattaatatttctycctgtcttactcagttacatagggccatcagtaaataaagccaaaagttgtgccactgaagagcgatacaaaggaacagagcgcgaacggcttctaaatt

SEQ ID NO: 9974 - DNA, 201 bp, Homo sapiens
gtcttactgggagccactcacggattaatatttctccctgtcttactcagttacatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggac

SEQ ID NO: 9975 - DNA, 201 bp, Homo sapiens
agctgccaagactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacagaaaacggtattttgtctccgagtacactcccatc

SEQ ID NO: 9976 - DNA, 201 bp, Homo sapiens
gttttcagattttccagtccatgggatggagcccatgaacaatgccaccaaaggctgtgacgagtctgtggatgaggtcacagcaccatgtagctgccaasactgctctattgtctgtggccccaagccccagcccccacctcctcctgctccctggacgatccttggcttggacgccatgtatgtcatcatgtggatcac

SEQ ID NO: 9977 - DNA, 201 bp, Homo sapiens
ttacaatactacgtcggacagagttttgccaatgcaatgtacaatgcctgccgggatgtggaggccccctcaagtaatgacaaggccctgggactcctgtrtgggaaggacgctgacgcctgtaatgccaccaactggattgaatacatgttcaataaggacaatggacaggcaccttttaccatcactcctgtgttttca

SEQ ID NO: 9978 - DNA, 201 bp, Homo sapiens
ggccatggcaccagggtcggagccacgtacttcatgacctaccacaccgtgctgcagacctctgctgactttattgacgctctgaagaaagcccgacttayagccagtaatgtcaccgaaaccatgggcattaacggcagtgcctaccgagtatttccttacagtgtgttttatgtcttctacgaacagtacctgaccatc

SEQ ID NO: 9979 - DNA, 201 bp, Homo sapiens
gtgaccctgtcagcgcagcatttgagggctgcttgaggcggctgttcacacgctgggggtctttctgcgtccgaaaccctggctgtgtcattttcttctcrctggtcttcattactgcgtgttcgtcaggcctggtgtttgtccgggtcacaaccaatccagttgacctctggtcagcccccagcagccaggctcgcctgg

SEQ ID NO: 9980 - DNA, 201 bp, Homo sapiens
cagtgtggtgctacagaaaacggtattttgtctccgagtacactcccatcgatagcaatatagctttttctgttaatgcaagtgacaaaggagaggcgtcytgctgtgaccctgtcagcgcagcatttgagggctgcttgaggcggctgttcacacgctgggggtctttctgcgtccgaaaccctggctgtgtcattttct

SEQ ID NO: 9981 - DNA, 201 bp, Homo sapiens
tcttccaaggggcagaacatggtgtgcggcggcatgggctgcaacaatgattccctggtgcagcagatatttaacgcggcgcagctggacaactatacccraataggcttcgccccctcgtcctggatcgacgattatttcgactgggtgaagccacagtcgtcttgctgtcgagtggacaatatcactgaccagttctgc

SEQ ID NO: 9982 - DNA, 201 bp, Homo sapiens
atatttaacgcggcgcagctggacaactatacccgaataggcttcgccccctcgtcctggatcgacgattatttcgactgggtgaagccacagtcgtcttrctgtcgagtggacaatatcactgaccagttctgcaatgcttcagtggttgaccctgcctgcgttcgctgcaggcctctgactccggaaggcaaacagagg

SEQ ID NO: 9983 - DNA, 201 bp, Homo sapiens
cgattatttcgactgggtgaagccacagtcgtcttgctgtcgagtggacaatatcactgaccagttctgcaatgcttcagtggttgaccctgcctgcgttygctgcaggcctctgactccggaaggcaaacagaggcctcaggggggagacttcatgagattcctgcccatgttcctttcggataaccctaaccccaagtg

SEQ ID NO: 9984 - DNA, 201 bp, Homo sapiens
ctgaagaaagcccgacttatagccagtaatgtcaccgaaaccatgggcattaacggcagtgcctaccgagtatttccttacagtgtgttttatgtcttctrcgaacagtacctgaccatcattgacgacactatcttcaacctcggtgtgtccctgggcgcgatatttctggtgaccatggtcctcctgggctgtgagctc

SEQ ID NO: 9985 - DNA, 201 bp, Homo sapiens
tctgcagtcatcatgtgtgccaccatcgccatggtcttggtcaacatgtttggagttatgtggctctggggcatcagtctgaacgctgtatccttggtcarcctggtgatgagctgtggcatctccgtggagttctgcagccacataaccagagcgttcacggtgagcatgaaaggcagccgcgtggagcgcgcggaagag

SEQ ID NO: 9986 - DNA, 201 bp, Homo sapiens
gctgtaaatgtaatgagtgtcggaaaacatttactgggagctcaaaccatattgtccaccagaggatccacactggggagaagccctctgcctgtaacgaytctggcaaagcctttatgcagattgcaaatcttattgtacatcagcgaagccatactggtgagaagccatatgagtagaaaccttatgactgcagtgaat

SEQ ID NO: 9987 - DNA, 201 bp, Homo sapiens
tgatccttaaggacctgagttaagagaggcttgtgaaaaagaaaacatgttaaagaggcagagaataaggagggaaaggaaagatttcagataagtcataktgaatgactgtcacttacctgaaagcttcaaagaagaggaagaccagaaatgtaagaaatctgtgggaaaatacagccttaattctgacactgttaacaa

SEQ ID NO: 9988 - DNA, 201 bp, Homo sapiens
aagctgatccttaaggacctgagttaagagaggcttgtgaaaaagaaaacatgttaaagaggcagagaataaggagggaaaggaaagatttcagataagtsatagtgaatgactgtcacttacctgaaagcttcaaagaagaggaagaccagaaatgtaagaaatctgtgggaaaatacagccttaattctgacactgtta

SEQ ID NO: 9989 - DNA, 201 bp, Homo sapiens
cgaagccatactggtgagaagccatatgagtagaaaccttatgactgcagtgaatgtgggcaagccttcagtcagctctcttgcctttttgtccaccagaraattcacagtggagatcttccttttgtgtgtaatgaatgtgggaaggccttcacatgtagctcatacctacttattcatcagagaatccataatggagaa

SEQ ID NO: 9990 - DNA, 201 bp, Homo sapiens
aggcagagaataaggagggaaaggaaagatttcagataagtcatagtgaatgactgtcacttacctgaaagcttcaaagaagaggaagaccagaaatgtargaaatctgtgggaaaatacagccttaattctgacactgttaacaatccgaaaacccagcttgggcgaaagtcttttacattgtagcatgtgtgggaaagg

SEQ ID NO: 9991 - DNA, 201 bp, Homo sapiens
tgtcggaaaacatttactgggagctcaaaccatattgtccaccagaggatccacactggggagaagccctctgcctgtaacgattctggcaaagcctttaygcagattgcaaatcttattgtacatcagcgaagccatactggtgagaagccatatgagtagaaaccttatgactgcagtgaatgtgggcaagccttcagt

SEQ ID NO: 9992 - DNA, 201 bp, Homo sapiens
cagccactgttcaccttcaagcactgcctgcagcccccttcaacatcaccgtgacaaagctttccagcagcaacgctagtgtggcctggatgccaggtgcygatggccgagctctgctacagtcctgtacagttcaggtgacacaggccccaggaggctgggaagtcctggctgttgtggtccctgtgcccccctttacct

SEQ ID NO: 9993 - DNA, 201 bp, Homo sapiens
gtgccctttcagaccaagggtctagccccagccagcgctccccaaaacctccatgccatccgcacagattcaggcctcatcttggagtgggaagaagtgawccccgaggcccctttggaaggccccctgggaccctacaaactgtcctgggttcaagacaatggaacccaggatgagctgacagtggaggggaccagggcc

SEQ ID NO: 9994 - DNA, 201 bp, Homo sapiens
gggccagctgtctgtgctatctgccagccaggaccccttatacatcaacatcgagagagctgaggagcccactgcgggaggcagcctggagctacctggcrgggatcagccctacagtggggctggggatggcagtggcatgggggcagtgggtggcactcccagtgactgtcggtacatactcacccccggagggctggc

SEQ ID NO: 9995 - DNA, 146 bp, Homo sapiens
gatgagggggaattcctggaacctggaccccagccttggtgggggagcctctggaatgcatggggcgggtcctagctgttagggacatttccaagctgttrgttgctgtttaaaatagaaataaaattgaagactaaagacctaag

SEQ ID NO: 9996 - DNA, 201 bp, Homo sapiens
acagtggggctggggatggcagtggcatgggggcagtgggtggcactcccagtgactgtcggtacatactcacccccggagggctggctgagcagccaggrcaggcagagcaccagccagagagtcccctcaatgagacacagaggcttttgctgctgcagcaagggctactgccacacagtagctgttagcccacaggca

SEQ ID NO: 9997 - DNA, 201 bp, Homo sapiens
tgccacccaatgcccctttccaactgtcttgtgaggctgtgggtccccctgaacctgttaccattgtctggtggagaggaactacgaagatcgggggaccygctccctctccatctgttttaaatgtaacaggggtgacccagagcaccatgttttcctgtgaagctcacaacctaaaaggcctggcctcttctcgcacag

SEQ ID NO: 9998 - DNA, 201 bp, Homo sapiens
ctcatcccagagcagcagttcaccctgggccggatgttgggcaaaggagagtttggttcagtgcgggaggcccagctgaagcaagaggatggctcctttgkgaaagtggctgtgaagatgctgaaagctgacatcattgcctcaagcgacattgaagagttcctcagggaagcagcttgcatgaaggagtttgaccatcca

SEQ ID NO: 9999 - DNA, 201 bp, Homo sapiens
ctgcgaatggaactggagaacatcttgggccagctgtctgtgctatctgccagccaggaccccttatacatcaacatcgagagagctgaggagcccactgygggaggcagcctggagctacctggcagggatcagccctacagtggggctggggatggcagtggcatgggggcagtgggtggcactcccagtgactgtcgg

SEQ ID NO: 10000 - DNA, 201 bp, Homo sapiens
gccgcacatcctgggtacctgtggtccttggtgtgctaacggccctggtgacggctgctgccctggccctcatcctgcttcgaaagagacggaaagagacrcggtttgggcaagcctttgacagtgtcatggcccggggagagccagccgttcacttccgggcagcccggtccttcaatcgagaaaggcccgagcgcatcg

SEQ ID NO: 10001 - DNA, 201 bp, Homo sapiens
cccctgctgcttaagtgcatgcattgagctgcctccagcctggtggcccagctattaccacacttggggtttaaatatccaggtgtgcccctccaagtcasaaagagatgtccttgtaatattcccttttaggtgagggttggtaaggggttggtatctcaggtctgaatcttcaccatctttctgattccgcaccctgcc

SEQ ID NO: 10002 - DNA, 201 bp, Homo sapiens; identical to SEQ ID NO: 9992

SEQ ID NO: 10003 - DNA, 201 bp, Homo sapiens; identical to SEQ ID NO: 9993

SEQ ID NO: 10004 - DNA, 201 bp, Homo sapiens; identical to SEQ ID NO: 9994

SEQ ID NO: 10005 - DNA, 146 bp, Homo sapiens; identical to SEQ ID NO: 9995

SEQ ID NO: 10006 - DNA, 201 bp, Homo sapiens; identical to SEQ ID NO: 9996

SEQ ID NO: 10007 - DNA, 201 bp, Homo sapiens; identical to SEQ ID NO: 9997

SEQ ID NO: 10008 - DNA, 201 bp, Homo sapiens; identical to SEQ ID NO: 9998

SEQ ID NO: 10009 - DNA, 201 bp, Homo sapiens; identical to SEQ ID NO: 9999

SEQ ID NO: 10010 - DNA, 201 bp, Homo sapiens; identical to SEQ ID NO: 10000

SEQ ID NO: 10011 - DNA, 201 bp, Homo sapiens; identical to SEQ ID NO: 10001

SEQ ID NO: 10012 - DNA, 201 bp, Homo sapiens; identical to SEQ ID NO: 9992

SEQ ID NO: 10013 - DNA, 201 bp, Homo sapiens; identical to SEQ ID NO: 9993

SEQ ID NO: 10014 - DNA, 201 bp, Homo sapiens; identical to SEQ ID NO: 9994

SEQ ID NO: 10015 - DNA, 146 bp, Homo sapiens; identical to SEQ ID NO: 9995

SEQ ID NO: 10016 - DNA, 201 bp, Homo sapiens; identical to SEQ ID NO: 9996

SEQ ID NO: 10017 - DNA, 201 bp, Homo sapiens; identical to SEQ ID NO: 9997

SEQ ID NO: 10018 - DNA, 201 bp, Homo sapiens; identical to SEQ ID NO: 9998

SEQ ID NO: 10019 - DNA, 201 bp, Homo sapiens; identical to SEQ ID NO: 9999

SEQ ID NO: 10020 - DNA, 201 bp, Homo sapiens; identical to SEQ ID NO: 10000

SEQ ID NO: 10021 - DNA, 201 bp, Homo sapiens; identical to SEQ ID NO: 10001

SEQ ID NO: 10022 - DNA, 201 bp, Homo sapiens
gagccgcagccagtccatggatgccatggggctgagcaacaagaagcccaacaccgtgtccaccagccacagcgggagcttcgcgcccaacaaccccgacstggccaaggcggctggaatatcactgattgtccctgggaagagccccacgaggaagaagtcgggcccgttcggctcccgccgcagcagcgccattggcat

SEQ ID NO: 10023 - DNA, 198 bp, Homo sapiens
tccaggccttgcctcccccgaccgccatggagggggcagcccggcacagctgctgggagcccttgtgtgtctggtcacactttttaggcgtcacgccaaargccagcctcctggccccaatacccattttggaagcccctgtggccgtgtggatgtcggtaacagttgtataaaataaattctatttatcgctattgt

SEQ ID NO: 10024 - DNA, 201 bp, Homo sapiens
gttccctaatgttgtccagatggcaaagttggtgtgtgaagacgtcaatgtggatcggttctatcctgtgctctaccccaaggcttcccggctcatcgtcrcctttgacgagcatgtcatcagcaataacttcaagtttggcgtcatttatcagaagcttgggcagacctccgaggaagaactcttcagcaccaatgagga

SEQ ID NO: 10025 - DNA, 201 bp, Homo sapiens
cctcctatactccttcactctaccctaagaacacagatctatttgagatgattgagaagatgcagggaagcaggatggatgaacaacgctgctccttcccrccgcccctcaaaacagaggaggactacattccatacccgagcgtgcacgaggtcttggggcgagaaggacccttccccctcatcctgctgccccagtttg

SEQ ID NO: 10026 - DNA, 201 bp, Homo sapiens
cactgattgtccctgggaagagccccacgaggaagaagtcgggcccgttcggctcccgccgcagcagcgccattggcatcgagaacatacaggaggtgcasgagaagagggagagccctccggctggtcagaagaccccagacagcgggcacgtctcacaggagcccaagtcggagaactcatccactcagagctccccag

SEQ ID NO: 10027 - DNA, 201 bp, Homo sapiens
gcagtgggggcggcggcttctttgagtctttcaagcgggtcatccggagccgcagccagtccatggatgccatggggctgagcaacaagaagcccaacacygtgtccaccagccacagcgggagcttcgcgcccaacaaccccgacctggccaaggcggctggaatatcactgattgtccctgggaagagccccacgagga

SEQ ID NO: 10028 - DNA, 201 bp, Homo sapiens
ccacaaccaaggtgaagctcgagtgcaaccccacagcccgcatctaccggaagcactttctcggcaaggagcatttcaattactactcactggacgctgcyctcggccaccttgtcttctcactcaagtacgatgtcatcggggaccaagagcacctgcggctgctgctcaggaccaagtgccggacataccatgatgtca

SEQ ID NO: 10029 - DNA, 201 bp, Homo sapiens
gcggcggcggcaccatgagcggccggaagcgcagcttcaccttcggggcctacggcggggtggacaagtccttcacttctcgccggagtgtgtggaggagygatgggcagaaccagcacttccctcaggcactagacctgtcacgagtgaacttagttccctcctatactccttcactctaccctaagaacacagatctat

SEQ ID NO: 10030 - DNA, 201 bp, Homo sapiens
ccctcccggaccccgctgtgttcaggaaggggcctgagttccaggaatttttgctgacaaagctgatcaatgctgaatatgcctgctacaaggcagagaartttgccaaactggaggagcggacgcgggccgccctcctggagacgctctatgaggaactacacatccacagccagtccatgatgggcttgggcggcgacg

SEQ ID NO: 10031 - DNA, 201 bp, Homo sapiens
cggagtgtgtggaggagcgatgggcagaaccagcacttccctcaggcactagacctgtcacgagtgaacttagttccctcctatactccttcactctaccmtaagaacacagatctatttgagatgattgagaagatgcagggaagcaggatggatgaacaacgctgctccttcccgccgcccctcaaaacagaggaggac

SEQ ID NO: 10032 - DNA, 201 bp, Homo sapiens
gtcgcccacaaccaaggtgaagctcgagtgcaaccccacagcccgcatctaccggaagcactttctcggcaaggagcatttcaattactactcactggacrctgccctcggccaccttgtcttctcactcaagtacgatgtcatcggggaccaagagcacctgcggctgctgctcaggaccaagtgccggacataccatga

SEQ ID NO: 10033 - DNA, 201 bp, Homo sapiens
catggcccacccatctgggctgtctctgcagggcagagccgtccagacctgggatcagggaagctgctggcatcgtccccacccccagcctgggggtctgsgctggggcagggattgctcagtggaagcaggactgggggtctggcttgccccctccctgggcctccatcacccctgagcatccctctggactcagaggga

SEQ ID NO: 10034 - DNA, 201 bp, Homo sapiens
cgacgaggacaagatggagaatggcagtgggggcggcggcttctttgagtctttcaagcgggtcatccggagccgcagccagtccatggatgccatggggmtgagcaacaagaagcccaacaccgtgtccaccagccacagcgggagcttcgcgcccaacaaccccgacctggccaaggcggctggaatatcactgattgt

SEQ ID NO: 10035 - DNA, 201 bp, Homo sapiens
ggggctactggattgagggcaccaaccacgaaatcaccagcatccccgagacagagccactgcagtcgcccacaaccaaggtgaagctcgagtgcaacccyacagcccgcatctaccggaagcactttctcggcaaggagcatttcaattactactcactggacgctgccctcggccaccttgtcttctcactcaagtacg

SEQ ID NO: 10036 - DNA, 201 bp, Homo sapiens
agggcaccaaccacgaaatcaccagcatccccgagacagagccactgcagtcgcccacaaccaaggtgaagctcgagtgcaaccccacagcccgcatctaycggaagcactttctcggcaaggagcatttcaattactactcactggacgctgccctcggccaccttgtcttctcactcaagtacgatgtcatcggggacc

SEQ ID NO: 10037 - DNA, 201 bp, Homo sapiens
agtctttcaagcgggtcatccggagccgcagccagtccatggatgccatggggctgagcaacaagaagcccaacaccgtgtccaccagccacagcgggagyttcgcgcccaacaaccccgacctggccaaggcggctggaatatcactgattgtccctgggaagagccccacgaggaagaagtcgggcccgttcggctccc

SEQ ID NO: 10038 - DNA, 201 bp, Homo sapiens
gagccgcagccagtccatggatgccatggggctgagcaacaagaagcccaacaccgtgtccaccagccacagcgggagcttcgcgcccaacaaccccgacstggccaaggcggctggaatatcattgcttattcctgggaaaagtgcgagtagattcggacgccggggcagtgccataggcataggaaccgtggaagagtc

SEQ ID NO: 10039 - DNA, 198 bp, Homo sapiens; identical to SEQ ID NO: 10023

SEQ ID NO: 10040 - DNA, 201 bp, Homo sapiens; identical to SEQ ID NO: 10024

SEQ ID NO: 10041 - DNA, 201 bp, Homo sapiens; identical to SEQ ID NO: 10025

SEQ ID NO: 10042 - DNA, 201 bp, Homo sapiens; identical to SEQ ID NO: 10026

SEQ ID NO: 10043 - DNA, 201 bp, Homo sapiens
gcagtgggggcggcggcttctttgagtctttcaagcgggtcatccggagccgcagccagtccatggatgccatggggctgagcaacaagaagcccaacacygtgtccaccagccacagcgggagcttcgcgcccaacaaccccgacctggccaaggcggctggaatatcattgcttattcctgggaaaagtgcgagtagat

SEQ ID NO: 10044 - DNA, 201 bp, Homo sapiens; identical to SEQ ID NO: 10028

SEQ ID NO: 10045 - DNA, 201 bp, Homo sapiens
gcggcggccgcgggcaccagagtgccgagcccaggacgcccccggcccaggcccttggggtggacaagtccttcacttctcgccggagtgtgtggaggagygatgggcagaaccagcacttccctcaggcactagacctgtcacgagtgaacttagttccctcctatactccttcactctaccctaagaacacagatctat

SEQ ID NO: 10046 - DNA, 201 bp, Homo sapiens; identical to SEQ ID NO: 10030

SEQ ID NO: 10047 - DNA, 201 bp, Homo sapiens; identical to SEQ ID NO: 10031

SEQ ID NO: 10048 - DNA, 201 bp, Homo sapiens; identical to SEQ ID NO: 10032

SEQ ID NO: 10049 - DNA, 201 bp, Homo sapiens; identical to SEQ ID NO: 10033

SEQ ID NO: 10050 - DNA, 201 bp, Homo sapiens
cgacgaggacaagatggagaatggcagtgggggcggcggcttctttgagtctttcaagcgggtcatccggagccgcagccagtccatggatgccatggggmtgagcaacaagaagcccaacaccgtgtccaccagccacagcgggagcttcgcgcccaacaaccccgacctggccaaggcggctggaatatcattgcttat

SEQ ID NO: 10051 - DNA, 201 bp, Homo sapiens; identical to SEQ ID NO: 10035

SEQ ID NO: 10052 - DNA, 201 bp, Homo sapiens; identical to SEQ ID NO: 10036

SEQ ID NO: 10053 - DNA, 201 bp, Homo sapiens
agtctttcaagcgggtcatccggagccgcagccagtccatggatgccatggggctgagcaacaagaagcccaacaccgtgtccaccagccacagcgggagyttcgcgcccaacaaccccgacctggccaaggcggctggaatatcattgcttattcctgggaaaagtgcgagtagattcggacgccggggcagtgccatag

SEQ ID NO: 10054 - DNA, 201 bp, Homo sapiens; identical to SEQ ID NO: 10022

SEQ ID NO: 10055 - DNA, 198 bp, Homo sapiens; identical to SEQ ID NO: 10023

SEQ ID NO: 10056 - DNA, 201 bp, Homo sapiens; identical to SEQ ID NO: 10024

SEQ ID NO: 10057 - DNA, 201 bp, Homo sapiens; identical to SEQ ID NO: 10025

SEQ ID NO: 10058 - DNA, 201 bp, Homo sapiens; identical to SEQ ID NO: 10026

SEQ ID NO: 10059 - DNA, 201 bp, Homo sapiens; identical to SEQ ID NO: 10027

SEQ ID NO: 10060 - DNA, 201 bp, Homo sapiens; identical to SEQ ID NO: 10028

SEQ ID NO: 10061 - DNA, 201 bp, Homo sapiens
gatctcaatttcttcgtgtctaaaatggggaaactgcagcgccacttaccctgcctagggtggacaagtccttcacttctcgccggagtgtgtggaggagygatgggcagaaccagcacttccctcaggcactagacctgtcacgagtgaacttagttccctcctatactccttcactctaccctaagaacacagatctat

SEQ ID NO: 10062 - DNA, 201 bp, Homo sapiens; identical to SEQ ID NO: 10030

SEQ ID NO: 10063 - DNA, 201 bp, Homo sapiens; identical to SEQ ID NO: 10031

SEQ ID NO: 10064 - DNA, 201 bp, Homo sapiens; identical to SEQ ID NO: 10032

SEQ ID NO: 10065 - DNA, 201 bp, Homo sapiens; identical to SEQ ID NO: 10033

SEQ ID NO: 10066 - DNA, 201 bp, Homo sapiens; identical to SEQ ID NO: 10034

SEQ ID NO: 10067 - DNA, 201 bp, Homo sapiens; identical to SEQ ID NO: 10035

SEQ ID NO: 10068 - DNA, 201 bp, Homo sapiens; identical to SEQ ID NO: 10036

SEQ ID NO: 10069 - DNA, 201 bp, Homo sapiens; identical to SEQ ID NO: 10037

SEQ ID NO: 10070 - DNA, 201 bp, Homo sapiens; identical to SEQ ID NO: 10022

SEQ ID NO: 10071 - DNA, 198 bp, Homo sapiens; identical to SEQ ID NO: 10023

SEQ ID NO: 10072 - DNA, 201 bp, Homo sapiens; identical to SEQ ID NO: 10024

SEQ ID NO: 10073 - DNA, 201 bp, Homo sapiens; identical to SEQ ID NO: 10025

SEQ ID NO: 10074 - DNA, 201 bp, Homo sapiens; identical to SEQ ID NO: 10026

SEQ ID NO: 10075 - DNA, 201 bp, Homo sapiens; identical to SEQ ID NO: 10027

SEQ ID NO: 10076 - DNA, 201 bp, Homo sapiens; identical to SEQ ID NO: 10028

SEQ ID NO: 10077 - DNA, 177 bp, Homo sapiens
agcagagctgcagcggcggccgcgggcaccagagtgccgagcccaggacgcccccggcccaggcccttgggaggagygatgggcagaaccagcacttccctcaggcactagacctgtcacgagtgaacttagttccctcctatactccttcactctaccctaagaacacagatctat

SEQ ID NO: 10078 - DNA, 201 bp, Homo sapiens; identical to SEQ ID NO: 10030

SEQ ID NO: 10079 - DNA, 201 bp, Homo sapiens
caggcccttgggaggagcgatgggcagaaccagcacttccctcaggcactagacctgtcacgagtgaacttagttccctcctatactccttcactctaccmtaagaacacagatctatttgagatgattgagaagatgcagggaagcaggatggatgaacaacgctgctccttcccgccgcccctcaaaacagaggaggac

SEQ ID NO: 10080 - DNA, 201 bp, Homo sapiens; identical to SEQ ID NO: 10032

SEQ ID NO: 10081 - DNA, 201 bp, Homo sapiens; identical to SEQ ID NO: 10033

SEQ ID NO: 10082 - DNA, 201 bp, Homo sapiens; identical to SEQ ID NO: 10034

SEQ ID NO: 10083 - DNA, 201 bp, Homo sapiens; identical to SEQ ID NO: 10035

SEQ ID NO: 10084 - DNA, 201 bp, Homo sapiens; identical to SEQ ID NO: 10036

SEQ ID NO: 10085 - DNA, 201 bp, Homo sapiens; identical to SEQ ID NO: 10037

SEQ ID NO: 10086 - DNA, 201 bp, Homo sapiens; identical to SEQ ID NO: 10022

SEQ ID NO: 10087 - DNA, 201 bp, Homo sapiens
gctcgctgcccgcgggggccagctggcagaacacagatctatttgagatgattgagaagatgcagggaagcaggatggatgaacaacgctgctccttcccrccgcccctcaaaacagaggaggactacattccatacccgagcgtgcacgaggtcttggggcgagaaggacccttccccctcatcctgctgccccagtttg

SEQ ID NO: 10088 - DNA, 201 bp, Homo sapiens; identical to SEQ ID NO: 10026

SEQ ID NO: 10089 - DNA, 201 bp, Homo sapiens; identical to SEQ ID NO: 10024

SEQ ID NO: 10090 - DNA, 198 bp, Homo sapiens; identical to SEQ ID NO: 10023

SEQ ID NO: 10091 - DNA, 201 bp, Homo sapiens; identical to SEQ ID NO: 10027

SEQ ID NO: 10092 - DNA, 179 bp, Homo sapiens
cgcggagctcagcgctgcggggcccggacccgggcgcgcgcgggccaggagccggctgggccagctgaagtgccgcccsggcgggggccgggccgggccgcgctcaggatggcacagctgcggcccgcggtgccacccggccgtccgcggaggggctcgctgcccgcgggggccagctg

SEQ ID NO: 10093 - DNA, 201 bp, Homo sapiens; identical to SEQ ID NO: 10028

SEQ ID NO: 10094 - DNA, 201 bp, Homo sapiens; identical to SEQ ID NO: 10030

SEQ ID NO: 10095 - DNA, 201 bp, Homo sapiens; identical to SEQ ID NO: 10032

SEQ ID NO: 10096 - DNA, 201 bp, Homo sapiens; identical to SEQ ID NO: 10033

SEQ ID NO: 10097 - DNA, 201 bp, Homo sapiens; identical to SEQ ID NO: 10035

SEQ ID NO: 10098 - DNA, 201 bp, Homo sapiens; identical to SEQ ID NO: 10034

SEQ ID NO: 10099 - DNA, 201 bp, Homo sapiens; identical to SEQ ID NO: 10037

SEQ ID NO: 10100 - DNA, 201 bp, Homo sapiens; identical to SEQ ID NO: 10036

SEQ ID NO: 10101 - DNA, 201 bp, Homo sapiens; identical to SEQ ID NO: 10022

SEQ ID NO: 10102 - DNA, 201 bp, Homo sapiens; identical to SEQ ID NO: 10026

SEQ ID NO: 10103 - DNA, 201 bp, Homo sapiens
ccaaccgaggccaccctccctcggacccccattcggaggaagcagacccaagttcgaattctgacattgccactgagcagccgtacaacttttggaggagygatgggcagaaccagcacttccctcaggcactagacctgtcacgagtgaacttagttccctcctatactccttcactctaccctaagaacacagatctat

SEQ ID NO: 10104 - DNA, 201 bp, Homo sapiens; identical to SEQ ID NO: 10033

SEQ ID NO: 10105 - DNA, 200 bp, Homo sapiens
agcagagctgcagcggcggccgcgggcaccagagtgccgagcccaggacgcccccggcccaggcccttggggtttggtgccagctgcggggcgcctgggyttggggaagaaaccttgtgtacgcacacctgcacacacacacagtctccggaggttaatacctctgccaaccgaggccaccctccctcggacccccattc

SEQ ID NO: 10106 - DNA, 201 bp, Homo sapiens; identical to SEQ ID NO: 10034

SEQ ID NO: 10107 - DNA, 201 bp, Homo sapiens; identical to SEQ ID NO: 10035

SEQ ID NO: 10108 - DNA, 201 bp, Homo sapiens; identical to SEQ ID NO: 10037

SEQ ID NO: 10109 - DNA, 201 bp, Homo sapiens; identical to SEQ ID NO: 10036

SEQ ID NO: 10110 - DNA, 201 bp, Homo sapiens; identical to SEQ ID NO: 10025

SEQ ID NO: 10111 - DNA, 201 bp, Homo sapiens; identical to SEQ ID NO: 10024

SEQ ID NO: 10112 - DNA, 198 bp, Homo sapiens; identical to SEQ ID NO: 10023

SEQ ID NO: 10113 - DNA, 201 bp, Homo sapiens; identical to SEQ ID NO: 10027

SEQ ID NO: 10114 - DNA, 201 bp, Homo sapiens; identical to SEQ ID NO: 10028

SEQ ID NO: 10115 - DNA, 201 bp, Homo sapiens; identical to SEQ ID NO: 10030

SEQ ID NO: 10116 - DNA, 201 bp, Homo sapiens
tacaacttttggaggagcgatgggcagaaccagcacttccctcaggcactagacctgtcacgagtgaacttagttccctcctatactccttcactctaccmtaagaacacagatctatttgagatgattgagaagatgcagggaagcaggatggatgaacaacgctgctccttcccgccgcccctcaaaacagaggaggac

SEQ ID NO: 10117 - DNA, 201 bp, Homo sapiens; identical to SEQ ID NO: 10032

SEQ ID NO: 10118 - DNA, 201 bp, Homo sapiens; identical to SEQ ID NO: 10022

SEQ ID NO: 10119 - DNA, 198 bp, Homo sapiens; identical to SEQ ID NO: 10023

SEQ ID NO: 10120 - DNA, 201 bp, Homo sapiens; identical to SEQ ID NO: 10024

SEQ ID NO: 10121 - DNA, 201 bp, Homo sapiens; identical to SEQ ID NO: 10025

SEQ ID NO: 10122 - DNA, 201 bp, Homo sapiens; identical to SEQ ID NO: 10026

SEQ ID NO: 10123 - DNA, 201 bp, Homo sapiens; identical to SEQ ID NO: 10027

SEQ ID NO: 10124 - DNA, 201 bp, Homo sapiens; identical to SEQ ID NO: 10028

SEQ ID NO: 10125 - DNA, 201 bp, Homo sapiens
aggaagcagacccaagttcgaattctgacattgccactgagcagccgtacaacttttgggtggacaagtccttcacttctcgccggagtgtgtggaggagygatgggcagaaccagcacttccctcaggcactagacctgtcacgagtgaacttagttccctcctatactccttcactctaccctaagaacacagatctat

SEQ ID NO: 10126 - DNA, 201 bp, Homo sapiens; identical to SEQ ID NO: 10030

SEQ ID NO: 10127 - DNA, 201 bp, Homo sapiens; identical to SEQ ID NO: 10031

SEQ ID NO: 10128 - DNA, 201 bp, Homo sapiens; identical to SEQ ID NO: 10032

SEQ ID NO: 10129 - DNA, 201 bp, Homo sapiens; identical to SEQ ID NO: 10033

SEQ ID NO: 10130 - DNA, 201 bp, Homo sapiens; identical to SEQ ID NO: 10034

SEQ ID NO: 10131 - DNA, 201 bp, Homo sapiens; identical to SEQ ID NO: 10035

SEQ ID NO: 10132 - DNA, 201 bp, Homo sapiens; identical to SEQ ID NO: 10036

SEQ ID NO: 10133 - DNA, 201 bp, Homo sapiens; identical to SEQ ID NO: 10037

SEQ ID NO: 10134 - DNA, 201 bp, Homo sapiens
gaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcat

SEQ ID NO: 10135 - DNA, 201 bp, Homo sapiens
tacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttc

SEQ ID NO: 10136 - DNA, 119 bp, Homo sapiens
aaatttgctgttctggtattaccaaaccacacatttgtaccgaattggcagtaaatgttagccatttacagcaatgccaaatatggagaaacatcataatwaaaaaatctgctttttca

SEQ ID NO: 10137 - DNA, 201 bp, Homo sapiens
aatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcaccta

SEQ ID NO: 10138 - DNA, 201 bp, Homo sapiens
cgcgactccccccgggcccaaattgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 10139 - DNA, 201 bp, Homo sapiens
caacttggaggatcatgactacgctcaacatgttaggagggcggcaagtgattgcagcagtgaaatgggcaaaggcaataccaggtttcaggaacttacayctggatgaccaaatgaccctactgcagtactcctggatgtttcttatggcatttgctctggggtggagatcatatagacaatcaagtgcaaacctgctgt

SEQ ID NO: 10140 - DNA, 201 bp, Homo sapiens
gggcatgccatgaaggaaagccacgctcccttcagaattcagaggcagggagcaattccagtttcacctaagtctcataattttagttcccttttaaaaaycctgaaaactacatcaccatggaatgaaaaatattgttatacaatacattgatctgtcaaacttccagaaccatggtagccttcagtgagatttccatct

SEQ ID NO: 10141 - DNA, 201 bp, Homo sapiens
agagctaggaaaagccattgtcaagagggaaggaaactccagccagaactggcagcggttttatcaactgacaaaactcttggattctatgcatgaagtgrttgaaaatctccttaactattgcttccaaacatttttggataagaccatgagtattgaattccccgagatgttagctgaaatcatcaccaatcagatacc

SEQ ID NO: 10142 - DNA, 201 bp, Homo sapiens
aaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgat

SEQ ID NO: 10143 - DNA, 201 bp, Homo sapiens
tccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaagcaagagaaactgggcacagtttact

SEQ ID NO: 10144 - DNA, 201 bp, Homo sapiens
ggttttatcaactgacaaaactcttggattctatgcatgaagtggttgaaaatctccttaactattgcttccaaacatttttggataagaccatgagtatkgaattccccgagatgttagctgaaatcatcaccaatcagataccaaaatattcaaatggaaatatcaaaaaacttctgtttcatcaaaagtgactgcctt

SEQ ID NO: 10145 - DNA, 201 bp, Homo sapiens
tctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttca

SEQ ID NO: 10146 - DNA, 201 bp, Homo sapiens
atggagatctggttttgtcaagccccagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacct

SEQ ID NO: 10147 - DNA, 201 bp, Homo sapiens
aatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctagggg

SEQ ID NO: 10148 - DNA, 201 bp, Homo sapiens
agaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaa

SEQ ID NO: 10149 - DNA, 201 bp, Homo sapiens
ttaactattgcttccaaacatttttggataagaccatgagtattgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactat

SEQ ID NO: 10150 - DNA, 201 bp, Homo sapiens
cagatgtaccactatgacatgaatacagcatccctttctcaacagcaggatcagaagcctatttttaatgtcattccaccaattcccgttggttccgaaarttggaataggtgccaaggatctggagatgacaacttgacttctctggggactctgaacttccctggtcgaacagttttttctaatggctattcaagcccc

SEQ ID NO: 10151 - DNA, 201 bp, Homo sapiens
gcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctg

SEQ ID NO: 10152 - DNA, 201 bp, Homo sapiens
ctggaatgaacctggaagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagct

SEQ ID NO: 10153 - DNA, 201 bp, Homo sapiens
taccactatgacatgaatacagcatccctttctcaacagcaggatcagaagcctatttttaatgtcattccaccaattcccgttggttccgaaaattggartaggtgccaaggatctggagatgacaacttgacttctctggggactctgaacttccctggtcgaacagttttttctaatggctattcaagccccagcatg

SEQ ID NO: 10154 - DNA, 201 bp, Homo sapiens
ccacaactcacccctaccctggtgtcactgttggaggttattgaacctgaagtgttatatgcaggatatgatagctctgttccagactcaacttggaggawcatgactacgctcaacatgttaggagggcggcaagtgattgcagcagtgaaatgggcaaaggcaataccaggtttcaggaacttacacctggatgaccaa

SEQ ID NO: 10155 - DNA, 201 bp, Homo sapiens
acatgctgtatgtttcctctgagttacacaggcttcaggtatcttatgaagagtatctctgtatgaaaaccttactgcttctctcttcagttcctaaggayggtctgaagagccaagagctatttgatgaaattagaatgacctacatcaaagagctaggaaaagccattgtcaagagggaaggaaactccagccagaact

SEQ ID NO: 10156 - DNA, 201 bp, Homo sapiens
cgactccccccgggcccaaattgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 10157 - DNA, 201 bp, Homo sapiens; identical to SEQ ID NO: 10134

SEQ ID NO: 10158 - DNA, 201 bp, Homo sapiens; identical to SEQ ID NO: 10135

SEQ ID NO: 10159 - DNA, 119 bp, Homo sapiens; identical to SEQ ID NO: 10136

SEQ ID NO: 10160 - DNA, 201 bp, Homo sapiens; identical to SEQ ID NO: 10137

SEQ ID NO: 10161 - DNA, 201 bp, Homo sapiens
gcgagcggctcctctgccagagttgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 10162 - DNA, 201 bp, Homo sapiens; identical to SEQ ID NO: 10139

SEQ ID NO: 10163 - DNA, 201 bp, Homo sapiens; identical to SEQ ID NO: 10140

SEQ ID NO: 10164 - DNA, 201 bp, Homo sapiens; identical to SEQ ID NO: 10141

SEQ ID NO: 10165 - DNA, 201 bp, Homo sapiens; identical to SEQ ID NO: 10142

SEQ ID NO: 10166 - DNA, 201 bp, Homo sapiens; identical to SEQ ID NO: 10143

SEQ ID NO: 10167 - DNA, 201 bp, Homo sapiens; identical to SEQ ID NO: 10144

SEQ ID NO: 10168 - DNA, 201 bp, Homo sapiens; identical to SEQ ID NO: 10145

SEQ ID NO: 10169 - DNA, 201 bp, Homo sapiens; identical to SEQ ID NO: 10146

SEQ ID NO: 10170 - DNA, 201 bp, Homo sapiens; identical to SEQ ID NO: 10147

SEQ ID NO: 10171 - DNA, 201 bp, Homo sapiens; identical to SEQ ID NO: 10148

SEQ ID NO: 10172 - DNA, 201 bp, Homo sapiens; identical to SEQ ID NO: 10149

SEQ ID NO: 10173 - DNA, 201 bp, Homo sapiens; identical to SEQ ID NO: 10150

SEQ ID NO: 10174 - DNA, 201 bp, Homo sapiens; identical to SEQ ID NO: 10151

SEQ ID NO: 10175 - DNA, 201 bp, Homo sapiens; identical to SEQ ID NO: 10152

SEQ ID NO: 10176 - DNA, 201 bp, Homo sapiens; identical to SEQ ID NO: 10153

SEQ ID NO: 10177 - DNA, 201 bp, Homo sapiens; identical to SEQ ID NO: 10154

SEQ ID NO: 10178 - DNA, 201 bp, Homo sapiens; identical to SEQ ID NO: 10155

SEQ ID NO: 10179 - DNA, 201 bp, Homo sapiens
gagcggctcctctgccagagttgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 10180 - DNA, 201 bp, Homo sapiens
aagacctggacgcctgtgagacaggcactgtgcgggccaggtatacctttgggaaacctgtggctggtgccttaacgatcaacatgactgttaatggtgtrgggtactacagccacgaggtgggacgccctgtcctcagaacaaccaagatcctcggctcccgggacttcgacatctgcgtgagggacatgatcccagcgg

SEQ ID NO: 10181 - DNA, 201 bp, Homo sapiens
ctgaaccaccggcaggacggtggcctctacaccgatgaggctgtccccgctttccagccccacacagggagcctggtggcagtggctccttccaggcaccmccccagaacagagaagagaaaaaggactttcttccccgaaacatggatttggcattgtctcaacatcagtgacccatctggtgaggggacactcagtgtg

SEQ ID NO: 10182 - DNA, 201 bp, Homo sapiens
agtccacatgtccctgcaactttaccctgtactacgaggtggctgcacggggcaatattgtgctatcgggccagcagcctgcccacaccacccagcagcgmagcaagcgggcggcccctgccctggagaaaccgattcgtttaacacacctttctgagacagagcccccaccagccccagaagctgaggtcgacgtgtgtg

SEQ ID NO: 10183 - DNA, 201 bp, Homo sapiens
ccaagatcctcggctcccgggacttcgacatctgcgtgagggacatgatcccagcggacgtccctgagcacttccggggcagggtcagcatctgggccatrgtgaccagtgtggacgggagccagcaggtcgcgttcgatgactccacccccgtgcagaggcagctggtggacatccggtactccaaggacacgaggaagc

SEQ ID NO: 10184 - DNA, 201 bp, Homo sapiens
caagatcctcggctcccgggacttcgacatctgcgtgagggacatgatcccagcggacgtccctgagcacttccggggcagggtcagcatctgggccatartgaccagtgtggacgggagccagcaggtcgcgttcgatgactccacccccgtgcagaggcagctggtggacatccggtactccaaggacacgaggaagca

SEQ ID NO: 10185 - DNA, 201 bp, Homo sapiens
gtactacagccacgaggtgggacgccctgtcctcagaacaaccaagatcctcggctcccgggacttcgacatctgcgtgagggacatgatcccagcggacrtccctgagcacttccggggcagggtcagcatctgggccatagtgaccagtgtggacgggagccagcaggtcgcgttcgatgactccacccccgtgcagag

SEQ ID NO: 10186 - DNA, 201 bp, Homo sapiens
tagggtactacagccacgaggtgggacgccctgtcctcagaacaaccaagatcctcggctcccgggacttcgacatctgcgtgagggacatgatcccagcrgacgtccctgagcacttccggggcagggtcagcatctgggccatagtgaccagtgtggacgggagccagcaggtcgcgttcgatgactccacccccgtgc

SEQ ID NO: 10187 - DNA, 201 bp, Homo sapiens
ccacgggcctccggggccaagcgcttctgaaagtgtggggccgcggctggcaggcggaggaggggcccctctttcacaaccagacctcggtgaccgtggayggccggggcgcttctgtattcatccagacggacaagcctgtgtacagaccccagcaccgagtgctcataagcatcttcaccgtctctccaaatctgaggc

SEQ ID NO: 10188 - DNA, 201 bp, Homo sapiens
accctgaggagaatcacgccgacaggagggtccccatcggggtggatcacgtcaggcgcagtgtgatggttgaggcggaaggagtcccccgggcgtacacstacagcgcattcttctgtcccagtgagagagtccacatctccacccccaacaagtatgagttccagtatgtgcagcggccactgcgcctcacccgctttg

SEQ ID NO: 10189 - DNA, 201 bp, Homo sapiens
ggctggtgccttaacgatcaacatgactgttaatggtgtagggtactacagccacgaggtgggacgccctgtcctcagaacaaccaagatcctcggctccygggacttcgacatctgcgtgagggacatgatcccagcggacgtccctgagcacttccggggcagggtcagcatctgggccatagtgaccagtgtggacgg

SEQ ID NO: 10190 - DNA, 201 bp, Homo sapiens
gctgcgaccacgactgcggcgcccaggggaacccggtgtgcggctccgacggggtggtctacgccagcgcctgccgcctgcgggaggccgcctgccgccargccgcgcccctggagcccgcgcctcccagctgctgcgccctcgagcagcggctgccggcctcgtcgtcctccacctacggggatgacctggcttctgtgg

SEQ ID NO: 10191 - DNA, 201 bp, Homo sapiens
ccgaccagcctgtgttgggagaatggttcatttttgttgaaatgcaaggccacgcgtacaacaagtcttttgaagttcagaagtatgtgttgcccaagttygagcttctgattgacccgccccggtatatccaagacctggacgcctgtgagacaggcactgtgcgggccaggtatacctttgggaaacctgtggctggtg

SEQ ID NO: 10192 - DNA, 201 bp, Homo sapiens
ccccagcaccgagtgctcataagcatcttcaccgtctctccaaatctgaggcctgtcaacgagaagctggaagcctacatcctggacccccgaggctctcrgatgatagagtggagacacttaaagccgttctgctgcggcatcaccaacatgagcttccccttgtccgaccagcctgtgttgggagaatggttcattttt

SEQ ID NO: 10193 - DNA, 201 bp, Homo sapiens
cttaacgatcaacatgactgttaatggtgtagggtactacagccacgaggtgggacgccctgtcctcagaacaaccaagatcctcggctcccgggacttcracatctgcgtgagggacatgatcccagcggacgtccctgagcacttccggggcagggtcagcatctgggccatagtgaccagtgtggacgggagccagca

SEQ ID NO: 10194 - DNA, 201 bp, Homo sapiens
gtcacagccgggcctcggcctcctgtgagcagcgggaacctggaaagcagcacccagagcgccagcccgttccacagatggggccagactccggcccctcrgagacatagtggccgggtggtgggggcccacaggccagggcttctgagccctgtcttcgtctacagcccagcctttcagagtggtggggaggagggttta

SEQ ID NO: 10195 - DNA, 132 bp, Homo sapiens
cagtttggtcctggggaccattcatacccacacacccagcttgtgcctgtggttaacatctcagaaaactctggtaaatgatcactccaggatattgacamgaatacacgttactgatcttactcacatgtt

SEQ ID NO: 10196 - DNA, 201 bp, Homo sapiens
gccgccaagagctggatcatccagcagcagcaggccgatggctccttcctggccgtgggcagggtcctgaacaaggacatccagggtgggatccacggcaytgtcccgctgacagcctacgtggtggttgctctcctggaaacaggcacagcctcagaggaggagagaggctccactgacaaagcgaggcacttcctggag

SEQ ID NO: 10197 - DNA, 201 bp, Homo sapiens
cacaacgacgccggcgctcctctgtcttcccgtggccttggggcatcaccaaggactctgggtttgccttcaccgaaacgggactggtggtgatgaccgamcgagtgagcctgaaccaccggcaggacggtggcctctacaccgatgaggctgtccccgctttccagccccacacagggagcctggtggcagtggctcctt

SEQ ID NO: 10198 - DNA, 201 bp, Homo sapiens
tccgggagtgcgtggtgggcaggacgtcggcgctgccagtctccgtgtacgactactacgaacccgccttcgaggccactcgcttctacaacgtcagcacscacagcccactcgcccgggaactgtgcgccggacccgcgtgcaacgaagtggagcgcgcccctgcccggggcccgggctggttccccggcgagtcgggcc

SEQ ID NO: 10199 - DNA, 201 bp, Homo sapiens
ccatccaatgagtctgtcattgtggcctggaccctcccgaggccaccagaggtccagttcattggcttttccaccggctggggctccatgggtgaattccraatctggaggaagatggaggtggacgagagctacagcgaggccttcaccctgggggtcccacacggcgccatccctgggtctgagcgagccaccgcctcc

SEQ ID NO: 10200 - DNA, 201 bp, Homo sapiens
ctgattgacccgccccggtatatccaagacctggacgcctgtgagacaggcactgtgcgggccaggtatacctttgggaaacctgtggctggtgccttaaygatcaacatgactgttaatggtgtagggtactacagccacgaggtgggacgccctgtcctcagaacaaccaagatcctcggctcccgggacttcgacatc

SEQ ID NO: 10201 - DNA, 201 bp, Homo sapiens
ggaggtccagcaaacaccctgaggagaatcacgccgacaggagggtccccatcggggtggatcacgtcaggcgcagtgtgatggttgaggcggaaggagtyccccgggcgtacacctacagcgcattcttctgtcccagtgagagagtccacatctccacccccaacaagtatgagttccagtatgtgcagcggccactgc

SEQ ID NO: 10202 - DNA, 201 bp, Homo sapiens
tgtcccagcgtggactagtggggtttgaaatcccctccatccccacgtcagcccagcacgtgtggctggagaccaaggtgatggcactgaacgggaagccygtgggggctcagtacctgcccagctacctctccctcggcagctggtactcccccagccagtgctacctgcagctgcagccaccctcccacccactgcagg

SEQ ID NO: 10203 - DNA, 201 bp, Homo sapiens
tcccagcgtggactagtggggtttgaaatcccctccatccccacgtcagcccagcacgtgtggctggagaccaaggtgatggcactgaacgggaagcccgwgggggctcagtacctgcccagctacctctccctcggcagctggtactcccccagccagtgctacctgcagctgcagccaccctcccacccactgcaggtt

SEQ ID NO: 10204 - DNA, 201 bp, Homo sapiens
gcccctgccctggagaaaccgattcgtttaacacacctttctgagacagagcccccaccagccccagaagctgaggtcgacgtgtgtgtgacctctcttcrtctggccgtgacccccagcatggtcccccttggtcgcctgctggtcttctacgtcagggagaatggagaaggggtcgccgacagccttcagtttgcagtc

SEQ ID NO: 10205 - DNA, 201 bp, Homo sapiens
cctgcaactttaccctgtactacgaggtggctgcacggggcaatattgtgctatcgggccagcagcctgcccacaccacccagcagcgaagcaagcgggcrgcccctgccctggagaaaccgattcgtttaacacacctttctgagacagagcccccaccagccccagaagctgaggtcgacgtgtgtgtgacctctcttc

SEQ ID NO: 10206 - DNA, 201 bp, Homo sapiens
gccgggatgggaggtccagcaaacaccctgaggagaatcacgccgacaggagggtccccatcggggtggatcacgtcaggcgcagtgtgatggttgaggcrgaaggagtcccccgggcgtacacctacagcgcattcttctgtcccagtgagagagtccacatctccacccccaacaagtatgagttccagtatgtgcagc

SEQ ID NO: 10207 - DNA, 201 bp, Homo sapiens
tatttttctgtgaagtccacatgtccctgcaactttaccctgtactacgaggtggctgcacggggcaatattgtgctatcgggccagcagcctgcccacaycacccagcagcgaagcaagcgggcggcccctgccctggagaaaccgattcgtttaacacacctttctgagacagagcccccaccagccccagaagctgag

SEQ ID NO: 10208 - DNA, 201 bp, Homo sapiens
cttcaagcccttcttcgtggacttcatgctccccgctctcatcatccgtggggagcaggtcaagatcccgctcagtgtctacaactacatgggcacctgcrctgaggtgtacatgaagctctcggttcccaagggcatccagtttgttgggcatcctggcaaacgccatgtgaccaagaagatgtgtgtggcccccgggga

SEQ ID NO: 10209 - DNA, 201 bp, Homo sapiens
catcggggacgtcatggggccaaccctgaaccacctcaacaacctcctgcggctgccgtttggctgtggagagcagaacatgatccactttgcacccaacrtctttgtcttgaagtatcttcagaaaacccagcagctcagccctgaggtggagagagagaccaccgactacctagtacaaggctaccagcgccagctgac

SEQ ID NO: 10210 - DNA, 201 bp, Homo sapiens
ctgcgtgagggacatgatcccagcggacgtccctgagcacttccggggcagggtcagcatctgggccatagtgaccagtgtggacgggagccagcaggtcrcgttcgatgactccacccccgtgcagaggcagctggtggacatccggtactccaaggacacgaggaagcagttcaagccgggcctggcctacgtggggaa

SEQ ID NO: 10211 - DNA, 201 bp, Homo sapiens
gggcttaggcatcgccgagccctccctgctgaagaccttcaagcccttcttcgtggacttcatgctccccgctctcatcatccgtggggagcaggtcaagrtcccgctcagtgtctacaactacatgggcacctgcgctgaggtgtacatgaagctctcggttcccaagggcatccagtttgttgggcatcctggcaaacg

SEQ ID NO: 10212 - DNA, 201 bp, Homo sapiens
agcagcgaagcaagcgggcggcccctgccctggagaaaccgattcgtttaacacacctttctgagacagagcccccaccagccccagaagctgaggtcgamgtgtgtgtgacctctcttcatctggccgtgacccccagcatggtcccccttggtcgcctgctggtcttctacgtcagggagaatggagaaggggtcgccg

SEQ ID NO: 10213 - DNA, 201 bp, Homo sapiens
gctggtgccttaacgatcaacatgactgttaatggtgtagggtactacagccacgaggtgggacgccctgtcctcagaacaaccaagatcctcggctcccrggacttcgacatctgcgtgagggacatgatcccagcggacgtccctgagcacttccggggcagggtcagcatctgggccatagtgaccagtgtggacggg

SEQ ID NO: 10214 - DNA, 201 bp, Homo sapiens
ggctgcgaccacgactgcggcgcccaggggaacccggtgtgcggctccgacggggtggtctacgccagcgcctgccgcctgcgggaggccgcctgccgccmggccgcgcccctggagcccgcgcctcccagctgctgcgccctcgagcagcggctgccggcctcgtcgtcctccacctacggggatgacctggcttctgtg

SEQ ID NO: 10215 - DNA, 201 bp, Homo sapiens; identical to SEQ ID NO: 10180

SEQ ID NO: 10216 - DNA, 201 bp, Homo sapiens; identical to SEQ ID NO: 10181

SEQ ID NO: 10217 - DNA, 201 bp, Homo sapiens; identical to SEQ ID NO: 10182

SEQ ID NO: 10218 - DNA, 201 bp, Homo sapiens; identical to SEQ ID NO: 10183

SEQ ID NO: 10219 - DNA, 201 bp, Homo sapiens; identical to SEQ ID NO: 10184

SEQ ID NO: 10220 - DNA, 201 bp, Homo sapiens; identical to SEQ ID NO: 10185

SEQ ID NO: 10221 - DNA, 201 bp, Homo sapiens; identical to SEQ ID NO: 10186

SEQ ID NO: 10222 - DNA, 201 bp, Homo sapiens; identical to SEQ ID NO: 10187

SEQ ID NO: 10223 - DNA, 201 bp, Homo sapiens; identical to SEQ ID NO: 10188

SEQ ID NO: 10224 - DNA, 201 bp, Homo sapiens; identical to SEQ ID NO: 10189

SEQ ID NO: 10225 - DNA, 201 bp, Homo sapiens; identical to SEQ ID NO: 10190

SEQ ID NO: 10226 - DNA, 201 bp, Homo sapiens; identical to SEQ ID NO: 10191

SEQ ID NO: 10227 - DNA, 201 bp, Homo sapiens
ccagcaccgagtgctcataagcatcttcaccgtctctccaaatctgaggcctgtcaacgagaaggtgagatcagccaccaacaggacccccgaggctctcrgatgatagagtggagacacttaaagccgttctgctgcggcatcaccaacatgagcttccccttgtccgaccagcctgtgttgggagaatggttcattttt

SEQ ID NO: 10228 - DNA, 201 bp, Homo sapiens; identical to SEQ ID NO: 10193

SEQ ID NO: 10229 - DNA, 201 bp, Homo sapiens; identical to SEQ ID NO: 10194

SEQ ID NO: 10230 - DNA, 132 bp, Homo sapiens; identical to SEQ ID NO: 10195

SEQ ID NO: 10231 - DNA, 201 bp, Homo sapiens; identical to SEQ ID NO: 10196

SEQ ID NO: 10232 - DNA, 201 bp, Homo sapiens; identical to SEQ ID NO: 10197

SEQ ID NO: 10233 - DNA, 201 bp, Homo sapiens; identical to SEQ ID NO: 10198

SEQ ID NO: 10234 - DNA, 201 bp, Homo sapiens; identical to SEQ ID NO: 10199

SEQ ID NO: 10235 - DNA, 201 bp, Homo sapiens; identical to SEQ ID NO: 10200

SEQ ID NO: 10236 - DNA, 201 bp, Homo sapiens; identical to SEQ ID NO: 10201

SEQ ID NO: 10237 - DNA, 201 bp, Homo sapiens; identical to SEQ ID NO: 10202

SEQ ID NO: 10238 - DNA, 201 bp, Homo sapiens; identical to SEQ ID NO: 10203

SEQ ID NO: 10239 - DNA, 201 bp, Homo sapiens; identical to SEQ ID NO: 10204

SEQ ID NO: 10240 - DNA, 201 bp, Homo sapiens; identical to SEQ ID NO: 10205

SEQ ID NO: 10241 - DNA, 201 bp, Homo sapiens; identical to SEQ ID NO: 10206

SEQ ID NO: 10242 - DNA, 201 bp, Homo sapiens; identical to SEQ ID NO: 10207

SEQ ID NO: 10243 - DNA, 201 bp, Homo sapiens; identical to SEQ ID NO: 10208

SEQ ID NO: 10244 - DNA, 201 bp, Homo sapiens; identical to SEQ ID NO: 10209

SEQ ID NO: 10245 - DNA, 201 bp, Homo sapiens; identical to SEQ ID NO: 10210

SEQ ID NO: 10246 - DNA, 201 bp, Homo sapiens; identical to SEQ ID NO: 10211

SEQ ID NO: 10247 - DNA, 201 bp, Homo sapiens; identical to SEQ ID NO: 10212

SEQ ID NO: 10248 - DNA, 201 bp, Homo sapiens; identical to SEQ ID NO: 10213

SEQ ID NO: 10249 - DNA, 201 bp, Homo sapiens; identical to SEQ ID NO: 10214

SEQ ID NO: 10250 - DNA, 201 bp, Homo sapiens
cagaccctgagcctgaaggggaggcggaggacagtcagagcggcttctcttcctaacggctgccctgctgagagcaggacgacaccatctggctgcatccygtccctatcagcctgtgactctgtatggtgggtgggcagacctcagcccaggtgacacctgcctctaaatgaacccaaggaacagaatgacagagatctg

SEQ ID NO: 10251 - DNA, 201 bp, Homo sapiens; identical to SEQ ID NO: 10194

SEQ ID NO: 10252 - DNA, 201 bp, Homo sapiens
ctttgtgacccctggcacctgcttatgtctgcatttgcccatcttctccggggtggtatttatttcagccaacaccgctcagccctgatctctgccagcayggaggcccctcgctgcctgtgagatcaaggtctgaggctgccctggccggtgggttccccacccctggcaccctacaagcgacaggccctgtggctcctt

SEQ ID NO: 10253 - DNA, 201 bp, Homo sapiens; identical to SEQ ID NO: 10198

SEQ ID NO: 10254 - DNA, 201 bp, Homo sapiens; identical to SEQ ID NO: 10190

SEQ ID NO: 10255 - DNA, 201 bp, Homo sapiens
tgacacctgcctctaaatgaacccaaggaacagaatgacagagatctgcccgtccctaggatgagactcttgggacccaggtgtgggctcagcagtcaccrgtgtggtgcaggggggacagctggaggtcccttgggagatcccccaccttcctagctacagctggagctccaagcaccccaaccccccagccttggagct

SEQ ID NO: 10256 - DNA, 201 bp, Homo sapiens; identical to SEQ ID NO: 10214

SEQ ID NO: 10257 - DNA, 201 bp, Homo sapiens
ggagaagaaacattcccagaaagcactcgtgtggccaaaagcctctttctgagcaaacacgatgtggactaaattagcaaaacatccagccggtgggcaayttcaaaacggaacaggctgcgtttctctgaaacacaaagccccggcctccctttggggcacccaggaccccaaattgccctaagactgtcccagctctcg

SEQ ID NO: 10258 - DNA, 201 bp, Homo sapiens
gtgacagccagagaatgcccactgcctgtaacagccacctggagaacttcataaagatgtctcacagccctggggacacctgcccagtgggccccagcccyacagggactgggcaaagatgatgtttccagattacactccagcctgagtcagcacccctcctagcaacctgccttgggacttagaacaccgccgccccct

SEQ ID NO: 10259 - DNA, 201 bp, Homo sapiens
ggtccaggagctgctgccctcctcctttgggcctgaggacctgcagaagacccagtgacagccagagaatgcccactgcctgtaacagccacctggagaayttcataaagatgtctcacagccctggggacacctgcccagtgggccccagccctacagggactgggcaaagatgatgtttccagattacactccagcctg

SEQ ID NO: 10260 - DNA, 201 bp, Homo sapiens
actggcccgtgtacatgaccaagccggatggtacgtatattgtcatgacggtccaggagctgctgccctcctcctttgggcctgaggacctgcagaagacycagtgacagccagagaatgcccactgcctgtaacagccacctggagaacttcataaagatgtctcacagccctggggacacctgcccagtgggccccagc

SEQ ID NO: 10261 - DNA, 178 bp, Homo sapiens
gaggctcctctcctagaccctgcatcctgaaagctgcgtacctgagagcctgcggtctggctgcagggacacacccarggggaggagctgcaatcgtgtctggggccccagcccaggctggccggagctcctgtttccgctgctctgctgcctgcccggggtaccaacatggcccaga

SEQ ID NO: 10262 - DNA, 201 bp, Homo sapiens
gctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaagggtgcaacatagaaaatgcctgcta

SEQ ID NO: 10263 - DNA, 154 bp, Homo sapiens
gaggctcctctcctagaccctgcatcctgaaagctgcgtacctgagagcctgckgtctggctgcagggacacacccaaggggaggagctgcaatcgtgtctggggccccagcccaggctggccggagctcctgtttccgctgctctgctgcctg

SEQ ID NO: 10264 - DNA, 201 bp, Homo sapiens
cagaagacccagtgacagccagagaatgcccactgcctgtaacagccacctggagaacttcataaagatgtctcacagccctggggacacctgcccagtgsgccccagccctacagggactgggcaaagatgatgtttccagattacactccagcctgagtcagcacccctcctagcaacctgccttgggacttagaacac

SEQ ID NO: 10265 - DNA, 182 bp, Homo sapiens
gaggctcctctcctagaccctgcatcctgaaagctgcgtacctgagagcctgcggtctggctgcagggacacacccaagggraggagctgcaatcgtgtctggggccccagcccaggctggccggagctcctgtttccgctgctctgctgcctgcccggggtaccaacatggcccagaagcg

SEQ ID NO: 10266 - DNA, 201 bp, Homo sapiens
cagcctactgcccctacagtcactttcctgtgggggctgccctgctcacccaggaggggagaatcttcaaagggtgcaacatagaaaatgcctgctacccrctgggcatctgtgctgaacggaccgctatccagaaggccgtctcagaagggtacaaggatttcagggcaattgctatcgccagtgacatgcaagatgatt

SEQ ID NO: 10267 - DNA, 201 bp, Homo sapiens; identical to SEQ ID NO: 10258

SEQ ID NO: 10268 - DNA, 201 bp, Homo sapiens; identical to SEQ ID NO: 10259

SEQ ID NO: 10269 - DNA, 201 bp, Homo sapiens; identical to SEQ ID NO: 10260

SEQ ID NO: 10270 - DNA, 178 bp, Homo sapiens; identical to SEQ ID NO: 10261

SEQ ID NO: 10271 - DNA, 201 bp, Homo sapiens; identical to SEQ ID NO: 10262

SEQ ID NO: 10272 - DNA, 154 bp, Homo sapiens; identical to SEQ ID NO: 10263

SEQ ID NO: 10273 - DNA, 201 bp, Homo sapiens; identical to SEQ ID NO: 10264

SEQ ID NO: 10274 - DNA, 182 bp, Homo sapiens; identical to SEQ ID NO: 10265

SEQ ID NO: 10275 - DNA, 201 bp, Homo sapiens
cagcctactgcccctacagtcactttcctgtgggggctgccctgctcacccaggaggggagaatcttcaaagggtgcaacatagaaaatgcctgctacccrctgggcatctgtgctgaacggaccgctatccagaaggccgtctcagaagggtacaaggatttcagggcaattgctatcgccagtttggcaccaactggcc

SEQ ID NO: 10276 - DNA, 201 bp, Homo sapiens
ggttaccagcactgtggaaaagataaaaatatatactctggaagagcatgatgttttatctgtttgggttgaaaagcacgtgggaagtccagcacatttgrcttatcgtctcttgtctgactttacaaagcgacctttgtgggacccccattttgtgtcctgtgaagtcatagactgggtgagtgaagatgatcagctgta

SEQ ID NO: 10277 - DNA, 201 bp, Homo sapiens
tttaatttcagcctggagtgttgaagttggagttcgcgtggaggcctttgactgtcaggaatgggccgagggccgagggcgtcacatcaacagtgcttttstcatttacaatgctgctgatgataaggaaaatctcatcacgtttcccagaatccaacccatttcaaaggatgatttcagacgctatcggggagctattgc

SEQ ID NO: 10278 - DNA, 201 bp, Homo sapiens
gatttggattagcattaaaagagctttagaattctgttgtaagtcatctgtggctctgcctcttccaggggcacagatagtggaaaattgcctgtatgcartactatgtgttctataaaatggcatgaatttagtttaaattatcgtaaacatttttaggttacagaggtgaaacatgcattctgtgtgaaattccaaaaa

SEQ ID NO: 10279 - DNA, 201 bp, Homo sapiens
gctagagttggacaagttataaccatcaaagcaaaagttactagagcattcagcacaagcatggagccgcctgtgttgggctcatccctttctgaagtccrtagatatgtttaagttccggggaccatctacagttggagatcgtcttgtcttcactgccattgtcaacaatacatttcagacctggtaaagtgagccctt

SEQ ID NO: 10280 - DNA, 201 bp, Homo sapiens; identical to SEQ ID NO: 10276

SEQ ID NO: 10281 - DNA, 201 bp, Homo sapiens
caatacatttcagacctgtgttgaagttggagttcgcgtggaggcctttgactgtcaggaatgggccgagggccgagggcgtcacatcaacagtgcttttstcatttacaatgctgctgatgataaggaaaatctcatcacgtttcccagaatccaacccatttcaaaggatgatttcagacgctatcggggagctattgc

SEQ ID NO: 10282 - DNA, 201 bp, Homo sapiens; identical to SEQ ID NO: 10278

SEQ ID NO: 10283 - DNA, 201 bp, Homo sapiens
tcacggaaatacatttggtggccagattatggcgtggatggagacagtggctactatttctgcaagccgcctgtgttgggctcatccctttctgaagtccrtagatatgtttaagttccggggaccatctacagttggagatcgtcttgtcttcactgccattgtcaacaatacatttcagacctgtgttgaagttggagt

SEQ ID NO: 10284 - DNA, 201 bp, Homo sapiens
gaaaataaggaagtattacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattagtaagttcaaaggt

SEQ ID NO: 10285 - DNA, 201 bp, Homo sapiens
agaaacacacaattttggactgaatttcctacaaaccattaaggggaaaatagtatcgaagcagaaattagagctgaagacaaccgaagcaggcccaagaytgatgtctggaaagcaggctgcagccataatcaaagcagttgattcaaagtacacggccattcccattgtggggcaggtcttccagagccagtgtaaagg

SEQ ID NO: 10286 - DNA, 201 bp, Homo sapiens
aaagagttctactcatatcaaaatgaggcagtggccatagaaaatatcaagagaggcctggctagcctatttcagacacagttaagctctggaaccaccartgaggtagatatctctggaaattgtaaagtgacctaccaggctcatcaagacaaagtgatcaaaattaaggccttggattcatgcaaaatagcgaggtct

SEQ ID NO: 10287 - DNA, 201 bp, Homo sapiens
ctctgcaaagacctacgctccttcatctaatccatggaaaggtcaaagagttctactcatatcaaaatgaggcagtggccatagaaaatatcaagagaggyctggctagcctatttcagacacagttaagctctggaaccaccaatgaggtagatatctctggaaattgtaaagtgacctaccaggctcatcaagacaaag

SEQ ID NO: 10288 - DNA, 201 bp, Homo sapiens
gttccctaatcaggaaaaaaaaaaaaaaaaaaagtaagacacaaacaaaccattttttttctctttttttggagttgggggcccagggagaagggacaagrcttttaaaagacttgttagccaacttcaagaattaatatttatgtctctgttattgttagttttaagccttaaggtagaaggcacatagaaataacatct

SEQ ID NO: 10289 - DNA, 201 bp, Homo sapiens
aaaatgtttttatttgtatgaattaaaagatccatgttgaacatttgcaaatatttattaataaacagatgtggtgataaacccaaaacaaatgacaggtscttattttccactaaacacagacacatgaaatgaaagtttagctagcccactatttgttgtaaattgaaaacgaagtgtgataaaataaatatgtagaaa

SEQ ID NO: 10290 - DNA, 201 bp, Homo sapiens
aggcagtggccatagaaaatatcaagagaggcctggctagcctatttcagacacagttaagctctggaaccaccaatgaggtagatatctctggaaattgyaaagtgacctaccaggctcatcaagacaaagtgatcaaaattaaggccttggattcatgcaaaatagcgaggtctggatttacgaccccaaatcaggtct

SEQ ID NO: 10291 - DNA, 201 bp, Homo sapiens
gcccaagattgatgtctggaaagcaggctgcagccataatcaaagcagttgattcaaagtacacggccattcccattgtggggcaggtcttccagagccastgtaaaggatgtccttctctctcggagctctggcggtccaccaggaaatacctgcagcctgacaacctttccaaggctgaggctgtcagaaacttcctgg

SEQ ID NO: 10292 - DNA, 201 bp, Homo sapiens
aagcagttgattcaaagtacacggccattcccattgtggggcaggtcttccagagccagtgtaaaggatgtccttctctctcggagctctggcggtccacmaggaaatacctgcagcctgacaacctttccaaggctgaggctgtcagaaacttcctggccttcattcagcacctcaggactgcgaagaaagaagagatcc

SEQ ID NO: 10293 - DNA, 201 bp, Homo sapiens
agagtccacttctcagtgactcctagctgggcactggatgcagttgaggattgctggtcaatatgattcttcttgctgtgctttttctctgcttcatttcstcatattcagcttctgttaaaggtcacacaactggtctctcattaaataatgaccggctgtacaagctcacgtactccactgaagttcttcttgatcggg

SEQ ID NO: 10294 - DNA, 201 bp, Homo sapiens
gtgtctttttgagactgtaatatggtacactgtcctctaagggacatcctcattttatctcacctttttgggggtgagagctctagttcatttaactgtamtctgcacaatagctaggatgactaagagaacattgcttcaagaaactggtggatttggatttccaaaatatgaaataaggaaaaaaatgtttttatttgt

SEQ ID NO: 10295 - DNA, 201 bp, Homo sapiens
agcaggcttggagtttatctccacagtgcagttttctcagtacccattcttagtttgcatgcagatggacaaggatgaagctccattcaggcaatttgagwaaaagtacgaaaggctgtccacaggcagaggttatgtctctcagaaaagaaaagaaagcgtattagcaggatgtgaattcccgctccatcaagagaactc

SEQ ID NO: 10296 - DNA, 201 bp, Homo sapiens
tggccttactatggaggaatcctgatggtgatgatgaccagttgatccaaataacgatgaaggatgtaaatgttgaaaatgtgaatcagcagagaggagasaagagcatcttcaaaggaaaaagcccatctaaaataatgggaaaggaaaacttggaagctctgcaaagacctacgctccttcatctaatccatggaaagg

SEQ ID NO: 10297 - DNA, 201 bp, Homo sapiens
gctctccagagatatgatctccctttcataactgatgaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaa

SEQ ID NO: 10298 - DNA, 201 bp, Homo sapiens
acgtggatgtggccttactatggaggaatcctgatggtgatgatgaccagttgatccaaataacgatgaaggatgtaaatgttgaaaatgtgaatcagcasagaggagagaagagcatcttcaaaggaaaaagcccatctaaaataatgggaaaggaaaacttggaagctctgcaaagacctacgctccttcatctaatcc

SEQ ID NO: 10299 - DNA, 201 bp, Homo sapiens
tggggcaggtcttccagagccagtgtaaaggatgtccttctctctcggagctctggcggtccaccaggaaatacctgcagcctgacaacctttccaaggcygaggctgtcagaaacttcctggccttcattcagcacctcaggactgcgaagaaagaagagatccttcaaatactaaagatggaaaataaggaagtattac

SEQ ID NO: 10300 - DNA, 201 bp, Homo sapiens
ccatctaaaataatgggaaaggaaaacttggaagctctgcaaagacctacgctccttcatctaatccatggaaaggtcaaagagttctactcatatcaaartgaggcagtggccatagaaaatatcaagagaggcctggctagcctatttcagacacagttaagctctggaaccaccaatgaggtagatatctctggaaat

SEQ ID NO: 10301 - DNA, 201 bp, Homo sapiens
caaggatgaagctccattcaggcaatttgagaaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacc

SEQ ID NO: 10302 - DNA, 201 bp, Homo sapiens
gttcaaaggttctattggtagcagtgacatcagagaaactgttatgatcatcactgggacacttgtcagaaagttgtgtcagaatgaaggctgcaaactcwaagcagtagtggaagctaagaagttaatcctgggaggacttgaaaaagcagagaaaaaagaggacaccaggatgtatctgctggctttgaagaatgccct

SEQ ID NO: 10303 - DNA, 201 bp, Homo sapiens
gtcaagaacatcctgctgtctattggggagcttccccaagaaatgaataaatacatgctcgccattgttcaagacatcctacgttttgaaatgcctgcaakcaaaattgtccgtcgagttctgaaggaaatggtcgctcacaattatgaccgtttctccaggagtggatcttcttctgcctacactggctacatagaacgt

SEQ ID NO: 10304 - DNA, 201 bp, Homo sapiens
actaaaagccaatatagaggtccagggtggtctagctattgatatttcaggtgcaatggagtttagcttgtggtatcgtgagtctaaaacccgagtgaaawatagggtgactgtggtaataaccactgacatcacagtggactcctcttttgtgaaagctggcctggaaaccagtacagaaacagaagcaggcttggagtt

SEQ ID NO: 10305 - DNA, 201 bp, Homo sapiens
cagagaggagagaagagcatcttcaaaggaaaaagcccatctaaaataatgggaaaggaaaacttggaagctctgcaaagacctacgctccttcatctaayccatggaaaggtcaaagagttctactcatatcaaaatgaggcagtggccatagaaaatatcaagagaggcctggctagcctatttcagacacagttaagc

SEQ ID NO: 10306 - DNA, 201 bp, Homo sapiens
gttctactcatatcaaaatgaggcagtggccatagaaaatatcaagagaggcctggctagcctatttcagacacagttaagctctggaaccaccaatgagrtagatatctctggaaattgtaaagtgacctaccaggctcatcaagacaaagtgatcaaaattaaggccttggattcatgcaaaatagcgaggtctggatt

SEQ ID NO: 10307 - DNA, 201 bp, Homo sapiens
cgaagtatgtcaagcattgatagtttcattagctgtgccacagacttccctgaggccaccagattctcccacagccctttgacatcactccccagcaagabtgggggcagcacagccccagaagtgggctggcggggagctctgggtgccagtggtggtaggtttgtggaggccaaccccagccctgatgccagccagcac

SEQ ID NO: 10308 - DNA, 201 bp, Homo sapiens
ggccccagtggtcaggaaaagtgcaaacttgagaaccacatctcccctgacgtccgtgtgttgccagggggaggagcccatggaagcacacgagatcagarcatctgaactgccctgccttggaggagagacttttgggtgaggtccaaagaggagagctgttcagcttacctgccacagagcttttctgcatgaactctg

SEQ ID NO: 10309 - DNA, 201 bp, Homo sapiens
ctgcaacacgcacgactcgctgctcgaggtgtgcgatgactacagcctcgacgacaacgagtacttctttgaccgccacccgggcgccttcacctccatcytcaacttctaccgcactgggcgactgcacatgatggaggagatgtgcgcgctcagcttcagccaagagctcgactactggggcatcgacgagatctacct

SEQ ID NO: 10310 - DNA, 201 bp, Homo sapiens
gggttcagaaggtgggcacccagccaacagcatgaactcagagcattgttttagggttggaggaggaacacgctttctttacatcactagtgtagactcamaagatatgcaagtgtcaaatatgcaaaagaaatagtttattcaaagagactgtgtgttactgaagaacagcataaaaatatgatttttttacttgcaaaa

SEQ ID NO: 10311 - DNA, 201 bp, Homo sapiens
tccgcctcaacgtcggggggctggcgcacgaggtactctggcgtaccctggaccgcctgccccgcacgcggctgggcaagctccgcgactgcaacacgcaygactcgctgctcgaggtgtgcgatgactacagcctcgacgacaacgagtacttctttgaccgccacccgggcgccttcacctccatcctcaacttctacc

SEQ ID NO: 10312 - DNA, 201 bp, Homo sapiens
ctaggaacacctgtccatcacctcctggatggattccactgttagacagctacagggaatgattggtcatggggaagtctctgcgccataagccacgatcmcagcgcaaaacccttactcaaatgtcttcattgacttcggtatttcatagtacctgagattttattttgagataccatcagggtgagttgcaccacttgt

SEQ ID NO: 10313 - DNA, 201 bp, Homo sapiens
ggtcatggggaagtctctgcgccataagccacgatcccagcgcaaaacccttactcaaatgtcttcattgacttcggtatttcatagtacctgagattttwttttgagataccatcagggtgagttgcaccacttgtactcaattctaattgccccctggcaatctgggaagggttcagaaggtgggcacccagccaacag

SEQ ID NO: 10314 - DNA, 201 bp, Homo sapiens
caaaagaaatagtttattcaaagagactgtgtgttactgaagaacagcataaaaatatgatttttttacttgcaaaaatgaaaggaaaaaaataccacgcrttgaaatgcccagttcagactgaataattcctgctgcagcaaggaaagtacctactataatagaaattctgttttgttttctgtggttttcaagttaaaa

SEQ ID NO: 10315 - DNA, 201 bp, Homo sapiens
ggaatgattggtcatggggaagtctctgcgccataagccacgatcccagcgcaaaacccttactcaaatgtcttcattgacttcggtatttcatagtaccygagattttattttgagataccatcagggtgagttgcaccacttgtactcaattctaattgccccctggcaatctgggaagggttcagaaggtgggcaccc

SEQ ID NO: 10316 - DNA, 201 bp, Homo sapiens
atcggagaaaaaccactttgaaagctcccctttacccacctcccctaagttcttaaggcagaactgtatttactccacagaagcattgactggaaaaggcyccagtggtcaggaaaagtgcaaacttgagaaccacatctcccctgacgtccgtgtgttgccagggggaggagcccatggaagcacacgagatcagagcat

SEQ ID NO: 10317 - DNA, 201 bp, Homo sapiens
actggggcatcgacgagatctacctggagtcctgctgccaggcccgctaccaccagaagaaagagcagatgaacgaggagctcaagcgtgaggccgagacyctacgggagcgggaaggcgaggagttcgataacacgtgctgcgcagagaagaggaaaaaactctgggacctactggagaagcccaattcctctgtggctg

SEQ ID NO: 10318 - DNA, 201 bp, Homo sapiens
actctcaatgatacttttctatcaaaggaatttaatccactggttatagtgggcctcagtaaagatggtacagattacattgagatcattccaaaggaagmggtccagagcagtgaagatgactatgctgaaattgattatgtgccctatgatgacccctacaaaactgatgttaggacaaacatcaactcctccagagat

SEQ ID NO: 10319 - DNA, 201 bp, Homo sapiens
ggcccagagggaaagtggatcatatcttctctcaccccaaaacatttgcaagctgggatgcaggcttacattgacattaaaaactgcccaaagaaaaccasgaatcttaagaaaataactcgtgagcagaggcggcacatgaagaggtgggaatacttcattgctgcagaggaagtcatttgggactatgcacctgtaata

SEQ ID NO: 10320 - DNA, 201 bp, Homo sapiens
tcagagacacactcaaaatcgtgttcaaaaatatggccagccgcccctatagcatttaccctcatggagtgaccttctcgccttatgaagatgaagtcaaytcttctttcacctcaggcaggaacaacaccatgatcagagcagttcaaccaggggaaacctatacttataagtggaacatcttagagtttgatgaaccca

SEQ ID NO: 10321 - DNA, 201 bp, Homo sapiens
gacctgagcccacaaactcaagtttgaatctttctgtaacttcctttaagaaaattgtctacagagagtatgaaccatattttaagaaagaaaaaccacartctaccatttcaggacttcttgggcctactttatatgctgaagtcggagacatcataaaagttcactttaaaaataaggcagataagcccttgagcatcc

SEQ ID NO: 10322 - DNA, 201 bp, Homo sapiens
tggctgcagcattaggaatcaggtcattccgaaactcatcattgaatcaggaagaagaagagttcaatcttactgccctagctctggagaatggcactgarttcgtttcttcaaacacagatataattgttggttcaaattattcttccccaagtaatattagtaagttcactgtcaataaccttgcagaacctcagaaag

SEQ ID NO: 10323 - DNA, 201 bp, Homo sapiens
taagaaagaaaaaccacaatctaccatttcaggacttcttgggcctactttatatgctgaagtcggagacatcataaaagttcactttaaaaataaggcasataagcccttgagcatccatcctcaaggaattaggtacagtaaattatcagaaggtgcttcttaccttgaccacacattccctgcggagaagatggacga

SEQ ID NO: 10324 - DNA, 201 bp, Homo sapiens
acggaaaatgcatgatcgtttagaacctgaagatgaagagagtgatgctgactatgattaccagaacagactggctgcagcattaggaatcaggtcattcygaaactcatcattgaatcaggaagaagaagagttcaatcttactgccctagctctggagaatggcactgaattcgtttcttcaaacacagatataattgt

SEQ ID NO: 10325 - DNA, 201 bp, Homo sapiens
gttttatgaatcaaacatcatgagcactatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgaccctcttccccat

SEQ ID NO: 10326 - DNA, 201 bp, Homo sapiens
aaagtggatcatatcttctctcaccccaaaacatttgcaagctgggatgcaggcttacattgacattaaaaactgcccaaagaaaaccaggaatcttaagwaaataactcgtgagcagaggcggcacatgaagaggtgggaatacttcattgctgcagaggaagtcatttgggactatgcacctgtaataccagcgaatat

SEQ ID NO: 10327 - DNA, 201 bp, Homo sapiens
ctactcagctgtgaacccagaaaaagatattcactcaggcttgataggtcccctcctaatctgccaaaaaggaatactacataaggacagcaacatgcctrtggacatgagagaatttgtcttactatttatgacctttgatgaaaagaagagctggtactatgaaaagaagtcccgaagttcttggagactcacatcctc

SEQ ID NO: 10328 - DNA, 201 bp, Homo sapiens
acccctgggtatggaaaatggaaagatagaaaacaagcaaatcacagcttcttcgtttaagaaatcttggtggggagattactgggaacccttccgtgccygtctgaatgcccagggacgtgtgaatgcctggcaagccaaggcaaacaacaataagcagtggctagaaattgatctactcaagatcaagaagataacggc

SEQ ID NO: 10329 - DNA, 201 bp, Homo sapiens
gctgtgtttgatgaaagcaagagctggagccagtcatcatccctaatgtacacagtcaatggatatgtgaatgggacaatgccagatataacagtttgtgyccatgaccacatcagctggcatctgctgggaatgagctcggggccagaattattctccattcatttcaacggccaggtcctggagcagaaccatcataag

SEQ ID NO: 10330 - DNA, 201 bp, Homo sapiens
cttaacaagaccatactacagtgacgtggacatcatgagagacatcgcctctgggctaataggactacttctaatctgtaagagcagatccctggacaggygaggaatacagagggcagcagacatcgaacagcaggctgtgtttgctgtgtttgatgagaacaaaagctggtaccttgaggacaacatcaacaagttttg

SEQ ID NO: 10331 - DNA, 201 bp, Homo sapiens
gataatgctgttcagccaaatagcagttatacctacgtatggcatgccactgagcgatcagggccagaaagtcctggctctgcctgtcgggcttgggcctrctactcagctgtgaacccagaaaaagatattcactcaggcttgataggtcccctcctaatctgccaaaaaggaatactacataaggacagcaacatgcct

SEQ ID NO: 10332 - DNA, 201 bp, Homo sapiens
ctctctccagaactcagccatatgactctctctccagaactcagtcagacaaacctttccccagccctcggtcagatgcccatttctccagacctcagccrtacaaccctttctctagacttcagccagacaaacctctctccagaactcagtcaaacaaacctttccccagccctcggtcagatgcccctttctccagac

SEQ ID NO: 10333 - DNA, 201 bp, Homo sapiens
agtcccgaagttcttggagactcacatcctcagaaatgaaaaaatcccatgagtttcacgccattaatgggatgatctacagcttgcctggcctgaaaatrtatgagcaagagtgggtgaggttacacctgctgaacataggcggctcccaagacattcacgtggttcactttcacggccagaccttgctggaaaatggca

SEQ ID NO: 10334 - DNA, 201 bp, Homo sapiens
cccctgggtatggaaaatggaaagatagaaaacaagcaaatcacagcttcttcgtttaagaaatcttggtggggagattactgggaacccttccgtgcccrtctgaatgcccagggacgtgtgaatgcctggcaagccaaggcaaacaacaataagcagtggctagaaattgatctactcaagatcaagaagataacggca

SEQ ID NO: 10335 - DNA, 201 bp, Homo sapiens
ataatttctcaaaccaaattggaaaacattataagaaagttatgtacacacagtacgaagatgagtccttcaccaaacatacagtgaatcccaatatgaargaagatgggattttgggtcctattatcagagcccaggtcagagacacactcaaaatcgtgttcaaaaatatggccagccgcccctatagcatttaccctc

SEQ ID NO: 10336 - DNA, 201 bp, Homo sapiens
ttggataatttctcaaaccaaattggaaaacattataagaaagttatgtacacacagtacgaagatgagtccttcaccaaacatacagtgaatcccaataygaaagaagatgggattttgggtcctattatcagagcccaggtcagagacacactcaaaatcgtgttcaaaaatatggccagccgcccctatagcatttac

SEQ ID NO: 10337 - DNA, 201 bp, Homo sapiens
gtcctccaggtctttatcagacagtgcccccagaggaacactatcaaacattccccattcaagaccctgatcaaatgcactctacttcagaccccagtcasagatcctcttctccagagctcagtgaaatgcttgagtatgaccgaagtcacaagtccttccccacagatataagtcaaatgtccccttcctcagaacatg

SEQ ID NO: 10338 - DNA, 201 bp, Homo sapiens
gtttagaacctgaagatgaagagagtgatgctgactatgattaccagaacagactggctgcagcattaggaatcaggtcattccgaaactcatcattgaaycaggaagaagaagagttcaatcttactgccctagctctggagaatggcactgaattcgtttcttcaaacacagatataattgttggttcaaattattctt

SEQ ID NO: 10339 - DNA, 201 bp, Homo sapiens
tcatggctacacggaaaatgcatgatcgtttagaacctgaagatgaagagagtgatgctgactatgattaccagaacagactggctgcagcattaggaatyaggtcattccgaaactcatcattgaatcaggaagaagaagagttcaatcttactgccctagctctggagaatggcactgaattcgtttcttcaaacacag

SEQ ID NO: 10340 - DNA, 201 bp, Homo sapiens
gaagtgaagcctacaacacattttcagaaagaagacttaagcattcgttggtgcttcataaatccaatgaaacatctcttcccacagacctcaatcagacrttgccctctatggattttggctggatagcctcacttcctgaccataatcagaattcctcaaatgacactggtcaggcaagctgtcctccaggtctttatc

SEQ ID NO: 10341 - DNA, 201 bp, Homo sapiens
aaattattcttccccaagtaatattagtaagttcactgtcaataaccttgcagaacctcagaaagccccttctcaccaacaagccaccacagctggttccycactgagacacctcattggcaagaactcagttctcaattcttccacagcagagcattccagcccatattctgaagaccctatagaggatcctctacagcc

SEQ ID NO: 10342 - DNA, 201 bp, Homo sapiens
agtggcacttctgtagtgtggggacccagaatgaaattttgaccatccacttcactgggcactcattcatctatggaaagaggcatgaggacaccttgacmctcttccccatgcgtggagaatctgtgacggtcacaatggataatgttggaacttggatgttaacttccatgaattctagtccaagaagcaaaaagctga

SEQ ID NO: 10343 - DNA, 201 bp, Homo sapiens
aatggagtatcagtgaggacagtggacccacccatgatgaccctccatgcctcacacacatctattactcccatgaaaatctgatcgaggatttcaactckgggctgattgggcccctgcttatctgtaaaaaagggaccctaactgagggtgggacacagaagacgtttgacaagcaaatcgtgctactatttgctgtgt

SEQ ID NO: 10344 - DNA, 201 bp, Homo sapiens
cagcagacatcgaacagcaggctgtgtttgctgtgtttgatgagaacaaaagctggtaccttgaggacaacatcaacaagttttgtgaaaatcctgatgargtgaaacgtgatgaccccaagttttatgaatcaaacatcatgagcactatcaatggctatgtgcctgagagcataactactcttggattctgctttgatg

SEQ ID NO: 10345 - DNA, 201 bp, Homo sapiens
ttaaaaataaggcagataagcccttgagcatccatcctcaaggaattaggtacagtaaattatcagaaggtgcttcttaccttgaccacacattccctgcrgagaagatggacgacgctgtggctccaggccgagaatacacctatgaatggagtatcagtgaggacagtggacccacccatgatgaccctccatgcctca

SEQ ID NO: 10346 - DNA, 201 bp, Homo sapiens
gtgaggacagtggacccacccatgatgaccctccatgcctcacacacatctattactcccatgaaaatctgatcgaggatttcaactcggggctgattggscccctgcttatctgtaaaaaagggaccctaactgagggtgggacacagaagacgtttgacaagcaaatcgtgctactatttgctgtgtttgatgaaagca

SEQ ID NO: 10347 - DNA, 201 bp, Homo sapiens
caaagtaactcatctaagattttggttgggagatggcatttggcttctgagaaaggtagctatgaaataatccaagatactgatgaagacacagctgttarcaattggctgatcagcccccagaatgcctcacgtgcttggggagaaagcacccctcttgccaacaagcctggaaagcagagtggccacccaaagtttcct

SEQ ID NO: 10348 - DNA, 201 bp, Homo sapiens
aagaactttttcaaccccccaatcatttccaggtttatccgtgtcattcctaaaacatggaatcaaagtattgcacttcgcctggaactctttggctgtgrtatttactagaattgaacattcaaaaacccctggaagagactctttaagacctcaaaccatttagaatgggcaatgtattttacgctgtgttaaatgtta

SEQ ID NO: 10349 - DNA, 201 bp, Homo sapiens
cggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctga

SEQ ID NO: 10350 - DNA, 201 bp, Homo sapiens
tgggtatggaaaatggaaagatagaaaacaagcaaatcacagcttcttcgtttaagaaatcttggtggggagattactgggaacccttccgtgcccgtctraatgcccagggacgtgtgaatgcctggcaagccaaggcaaacaacaataagcagtggctagaaattgatctactcaagatcaagaagataacggcaatta

SEQ ID NO: 10351 - DNA, 201 bp, Homo sapiens
tcagccatacaaccctttctccagacctcagccatacaaccctttctttagacctcagccagacaaacctctctccagaactcagtcagacaaacctttcyccagccctcggtcagatgcccctttctccagacctcagccatacaaccctttctctagacttcagccagacaaacctctctccagaactcagccatatga

SEQ ID NO: 10352 - DNA, 201 bp, Homo sapiens
gggcccagagggaaagtggatcatatcttctctcaccccaaaacatttgcaagctgggatgcaggcttacattgacattaaaaactgcccaaagaaaaccrggaatcttaagaaaataactcgtgagcagaggcggcacatgaagaggtgggaatacttcattgctgcagaggaagtcatttgggactatgcacctgtaat

SEQ ID NO: 10353 - DNA, 201 bp, Homo sapiens
aaacacagatataattgttggttcaaattattcttccccaagtaatattagtaagttcactgtcaataaccttgcagaacctcagaaagccccttctcacyaacaagccaccacagctggttccccactgagacacctcattggcaagaactcagttctcaattcttccacagcagagcattccagcccatattctgaaga

SEQ ID NO: 10354 - DNA, 201 bp, Homo sapiens
tcaaacattccccattcaagaccctgatcaaatgcactctacttcagaccccagtcacagatcctcttctccagagctcagtgaaatgcttgagtatgacygaagtcacaagtccttccccacagatataagtcaaatgtccccttcctcagaacatgaagtctggcagacagtcatctctccagacctcagccaggtgac

SEQ ID NO: 10355 - DNA, 201 bp, Homo sapiens
gagacacctaagccaagacactggttctccttccggaatgaggccctgggaggaccttcctagccaagacactggttctccttccagaatgaggccctggraggaccctcctagtgatctgttactcttaaaacaaagtaactcatctaagattttggttgggagatggcatttggcttctgagaaaggtagctatgaaat

SEQ ID NO: 10356 - DNA, 201 bp, Homo sapiens
tctgaagaccctatagaggatcctctacagccagatgtcacagggatacgtctactttcacttggtgctggagaattcaaaagtcaagaacatgctaagcrtaagggacccaaggtagaaagagatcaagcagcaaagcacaggttctcctggatgaaattactagcacataaagttgggagacacctaagccaagacact

SEQ ID NO: 10357 - DNA, 201 bp, Homo sapiens
ttaacaagaccatactacagtgacgtggacatcatgagagacatcgcctctgggctaataggactacttctaatctgtaagagcagatccctggacaggcraggaatacagagggcagcagacatcgaacagcaggctgtgtttgctgtgtttgatgagaacaaaagctggtaccttgaggacaacatcaacaagttttgt

SEQ ID NO: 10358 - DNA, 201 bp, Homo sapiens
agacctcagccagacaaacctctctccagaactcagtcagacaaacctttctccagccctcggtcagatgcccctttctccagacctcagccatacaaccmtttctctagacttcagccagacaaacctctctccagaactcagccatatgactctctctccagaactcagtcagacaaacctttccccagccctcggtca

SEQ ID NO: 10359 - DNA, 201 bp, Homo sapiens
atcagggccagaaagtcctggctctgcctgtcgggcttgggcctactactcagctgtgaacccagaaaaagatattcactcaggcttgataggtcccctcstaatctgccaaaaaggaatactacataaggacagcaacatgcctatggacatgagagaatttgtcttactatttatgacctttgatgaaaagaagagctg

SEQ ID NO: 10360 - DNA, 201 bp, Homo sapiens
gcagagcattccagcccatattctgaagaccctatagaggatcctctacagccagatgtcacagggatacgtctactttcacttggtgctggagaattcaraagtcaagaacatgctaagcataagggacccaaggtagaaagagatcaagcagcaaagcacaggttctcctggatgaaattactagcacataaagttggg

SEQ ID NO: 10361 - DNA, 201 bp, Homo sapiens
gaagtcacaagtccttccccacagatataagtcaaatgtccccttcctcagaacatgaagtctggcagacagtcatctctccagacctcagccaggtgacyctctctccagaactcagccagacaaacctctctccagacctcagccacacgactctctctccagaactcattcagagaaacctttccccagccctcggtc

SEQ ID NO: 10362 - DNA, 201 bp, Homo sapiens
acctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggcgaggaatacagagggcagcagacatcgaacagcaggct

SEQ ID NO: 10363 - DNA, 201 bp, Homo sapiens
agtaagttcactgtcaataaccttgcagaacctcagaaagccccttctcaccaacaagccaccacagctggttccccactgagacacctcattggcaagamctcagttctcaattcttccacagcagagcattccagcccatattctgaagaccctatagaggatcctctacagccagatgtcacagggatacgtctactt

SEQ ID NO: 10364 - DNA, 201 bp, Homo sapiens
gtggatgatgttatccaagttcgttttaaaaatttagcatccagaccgtattctctacatgcccatggactttcctatgaaaaatcatcagagggaaagasttatgaagatgactctcctgaatggtttaaggaagataatgctgttcagccaaatagcagttatacctacgtatggcatgccactgagcgatcagggcca

SEQ ID NO: 10365 - DNA, 201 bp, Homo sapiens
taggaatcaggtcattccgaaactcatcattgaatcaggaagaagaagagttcaatcttactgccctagctctggagaatggcactgaattcgtttcttcraacacagatataattgttggttcaaattattcttccccaagtaatattagtaagttcactgtcaataaccttgcagaacctcagaaagccccttctcacc

SEQ ID NO: 10366 - DNA, 201 bp, Homo sapiens
tagacttcagccagacaaacctctctccagaactcagtcaaacaaacctttccccagccctcggtcagatgcccctttctccagaccccagccatacaacyctttctctagacctcagccagacaaacctctctccagaactcagtcagacaaacctttccccagacctcagtgagatgcccctctttgcagatctcagtc

SEQ ID NO: 10367 - DNA, 201 bp, Homo sapiens
tcggaattcttggtcctattatcagagctgaagtggatgatgttatccaagttcgttttaaaaatttagcatccagaccgtattctctacatgcccatggrctttcctatgaaaaatcatcagagggaaagacttatgaagatgactctcctgaatggtttaaggaagataatgctgttcagccaaatagcagttatacct

SEQ ID NO: 10368 - DNA, 201 bp, Homo sapiens
atctgtaagagcagatccctggacaggcgaggaatacagagggcagcagacatcgaacagcaggctgtgtttgctgtgtttgatgagaacaaaagctggtmccttgaggacaacatcaacaagttttgtgaaaatcctgatgaggtgaaacgtgatgaccccaagttttatgaatcaaacatcatgagcactatcaatggc

SEQ ID NO: 10369 - DNA, 201 bp, Homo sapiens
catctttgaattggaagccattacgcataaaaggccattggtttatctgggcttaaaggtcttctctcggtttggagtatgtgagtttttaaactgttctraaaccactcttcgggcctggttccaagtgatcgaagccaactaccactcttccaatgcctaccacaactccacccatgctgccgacgtcctgcacgccac

SEQ ID NO: 10370 - DNA, 194 bp, Homo sapiens
ctaaattatttttgttagatgataagagaacttgcttggtcaggacagcagccagctttgtattgtaatgctatattatgtaaatgtgatgaaaatgtttwtgtgaagtacttgtaactaaattcctacagccatttttcactcccaacagctgtttttattttacctctttggcctaaagttttcataatttc

SEQ ID NO: 10371 - DNA, 201 bp, Homo sapiens
gggaccccccagcgtagcccgcgtccgcagggcccgcaccgagctgggcagcggtagcagcgcgggttccgcagcccccgccgcgaccaccagcaggggcyggaggcgccactgctgcagcagcgccgaggccgagactcagacctgctacaccagcgtgaagcaggtgtcttctgcggaggtgcgcatcgggcccatgag

SEQ ID NO: 10372 - DNA, 201 bp, Homo sapiens
ccacgaggcactacaccaagtattatataaaagccattaaatttgaatgcccttggacaagcttttcttaaaaaaaaaaaaaaagtttatatacatgtttgaaatttttattaaaatccaaattttctgggtgtaagcccatgcagtatgttgtgccatgcaccatctatacgtaatattttgggaggggataggggaagt

SEQ ID NO: 10373 - DNA, 201 bp, Homo sapiens
gcttgactgttttcctcaagaacatcgatctgaaggattcataaggagcttatctgaacagatttatctaagaaaaaaaaaaaaagacataaaataagcgmaacaactaggaccaaattacagataaactagttagcttcacagcctctatggctacatggttcttctggccgatggtatgacacctaagttagaacacag

SEQ ID NO: 10374 - DNA, 201 bp, Homo sapiens
aggcttccatctgacagctaaagccaagccacagagggggcctcttgaccgacaaaggacactgtgaatcacagtagcgtaaacaagaggccttcctttcraatgacaatgacaggtattggtgaaggagctaatgtttaatatttgaccttgaatcattcaagtccccaaatttcattcttagaaagttatgttccatga

SEQ ID NO: 10375 - DNA, 201 bp, Homo sapiens
actaagtagcttagctagtgatcagctcatcctttaccataaaagtcatcattgctgtttagcttgactgttttcctcaagaacatcgatctgaaggattrataaggagcttatctgaacagatttatctaagaaaaaaaaaaaaagacataaaataagcgaaacaactaggaccaaattacagataaactagttagcttc

SEQ ID NO: 10376 - DNA, 201 bp, Homo sapiens
cgtgattcaggagacaattctcagacagagcctcattcattcagatataagaacaggaggaaagagtccattgacgtgaaatcgatatcatctcgaggcartgatgcaccaagcctgcagaatcgtcgctatccgtccatggcgaggatccactccatgaccatcgaggctcccatcacaaaggttataaatataatcaat

SEQ ID NO: 10377 - DNA, 201 bp, Homo sapiens
tgcttgggatgcctttgcacatctgccagccctgatgcaacatttggctgacaactacaaacactggaagacactagatgacctaaagtgcaaaagtttgrggcttccatctgacagctaaagccaagccacagagggggcctcttgaccgacaaaggacactgtgaatcacagtagcgtaaacaagaggccttcctttct

SEQ ID NO: 10378 - DNA, 201 bp, Homo sapiens
agaacatcgatctgaaggattcataaggagcttatctgaacagatttatctaagaaaaaaaaaaaaagacataaaataagcgaaacaactaggaccaaatracagataaactagttagcttcacagcctctatggctacatggttcttctggccgatggtatgacacctaagttagaacacagccttggctggtgggtgcc

SEQ ID NO: 10379 - DNA, 201 bp, Homo sapiens
agcggaagccttggacagagttctagagattttacggaccacagaactgtactcccctcagctgggtaccaaagatgaagatccccacaccagtgatcttyttggaggcctgatgactgacggcttgagaagactgtcaggaaacgagtatgtgtttactaagaatgtgcaccagagtcacagtcaccttgcaatgccaat

SEQ ID NO: 10380 - DNA, 201 bp, Homo sapiens
ctcaagaacatcgatctgaaggattcataaggagcttatctgaacagatttatctaagaaaaaaaaaaaaagacataaaataagcgaaacaactaggaccyaattacagataaactagttagcttcacagcctctatggctacatggttcttctggccgatggtatgacacctaagttagaacacagccttggctggtggg

SEQ ID NO: 10381 - DNA, 201 bp, Homo sapiens
gaggcttccatctgacagctaaagccaagccacagagggggcctcttgaccgacaaaggacactgtgaatcacagtagcgtaaacaagaggccttcctttytaatgacaatgacaggtattggtgaaggagctaatgtttaatatttgaccttgaatcattcaagtccccaaatttcattcttagaaagttatgttccatg

SEQ ID NO: 10382 - DNA, 201 bp, Homo sapiens
tcatcatctgtggagatgtttctatactttgaagatcatggactagtgacgtgctccgctgatcatctcattattttgtggaaaaatggagagcgagaatytggattgcgcagtttaagattatttcaaaaattagaggagaatggtgacttataccttgctgtctagtttaaggaattaaaaatacacatgcatgaacct

SEQ ID NO: 10383 - DNA, 201 bp, Homo sapiens
caaacccagaatccctacactgaactgctagtactgaaggctcatcatgatattgtacgatttctggtacagttagatgactacagatttgcatctgctgrtgatgatggaattgtagttgtgtggaatgcccagacaggggaaaaacttttagaactgaatggacacactcaaaagataacagctattattacatttcct

SEQ ID NO: 10384 - DNA, 201 bp, Homo sapiens
aagcgactgcccaaactaagcctccgtggctgggtacgggagcgctttggggacaaaaattctccctcaactgtggtctgcattccttcggcccgtgggcygatctggggcgggaagtattagcgtctcagttgcgctgcagccggggaggaaggaggaggccgagcctggggcggagtttgggctgactggggctggacc

SEQ ID NO: 10385 - DNA, 201 bp, Homo sapiens
gtgattgcctgccagaaaactgcacatgactccaatgtcctgcacattgccagacttccaaacaggcagttaatctcatgctcagaagatggcagtgtacrcatttgggagttaagagaaaaacagcagcttgcagctgagcctgtaccaacaggtttttttaacatgtggggatttggaagagtcagcaaacaagccagc

SEQ ID NO: 10386 - DNA, 201 bp, Homo sapiens
gacaagttcagagaatatcatgcttccagtctactgtaaagtgtttaactgttcttcagagactagatgtttggctttctggtgggaatgacctgtgtgtrtggaaccgaaaattagatctcctgtgtaagactagccacctttctgatacaggtattagtgctttggttgaaatacctaagaactgtgttgtggcagcag

SEQ ID NO: 10387 - DNA, 201 bp, Homo sapiens
tcctccaaagaatataccacaagtttttccatttgactttgagctgctgttgaagtgataaatctgttcagataagctccttatgaatccttcagatcgaygttcttgaggaaaacagtcaagctaaacagcaatgatgacttttatgagttttcctccaacgacagaaaaacactgcagtaagctttggcagcgtgtcct

SEQ ID NO: 10388 - DNA, 201 bp, Homo sapiens
aacagcaatgatgacttttatgagttttcctccaacgacagaaaaacactgcagtaagctttggcagcgtgtcctttgaagaggcagagactcgtttatcyagctatcaaaaatccatcaagtcttctgcacacaagcttctgtgccagctgctggggatgcaaagaatgcaccccaccccacttggccacaaaaagctga

SEQ ID NO: 10389 - DNA, 201 bp, Homo sapiens
tgtatttgctgcagttggaaggggtttatacgtgtatagccttcaaatgaagcgtgtgattgcctgccagaaaactgcacatgactccaatgtcctgcacrttgccagacttccaaacaggcagttaatctcatgctcagaagatggcagtgtacgcatttgggagttaagagaaaaacagcagcttgcagctgagcctgt

SEQ ID NO: 10390 - DNA, 201 bp, Homo sapiens
tgcatgaaccttgaacatcaaatatcgggtactactctgaaaaccattaatatattgatcacttaaattggtaattttttttgtcagtccataaaattctrcatgtttaaattttttgtggacctaccaaccaggaacatgttgcttctcaggtcctagtatatcctccaaagaatataccacaagtttttccatttgact

SEQ ID NO: 10391 - DNA, 201 bp, Homo sapiens; identical to SEQ ID NO: 10382

SEQ ID NO: 10392 - DNA, 201 bp, Homo sapiens; identical to SEQ ID NO: 10383

SEQ ID NO: 10393 - DNA, 201 bp, Homo sapiens; identical to SEQ ID NO: 10384

SEQ ID NO: 10394 - DNA, 201 bp, Homo sapiens
gttttctccttttggtgctaaaaaataaaaatattagaaagtagtctacacattaaagattgaaattcttaaactactgatgaagaaagggcaacgtgacwgatgttagcagactgacccttcttacagaaaacctacagatttatttgttcattatacaaatatactacaaatataccctaaagggaatctccataagtt

SEQ ID NO: 10395 - DNA, 201 bp, Homo sapiens; identical to SEQ ID NO: 10385

SEQ ID NO: 10396 - DNA, 201 bp, Homo sapiens
gacaagttcagagaatatcatgcttccagtctactgtaaagtgtttaactgttcttcagagactagatgtttggctttctggtgggaatgacctgtgtgtrtggaaccgaaaattagatctcctgtgtaagactagccacctttctgatacagtaattttcaggttggtagcacccacagaaggatcactagaatgggata

SEQ ID NO: 10397 - DNA, 201 bp, Homo sapiens
ttctatatagcacaaacttgaatctctcagccaaaaaagggaacatatatactgtttaagtatggcaagttttctttggtaccaatttgtttagataattktaaaaatgttttttagttctagctactaaaacctgtatgaactcaaatggataggcatcttgtgagggtgtgtttttcccagtgtgaattggcttgaaga

SEQ ID NO: 10398 - DNA, 201 bp, Homo sapiens
gcttgagacagacttcttttatgtagttctttgcagtgtccattgagacactataaccagccttgtaacaatatgttttctccttttggtgctaaaaaatraaaatattagaaagtagtctacacattaaagattgaaattcttaaactactgatgaagaaagggcaacgtgactgatgttagcagactgacccttcttac

SEQ ID NO: 10399 - DNA, 201 bp, Homo sapiens
gacactataaccagccttgtaacaatatgttttctccttttggtgctaaaaaataaaaatattagaaagtagtctacacattaaagattgaaattcttaamctactgatgaagaaagggcaacgtgactgatgttagcagactgacccttcttacagaaaacctacagatttatttgttcattatacaaatatactacaaa

SEQ ID NO: 10400 - DNA, 201 bp, Homo sapiens; identical to SEQ ID NO: 10389

SEQ ID NO: 10401 - DNA, 201 bp, Homo sapiens; identical to SEQ ID NO: 10390

SEQ ID NO: 10402 - DNA, 201 bp, Homo sapiens; identical to SEQ ID NO: 10382

SEQ ID NO: 10403 - DNA, 201 bp, Homo sapiens; identical to SEQ ID NO: 10383

SEQ ID NO: 10404 - DNA, 201 bp, Homo sapiens; identical to SEQ ID NO: 10384

SEQ ID NO: 10405 - DNA, 201 bp, Homo sapiens; identical to SEQ ID NO: 10394

SEQ ID NO: 10406 - DNA, 201 bp, Homo sapiens; identical to SEQ ID NO: 10385

SEQ ID NO: 10407 - DNA, 201 bp, Homo sapiens; identical to SEQ ID NO: 10386

SEQ ID NO: 10408 - DNA, 201 bp, Homo sapiens; identical to SEQ ID NO: 10397

SEQ ID NO: 10409 - DNA, 201 bp, Homo sapiens; identical to SEQ ID NO: 10398

SEQ ID NO: 10410 - DNA, 201 bp, Homo sapiens; identical to SEQ ID NO: 10399

SEQ ID NO: 10411 - DNA, 201 bp, Homo sapiens; identical to SEQ ID NO: 10389

SEQ ID NO: 10412 - DNA, 201 bp, Homo sapiens; identical to SEQ ID NO: 10390

SEQ ID NO: 10413 - DNA, 201 bp, Homo sapiens
tggagacagcggcaacttctccgtgttgatggtggacacaaggggccagccctggacccagaccctccagctcaaggtgtacgatgcagtgcccaggcccrtggtacaagtgttcattgctgtagaaagggatgctcagccctccaagacctgccaggttttcttgtcctgttgggcccccaacatcagcgaaataaccta

SEQ ID NO: 10414 - DNA, 130 bp, Homo sapiens
ggaccacagctcctcccgtgcatccactcrgcctgggaggttctggattttggctgtcgagggagtttgcctgcctctccagagaaagatggtcatgaggcccctgtggagtctgcttctctgggaagcc

SEQ ID NO: 10415 - DNA, 201 bp, Homo sapiens
aggctccctggagactctgtaccattcccgcttcctgggccgagcccagctacacagcaacctcagcctggagctcgggccgctggagtctggagacagcrgcaacttctccgtgttgatggtggacacaaggggccagccctggacccagaccctccagctcaaggtgtacgatgcagtgcccaggcccgtggtacaagt

SEQ ID NO: 10416 - DNA, 201 bp, Homo sapiens
aatccagtcttgataacagcgaggaaagaggtattgaagaaacaggggtgggtttgaagtactattttcccagggtggcttcaatctccccacctaggatrtcagccctgtccaaggaccttccctcttctccccagttcctgggcaatcacttcaccttggacaaaggatcagcacagctggcctccagatccacatcac

SEQ ID NO: 10417 - DNA, 201 bp, Homo sapiens
tgccacctacagtcaggccacatgcctggtcactgaatcatgcaaaactggcctcagtccctaaaaatgatgtggaaaggaaagcccaggatctgacaatsagccctggtggatttgtggggaaaaaatacacagcactccccacctttctttcgttcatctccagggccccacctcagatcaaagcagctctggatgaga

SEQ ID NO: 10418 - DNA, 201 bp, Homo sapiens
ggaccacagctcctcccgtgcatccactcggcctgggaggttctggattttggctgtcgagggagtttgcctgcctctccagagaaagatggtcatgaggmccctgtggagtctgcttctctgggaagccctacttcccattacagttactggtgcccaagtgctgagcaaagtcgggggctcggtgctgctggtggcagc

SEQ ID NO: 10419 - DNA, 148 bp, Homo sapiens
ggaccacagctcctcccgtgcatccactcggcctgggaggttctggaktttggctgtcgagggagtttgcctgcctctccagagaaagatggtcatgaggcccctgtggagtctgcttctctgggaagccctacttcccattacagtt

SEQ ID NO: 10420 - DNA, 201 bp, Homo sapiens
cttgtcctgttgggcccccaacatcagcgaaataacctatagctggcgacgggagacaaccatggactttggtatggaaccacacagcctcttcacagacrgacaggtgctgagcatttccctgggaccaggagacagagatgtggcctattcctgcattgtctccaaccctgtcagctgggacttggccacagtcacgcc

SEQ ID NO: 10421 - DNA, 201 bp, Homo sapiens
gaaaactgggaatgtaatgtggattctgtcagagctcctacagagcacagttgcctttagtttcctttaaagatgtaaaaatattgtataatacagttttktccctacacaattgtatttgccaagcttagtgcattatgatacctttatttatttgttttgggcagtattactatatatatataaacatacagttactgt

SEQ ID NO: 10422 - DNA, 201 bp, Homo sapiens
gctcacttacttttctacagagtaactcaaaagtaaccattgaattacaatccactttgtaaaaatctgaatgtaaaacagtaaataataaattaaataaytggatcctaggcataccaataaatgttatttggggaaagaagctagcactatctcatgcagtgagaataacgggttctagtgaattatcctatctacact

SEQ ID NO: 10423 - DNA, 201 bp, Homo sapiens
tggctggtgactctgagcaagttgcttgacctctccaagcctccgtttcctcatgtgcaaagtgtggacaacaacagtaccttcctcataaggaacgtgcracgcgcctcagaagtacgtgttcataaatggtagccattgttgttaccttcccgtctgtgaacatggatcacatcatctctgtgggtaacccagtcctcg

SEQ ID NO: 10424 - DNA, 201 bp, Homo sapiens
gtgagctgcatactccatcgctagatcgaaagccaaatagttttgttgcggtgagtgtcaccacccctcctcaggcattctggacgaagcatgcacagacrgagatcattgagggaaccaacaatcctatatttctaagcagtattgccttctttcaagactctcttatcaatcagatgacacaagtcaaactctccgtgt

SEQ ID NO: 10425 - DNA, 201 bp, Homo sapiens
ggatggttcttcctgtcgatgagagcttgacggaggcgttaggaatccgatccaaatacgcttcattgcgaaaggacactttgctgaaatcggtgttcggyggtgccatctgccgcatgtaccggtttccaaccactgatggtaaccatttgcggatcctggagcagatggcagagagcgtgctctccctgcacgtgcccc

SEQ ID NO: 10426 - DNA, 201 bp, Homo sapiens
ttaaaaaatctccttgctttttaaaaataaatattacccacatagttttcagatcttttttgtctggagagcattaaatatctgcactcatcaaagggaayatagcaaatgttgatcatctgtcagcagttttgcatgtgacacctttatatgaattattttcccaatttttgctctatgtaatgggtcaccataaaactg

SEQ ID NO: 10427 - DNA, 201 bp, Homo sapiens
tttcctcatgtgcaaagtgtggacaacaacagtaccttcctcataaggaacgtgcgacgcgcctcagaagtacgtgttcataaatggtagccattgttgtwaccttcccgtctgtgaacatggatcacatcatctctgtgggtaacccagtcctcgttgtatgacttgtcaaaatgcagttccacttgtattaatattgac

SEQ ID NO: 10428 - DNA, 184 bp, Homo sapiens
tgacttgtcaaaatgcagttccacttgtattaatattgaccctgttcatcgtcaccaggactgcatcttgcaccactgtgccgtcttctaggcacacacgrcccgttatctcccttggaaaaattcctctcactggaaatgtacaattaaaggatgattgaaatgtttaactcttggagttttt

SEQ ID NO: 10429 - DNA, 201 bp, Homo sapiens
gctgtaactacacagatctcatcaatagttacctacatgaatcaagctaggtttgtctgaaatgctagaagactttttcaaatgcctgcttgctcacttayttttctacagagtaactcaaaagtaaccattgaattacaatccactttgtaaaaatctgaatgtaaaacagtaaataataaattaaataattggatccta

SEQ ID NO: 10430 - DNA, 201 bp, Homo sapiens
  misc_feature (1)...(201): n = A,T,C or G, or insertion/deletion polymorphism (see Tables 1-2)
agaacgtgcatgcccggaagaataagaacgtcgacattctctggcaagctgctgagatctgccgccgccttaatggggtccggttcaccagctgcaagagngctaaggaccgtacagccatgtcggtgacactggagcagtgcctgatcctgcaacacgagcatggcatggccccgcaggtcttcacccaggccctggagt

SEQ ID NO: 10431 - DNA, 201 bp, Homo sapiens
gtaaccatttgcggatcctggagcagatggcagagagcgtgctctccctgcacgtgccccggcagttcgtgaagctcctactagaggaagatgcagccagkgtgtgtgagctggaggagctgggagagctgtccccttgctgggagagcctccggcgccaaattgtcacccagtaccagaccatcatcctcacataccagg

SEQ ID NO: 10432 - DNA, 201 bp, Homo sapiens
gaaagattgataaatcaacgggagataagactttattagaaggtaacacctgcaaggtaccccacatagttggggccactcttttttctgtcccttatgasttacagaacagggagtctgctggagacacaaagccagcagtaaggtccctttagcctgtctcctgttctctgaagctccctgccgaggctccctcacgcc

SEQ ID NO: 10433 - DNA, 201 bp, Homo sapiens
cttgtttgtttagctcctgtagcatcttcagtgcttgtaacatgttcttacggtgccctgtcactgcatcgtttagctggcctggaattccttgtaccacrtctctaccttctgatgtacaactatttatcacctgtacctctcatgtgccctgtttccaagagaaacgagttctgtttaaagagaatttgtatatttgat

SEQ ID NO: 10434 - DNA, 201 bp, Homo sapiens; identical to SEQ ID NO: 10430
  misc_feature (1)...(201): n = A,T,C or G, or insertion/deletion polymorphism (see Tables 1-2)

SEQ ID NO: 10435 - DNA, 201 bp, Homo sapiens
tacagagggccctcgtttaaagcaagcagtttgaaagcagataaaaagttagaatttgttcccacaaacttgcacatacaaaggatgagagttcaagacgktggaggatcagatcagaactacgacatcgtcaccattggggcgccagcagcacactgccaaggttttaagtcaggaggtctccgcaaaaagctgcacaaa

SEQ ID NO: 10436 - DNA, 201 bp, Homo sapiens; identical to SEQ ID NO: 10424

SEQ ID NO: 10437 - DNA, 201 bp, Homo sapiens; identical to SEQ ID NO: 10425

SEQ ID NO: 10438 - DNA, 201 bp, Homo sapiens; identical to SEQ ID NO: 10421

SEQ ID NO: 10439 - DNA, 201 bp, Homo sapiens; identical to SEQ ID NO: 10422

SEQ ID NO: 10440 - DNA, 201 bp, Homo sapiens; identical to SEQ ID NO: 10423

SEQ ID NO: 10441 - DNA, 201 bp, Homo sapiens; identical to SEQ ID NO: 10424

SEQ ID NO: 10442 - DNA, 201 bp, Homo sapiens; identical to SEQ ID NO: 10425

SEQ ID NO: 10443 - DNA, 201 bp, Homo sapiens; identical to SEQ ID NO: 10426

SEQ ID NO: 10444 - DNA, 201 bp, Homo sapiens; identical to SEQ ID NO: 10427

SEQ ID NO: 10445 - DNA, 184 bp, Homo sapiens; identical to SEQ ID NO: 10428

SEQ ID NO: 10446 - DNA, 201 bp, Homo sapiens; identical to SEQ ID NO: 10429

SEQ ID NO: 10447 - DNA, 201 bp, Homo sapiens; identical to SEQ ID NO: 10430
  misc_feature (1)...(201): n = A,T,C or G, or insertion/deletion polymorphism (see Tables 1-2)

SEQ ID NO: 10448 - DNA, 201 bp, Homo sapiens; identical to SEQ ID NO: 10431

SEQ ID NO: 10449 - DNA, 201 bp, Homo sapiens; identical to SEQ ID NO: 10432

SEQ ID NO: 10450 - DNA, 201 bp, Homo sapiens; identical to SEQ ID NO: 10421

SEQ ID NO: 10451 - DNA, 201 bp, Homo sapiens; identical to SEQ ID NO: 10422

SEQ ID NO: 10452 - DNA, 201 bp, Homo sapiens; identical to SEQ ID NO: 10423

SEQ ID NO: 10453 - DNA, 201 bp, Homo sapiens; identical to SEQ ID NO: 10424

SEQ ID NO: 10454 - DNA, 201 bp, Homo sapiens; identical to SEQ ID NO: 10425

SEQ ID NO: 10455 - DNA, 201 bp, Homo sapiens; identical to SEQ ID NO: 10426

SEQ ID NO: 10456 - DNA, 201 bp, Homo sapiens; identical to SEQ ID NO: 10427

SEQ ID NO: 10457 - DNA, 184 bp, Homo sapiens; identical to SEQ ID NO: 10428

SEQ ID NO: 10458 - DNA, 201 bp, Homo sapiens; identical to SEQ ID NO: 10429

SEQ ID NO: 10459 - DNA, 201 bp, Homo sapiens
cagcaagaaaggtaacccggacagccacgcctactggatcagaccagaagaccccttctgtgatgtcccctcctcaccatgcccctccaccatgccctccrctgcatgccatcctcatctgaccacacattgcagtccccctcctgaagagtccagcccaggtgaatggagtgaggccctttacccgctgctgaccactct

SEQ ID NO: 10460 - DNA, 201 bp, Homo sapiens; identical to SEQ ID NO: 10430
  misc_feature (1)...(201): n = A,T,C or G, or insertion/deletion polymorphism (see Tables 1-2)

SEQ ID NO: 10461 - DNA, 201 bp, Homo sapiens; identical to SEQ ID NO: 10431

SEQ ID NO: 10462 - DNA, 201 bp, Homo sapiens; identical to SEQ ID NO: 10432

SEQ ID NO: 10463 - DNA, 201 bp, Homo sapiens; identical to SEQ ID NO: 10433

SEQ ID NO: 10464 - DNA, 201 bp, Homo sapiens; identical to SEQ ID NO: 10430
  misc_feature (1)...(201): n = A,T,C or G, or insertion/deletion polymorphism (see Tables 1-2)

SEQ ID NO: 10465 - DNA, 201 bp, Homo sapiens; identical to SEQ ID NO: 10431

SEQ ID NO: 10466 - DNA, 201 bp, Homo sapiens; identical to SEQ ID NO: 10424

SEQ ID NO: 10467 - DNA, 201 bp, Homo sapiens; identical to SEQ ID NO: 10425

SEQ ID NO: 10468 - DNA, 201 bp, Homo sapiens; identical to SEQ ID NO: 10421

SEQ ID NO: 10469 - DNA, 201 bp, Homo sapiens; identical to SEQ ID NO: 10422

SEQ ID NO: 10470 - DNA, 201 bp, Homo sapiens; identical to SEQ ID NO: 10423

SEQ ID NO: 10471 - DNA, 201 bp, Homo sapiens; identical to SEQ ID NO: 10424

SEQ ID NO: 10472 - DNA, 201 bp, Homo sapiens; identical to SEQ ID NO: 10425

SEQ ID NO: 10473 - DNA, 201 bp, Homo sapiens; identical to SEQ ID NO: 10426

SEQ ID NO: 10474 - DNA, 201 bp, Homo sapiens; identical to SEQ ID NO: 10427

SEQ ID NO: 10475 - DNA, 184 bp, Homo sapiens; identical to SEQ ID NO: 10428

SEQ ID NO: 10476 - DNA, 201 bp, Homo sapiens; identical to SEQ ID NO: 10429

SEQ ID NO: 10477 - DNA, 201 bp, Homo sapiens; identical to SEQ ID NO: 10430
  misc_feature (1)...(201): n = A,T,C or G, or insertion/deletion polymorphism (see Tables 1-2)

SEQ ID NO: 10478 - DNA, 201 bp, Homo sapiens; identical to SEQ ID NO: 10435

SEQ ID NO: 10479 - DNA, 201 bp, Homo sapiens; identical to SEQ ID NO: 10432

SEQ ID NO: 10480 - DNA, 201 bp, Homo sapiens; identical to SEQ ID NO: 10433

SEQ ID NO: 10481 - DNA, 201 bp, Homo sapiens; identical to SEQ ID NO: 10430
  misc_feature (1)...(201): n = A,T,C or G, or insertion/deletion polymorphism (see Tables 1-2)

SEQ ID NO: 10482 - DNA, 201 bp, Homo sapiens
ctgcaagctcctggccaactccatccatgggctgaacgctgcacggcctgactacattgcctccaaggcctctcccacttcgactgaggaggagcaggtgktgcttagaaatgaccaggacaccctcatggcccggtggacagggagaaacagccgatcttccctgcaggtggactggcacgaggaggagtgggagaaagt

SEQ ID NO: 10483 - DNA, 201 bp, Homo sapiens; identical to SEQ ID NO: 10424

SEQ ID NO: 10484 - DNA, 201 bp, Homo sapiens; identical to SEQ ID NO: 10425

SEQ ID NO: 10485 - DNA, 107 bp, Homo sapiens
tgtatttgtttcaatggtaaatccttttggaacatatagaatgcagagatttttttttccattaaaataaatgggtattggtggttaaaactgctggacagtaactg

SEQ ID NO: 10486 - DNA, 201 bp, Homo sapiens
gactactttttctggtgtgttaacatgtcgctagccagtgctccaggcacccagctttgtctgtgggttagtattggtgtatgtatgagtatctgtatgtrtatatacacggtatttatagagagagactatcctggagaagcctcgttttgatgccattcttccttgcaaggttaagcaaggtgggtggaaactaagaca

SEQ ID NO: 10487 - DNA, 201 bp, Homo sapiens
tttttctggtgtgttaacatgtcgctagccagtgctccaggcacccagctttgtctgtgggttagtattggtgtatgtatgagtatctgtatgtatatatrcacggtatttatagagagagactatcctggagaagcctcgttttgatgccattcttccttgcaaggttaagcaaggtgggtggaaactaagacacctgaa

SEQ ID NO: 10488 - DNA, 201 bp, Homo sapiens
atagagagagactatcctggagaagcctcgttttgatgccattcttccttgcaaggttaagcaaggtgggtggaaactaagacacctgaaccctccagggyctcccgcatcaaggtcagcatgaggacagaccacagagctgtcacttttgctccgaagctacttctccactgtcccgttcagtctgaatgctgccacaac

SEQ ID NO: 10489 - DNA, 201 bp, Homo sapiens
acgaagggatgctttctgttgtcaaaccattggactatgaaatttctgccttccacaccctgctgatcaaagtggaaaatgaagacccactcgtacccgaygtctcctacggccccagctccacagccaccgtccacatcactgtcctggatgtcaacgagggcccagtcttctacccagaccccatgatggtgaccaggc

SEQ ID NO: 10490 - DNA, 201 bp, Homo sapiens
tcatggtgacagattcagggaaaccacccatgacgaatatcacagatctcagggtacaagtgtgctcctgcaggaattccaaagtggactgcaacgcggcrggggccctgcgcttcagcctgccctcagtcctgctcctcagcctcttcagcttagcttgtctgtgagaactcctgacgtctgaagcttgactcccaagtt

SEQ ID NO: 10491 - DNA, 201 bp, Homo sapiens
tccatatcaatcagccagctgaattcattgaggaccagtcaattctaaacttgaccttcagtgactgtaagggaaacgacaagctacgctatgaggtctcvagcccatacttcaaggtgaacagcgatggcggcttagttgctctgagaaacataactgcagtgggcaaaactctgttcgtccatgcacggaccccccatg

SEQ ID NO: 10492 - DNA, 201 bp, Homo sapiens
tggaagggtcacccacaggcaccacagtgatgcggatgacagcctttgatgcagatgacccagccaccgataatgccctcctgcggtataatatccgtcarcagacgcctgacaagccatctcccaacatgttctacatcgatcctgagaaaggagacattgtcactgttgtgtcacctgcgctgctggaccgagagactc

SEQ ID NO: 10493 - DNA, 201 bp, Homo sapiens
attaacaggcacggccacagccacgatcatgatcgatgacaaaaatgatcactcaccaaaattcaccaagaaagagtttcaagccacagtcgaggaaggarctgtgggagttattgtcaatttgacagttgaagataaggatgaccccaccacaggtgcatggagggctgcctacaccatcatcaacggaaaccccgggca

SEQ ID NO: 10494 - DNA, 201 bp, Homo sapiens
cagtcgaggaaggagctgtgggagttattgtcaatttgacagttgaagataaggatgaccccaccacaggtgcatggagggctgcctacaccatcatcaayggaaaccccgggcagagctttgaaatccacaccaaccctcaaaccaacgaagggatgctttctgttgtcaaaccattggactatgaaatttctgccttcc

SEQ ID NO: 10495 - DNA, 201 bp, Homo sapiens
aacccgaaaataaaagacgttcattatgtatgaaaagtaactgatttgtattctgtgagcatgtaaaagcggaaagttagtgcttgttctaagattacctycttgttgataaaccataaatgaatcatcaaagctcacaccaaatttttctatcaaataaaactagtgacagcttgtggctttttattagagctcgccacg

SEQ ID NO: 10496 - DNA, 201 bp, Homo sapiens
ctttttctggtgtgttaacatgtcgctagccagtgctccaggcacccagctttgtctgtgggttagtattggtgtatgtatgagtatctgtatgtatatayacacggtatttatagagagagactatcctggagaagcctcgttttgatgccattcttccttgcaaggttaagcaaggtgggtggaaactaagacacctga

SEQ ID NO: 10497 - DNA, 201 bp, Homo sapiens
gcataaaatagagtaaatacaggtagttttaaaagtacccttttgtgtgaattgactaccgttgtttgcaaacccgaaaataaaagacgttcattatgtaygaaaagtaactgatttgtattctgtgagcatgtaaaagcggaaagttagtgcttgttctaagattaccttcttgttgataaaccataaatgaatcatcaa

SEQ ID NO: 10498 - DNA, 201 bp, Homo sapiens
acagtcgtactgattctaatggggacacagatcatggtagagaatctctccctcctcagtaaatgtacaactgcacctgtcatcatggaggtcatacatgsatacaaagaggtgtacaggtaccatcttgtatacacatatatacccacatgtacagacatacatttatgcacattcacgctgtttgtttcatatatacag

SEQ ID NO: 10499 - DNA, 201 bp, Homo sapiens
gatcttcacccgaatacagatcctttcaaatttgaaatccacaaacaagctgttcctgataaagtctggaagatctccaagatcaacaatacacacgccckggtaagccttcttcaaaatctgaacaaagcaaactacaacctgcccatcatggtgacagattcagggaaaccacccatgacgaatatcacagatctcagg

SEQ ID NO: 10500 - DNA, 201 bp, Homo sapiens
tttgtatgtgtcccgaatccacagtcgtactgattctaatggggacacagatcatggtagagaatctctccctcctcagtaaatgtacaactgcacctgtyatcatggaggtcatacatgcatacaaagaggtgtacaggtaccatcttgtatacacatatatacccacatgtacagacatacatttatgcacattcacgc

SEQ ID NO: 10501 - DNA, 201 bp, Homo sapiens
ctggtgtttttatggaaatggtgaaggccagtgccactgtagatattgtccagaagaagttggtttatctgtacatgtgcacatatgctcccctgaaaccrgatctggctctcctggccatcaatacgctgtgcaaagactgctcagaccccaatccaatggtgcgagggctggcgttacggagcatgtgtagcctcagga

SEQ ID NO: 10502 - DNA, 201 bp, Homo sapiens
ctgtctgttcttaacagaactgctattggagcctggaaactcagaaatgcagatctctgtgaaacaaaatgaagcaagaacggagacgctgaatagttttwtttctgtattagaaactgtgattggaacaattgaagaaataaaatcataacagagtcttgttgcttgtctagagtaagatgaataactattacactttct

SEQ ID NO: 10503 - DNA, 201 bp, Homo sapiens
ccctggtaaatgaattatacagtttgctgcgtgaccaggatccaattgtagttgtgaactgcttgaggtctctagaggaaattctgaaacaggaaggaggygttgtcatcaataagcccattgctcaccatctcttaaatcgaatgtcaaaactggaccaatggggccaggctgaagtattgaactttctgctacgctacc

SEQ ID NO: 10504 - DNA, 201 bp, Homo sapiens
ttggacttttggaggatccggcagaaagacctgtgaatagctgggcctcagacttcaacacactggtgccagtgtatggcaaagcccactgggcaactatytctaaatgccagggggcagagcgttgtgacccagagcttcctaaaacttcatcctttgccgcatcaggacccttgattcctgaagagaacaaggagaggg

SEQ ID NO: 10505 - DNA, 201 bp, Homo sapiens
tgcgagggctggcgttacggagcatgtgtagcctcaggatgcctggtgtgcaggagtatatacaacagcctattctcaatggtctgcgggataaggcttcmtatgtcaggagagtggcagtccttggatgtgccaagatgcataatcttcatggagactctgaagtagatggtgccctggtaaatgaattatacagtttgc

SEQ ID NO: 10506 - DNA, 201 bp, Homo sapiens
ggggaaagaattcctaatgctccttatgtgttagaggactttgttgagaatgtgaagtcggaaacatttccagctgttaagatggagctgctcactgcttygctgcgccttttcctctcccgacctgctgagtgccaggacatgctaggacgtttgttgtattactgcatagaggaagaaaaagatatggctgtacgggac

SEQ ID NO: 10507 - DNA, 201 bp, Homo sapiens; identical to SEQ ID NO: 10501

SEQ ID NO: 10508 - DNA, 201 bp, Homo sapiens; identical to SEQ ID NO: 10502

SEQ ID NO: 10509 - DNA, 201 bp, Homo sapiens; identical to SEQ ID NO: 10503

SEQ ID NO: 10510 - DNA, 201 bp, Homo sapiens
gaggggtctgcggtcagtcggacgcggcgctggaaatccggcggaggacctagaagtagcgggagcgatctgtgggcggggcgaacggcctgccggccgayggctcccacatcaggacgagaaggagccctcgagttaccgtgggagctgtgggagctgccctgtgactcttaggaagatgccgtaccttggctccgagga

SEQ ID NO: 10511 - DNA, 201 bp, Homo sapiens; identical to SEQ ID NO: 10504

SEQ ID NO: 10512 - DNA, 201 bp, Homo sapiens; identical to SEQ ID NO: 10505

SEQ ID NO: 10513 - DNA, 201 bp, Homo sapiens; identical to SEQ ID NO: 10506

SEQ ID NO: 10514 - DNA, 201 bp, Homo sapiens; identical to SEQ ID NO: 10501

SEQ ID NO: 10515 - DNA, 201 bp, Homo sapiens
ctgtctgttcttaacagaactgctattggagcctggaaactcagaaatgcagatctctgtgaaacaaaatgaagcaagaacggagacgctgaatagttttwtttctgtattagaaactgtgattggaacaattgaagaaataaaatcataacagagtcttgttgcttgtctagagagagccttgttcttttgatgtggcta

SEQ ID NO: 10516 - DNA, 201 bp, Homo sapiens; identical to SEQ ID NO: 10503

SEQ ID NO: 10517 - DNA, 201 bp, Homo sapiens
gtgatctcagctcactgcagcctccacctcctgggctcaagcgatcctcccactgcagcctcctgagtagctgggacttcaggcaagagctatactccagracactgtggaatctctcagcaagacctggtgtgctcaggattccagcttagcttatgagagagcttttctggcagtgtcagtgaaacttcttgagtacat

SEQ ID NO: 10518 - DNA, 201 bp, Homo sapiens; identical to SEQ ID NO: 10504

SEQ ID NO: 10519 - DNA, 201 bp, Homo sapiens; identical to SEQ ID NO: 10505

SEQ ID NO: 10520 - DNA, 201 bp, Homo sapiens; identical to SEQ ID NO: 10506

SEQ ID NO: 10521 - DNA, 119 bp, Homo sapiens
gagagctgaagagttggagctattcacgagactgaacatcacttccttgttgactgattgggtgattgattcctgggaattcaaacaaacaaataaaaaarcacttttttcattttatc

SEQ ID NO: 10522 - DNA, 201 bp, Homo sapiens; identical to SEQ ID NO: 10501

SEQ ID NO: 10523 - DNA, 201 bp, Homo sapiens; identical to SEQ ID NO: 10515

SEQ ID NO: 10524 - DNA, 201 bp, Homo sapiens; identical to SEQ ID NO: 10503

SEQ ID NO: 10525 - DNA, 201 bp, Homo sapiens; identical to SEQ ID NO: 10517

SEQ ID NO: 10526 - DNA, 201 bp, Homo sapiens; identical to SEQ ID NO: 10504

SEQ ID NO: 10527 - DNA, 201 bp, Homo sapiens; identical to SEQ ID NO: 10505

SEQ ID NO: 10528 - DNA, 201 bp, Homo sapiens; identical to SEQ ID NO: 10506

SEQ ID NO: 10529 - DNA, 119 bp, Homo sapiens; identical to SEQ ID NO: 10521

SEQ ID NO: 10530 - DNA, 201 bp, Homo sapiens
actgggattttcagtgcacttaaggtctacagatgaggagtttatttctcaaaaaaccagggaggaaattggtttagggtcccccttggtacccatgggaratgatgatggaggtccagaagccacagggaatcagagtgcctggatgggccatggttctcccctgtcccacagcagcaagggcacccctcttctagctac

SEQ ID NO: 10531 - DNA, 201 bp, Homo sapiens
cagtgactgccacaggatgggtctttcagattttggttctctttagcttctggttcttgaaagaaattaatctgtatataacataagaaactttgaaagtmaaaaaaacaaaaaattttaattcctcgtagattaattgatttgctatcttttagtttttttttctatgcatgtagatgtattaaatatgtaaatgttttt

SEQ ID NO: 10532 - DNA, 201 bp, Homo sapiens
tggccctgttcttgccccagcatgacttttatcgggacgccgttgtggaagcctcacgcaggagccctgcccccgtggagaagatcccactggtgactccraccctaccaccatgaatggggtcctgatcccccatacgcccatcgcagtggacttctggagcctgcgccgggctggcaccgcacgtctcttcttcttgtc

SEQ ID NO: 10533 - DNA, 201 bp, Homo sapiens
cttcttgtctcacatgcactcggaccacaccgtgggcctgtctagcacctgggcccggcccctctactgctccccaattacagcccacctcttgcatcgtyacctacaggtatctaagcaatggatccaagccctggaggttggtgagagccatgtattacccctagatgaaattggacaagagaccatgaccgtaaccct

SEQ ID NO: 10534 - DNA, 201 bp, Homo sapiens
gtggacttctggagcctgcgccgggctggcaccgcacgtctcttcttcttgtctcacatgcactcggaccacaccgtgggcctgtctagcacctgggccckgcccctctactgctccccaattacagcccacctcttgcatcgtcacctacaggtatctaagcaatggatccaagccctggaggttggtgagagccatgta

SEQ ID NO: 10535 - DNA, 201 bp, Homo sapiens
gacttttatcgggacgccgttgtggaagcctcacgcaggagccctgcccccgtggagaagatcccactggtgactccaaccctaccaccatgaatggggtyctgatcccccatacgcccatcgcagtggacttctggagcctgcgccgggctggcaccgcacgtctcttcttcttgtctcacatgcactcggaccacaccg

SEQ ID NO: 10536 - DNA, 178 bp, Homo sapiens
ccttcccccaacctctcactctccaggcgcagctgcgcggctccctctggtggagctgcggcgggcaatcggaaatckgctactttggcctgtctcctccctgcagcgcgcgctttgagtgcccggctcggcctccgctcccgcgcggttgggagtgtccagcgccctccgcgatttg

SEQ ID NO: 10537 - DNA, 201 bp, Homo sapiens
cccggcccctctactgctccccaattacagcccacctcttgcatcgtcacctacaggtatctaagcaatggatccaagccctggaggttggtgagagccaygtattacccctagatgaaattggacaagagaccatgaccgtaaccctcctcgatgccaatcactgtcctggttctgtcatgtttctctttgaaggatatt

SEQ ID NO: 10538 - DNA, 201 bp, Homo sapiens
gccacaggatgggtctttcagattttggttctctttagcttctggttcttgaaagaaattaatctgtatataacataagaaactttgaaagtcaaaaaaamaaaaaattttaattcctcgtagattaattgatttgctatcttttagtttttttttctatgcatgtagatgtattaaatatgtaaatgtttttcaaagttg

SEQ ID NO: 10539 - DNA, 201 bp, Homo sapiens
gatgggccatggttctcccctgtcccacagcagcaagggcacccctcttctagctactgaattcaggggtctagcactcaaatatcttctgactccagtgwactttttccaggcagggtattcttccaggagatttgaccagcaagtggaaaaataccataaaccctgctgaagacaggagagtacagaatgacaacattg

SEQ ID NO: 10540 - DNA, 201 bp, Homo sapiens
tagttcctcatctgtaagatggacttgagattcctacctctcatgattactatggagattgaataattggtaaaattctcctagctcagtgactgccacakgatgggtctttcagattttggttctctttagcttctggttcttgaaagaaattaatctgtatataacataagaaactttgaaagtcaaaaaaacaaaaaa

SEQ ID NO: 10541 - DNA, 201 bp, Homo sapiens
gctcataacctgacaaaatgccaaactagtaagcaggatagctgataccacggctatgagggagtaggctctgagagggcacagacttgtggagctgggcrtctggatcaaaactgctttgggatggaacctcgagccctagcagtgaagaagattccatttcttgtccaggggatttaaaagagttttctgctttgagag

SEQ ID NO: 10542 - DNA, 201 bp, Homo sapiens
tgcatcggggccaacctcggccactgtgctcctgccagctcggcaggcagccttgctgcaggccccctgctgctcgcgctggccctctaccccctgagcgycctgttctgagggcccagggcccgggcacccacaagcccgtgacagatgccaacttcccacacggcagcccccccctcaaggggcagggaggtgggggcc

SEQ ID NO: 10543 - DNA, 201 bp, Homo sapiens
ccaggggaacgaggtcacctccatcctgcgctgggccaaggacgctgggaaatctgtgggcattgtgaccaccacgagagtgaaccatgccacccccagcrccgcctacgcccactcggctgaccgggactggtactcagacaacgagatgccccctgaggccttgagccagggctgtaaggacatcgcctaccagctcat

SEQ ID NO: 10544 - DNA, 201 bp, Homo sapiens
cctgcatgaggcggtggagatggaccgggccatcgggcaggcaggcagcttgacctcctcggaagacactctgaccgtggtcactgcggaccattcccacrtcttcacatttggtggatacaccccccgtggcaactctatctttggtctggcccccatgctgagtgacacagacaagaagcccttcactgccatcctgta

SEQ ID NO: 10545 - DNA, 201 bp, Homo sapiens
tacaacaccaatgcccaggtccctgacagcgccggcaccgccaccgcctacctgtgtggggtgaaggccaatgagggcaccgtgggggtaagcgcagccamtgagcgttcccggtgcaacaccacccaggggaacgaggtcacctccatcctgcgctgggccaaggacgctgggaaatctgtgggcattgtgaccaccacg

SEQ ID NO: 10546 - DNA, 201 bp, Homo sapiens
accaatgcccaggtccctgacagcgccggcaccgccaccgcctacctgtgtggggtgaaggccaatgagggcaccgtgggggtaagcgcagccactgagcrttcccggtgcaacaccacccaggggaacgaggtcacctccatcctgcgctgggccaaggacgctgggaaatctgtgggcattgtgaccaccacgagagtg

SEQ ID NO: 10547 - DNA, 201 bp, Homo sapiens
cctgcgctgggccaaggacgctgggaaatctgtgggcattgtgaccaccacgagagtgaaccatgccacccccagcgccgcctacgcccactcggctgacygggactggtactcagacaacgagatgccccctgaggccttgagccagggctgtaaggacatcgcctaccagctcatgcataacatcagggacattgacgt

SEQ ID NO: 10548 - DNA, 201 bp, Homo sapiens
gggaaatctgtgggcattgtgaccaccacgagagtgaaccatgccacccccagcgccgcctacgcccactcggctgaccgggactggtactcagacaacgrgatgccccctgaggccttgagccagggctgtaaggacatcgcctaccagctcatgcataacatcagggacattgacgtgatcatggggggtggccggaaa

SEQ ID NO: 10549 - DNA, 201 bp, Homo sapiens
agagtgaaccatgccacccccagcgccgcctacgcccactcggctgaccgggactggtactcagacaacgagatgccccctgaggccttgagccagggctrtaaggacatcgcctaccagctcatgcataacatcagggacattgacgtgatcatggggggtggccggaaatacatgtaccccaagaataaaactgatgtg

SEQ ID NO: 10550 - DNA, 201 bp, Homo sapiens
aaggacatcgcctaccagctcatgcataacatcagggacattgacgtgatcatggggggtggccggaaatacatgtaccccaagaataaaactgatgtggrgtatgagagtgacgagaaagccaggggcacgaggctggacggcctggacctcgttgacacctggaagagcttcaaaccgagatacaagcactcccacttc

SEQ ID NO: 10551 - DNA, 201 bp, Homo sapiens
cgaggtcacctccatcctgcgctgggccaaggacgctgggaaatctgtgggcattgtgaccaccacgagagtgaaccatgccacccccagcgccgcctacrcccactcggctgaccgggactggtactcagacaacgagatgccccctgaggccttgagccagggctgtaaggacatcgcctaccagctcatgcataacat

SEQ ID NO: 10552 - DNA, 201 bp, Homo sapiens
ggggaacgaggtcacctccatcctgcgctgggccaaggacgctgggaaatctgtgggcattgtgaccaccacgagagtgaaccatgccacccccagcgccrcctacgcccactcggctgaccgggactggtactcagacaacgagatgccccctgaggccttgagccagggctgtaaggacatcgcctaccagctcatgca

SEQ ID NO: 10553 - DNA, 201 bp, Homo sapiens
ctggcgagaccaagcgcaagagacactgaaatatgccctggagcttcagaagctcaacaccaacgtggctaagaatgtcatcatgttcctgggagatgggwtgggtgtctccacagtgacggctgcccgcatcctcaagggtcagctccaccacaaccctggggaggagaccaggctggagatggacaagttccccttcgt

SEQ ID NO: 10554 - DNA, 201 bp, Homo sapiens
cgagaccaagcgcaagagacactgaaatatgccctggagcttcagaagctcaacaccaacgtggctaagaatgtcatcatgttcctgggagatgggatggktgtctccacagtgacggctgcccgcatcctcaagggtcagctccaccacaaccctggggaggagaccaggctggagatggacaagttccccttcgtggcc

SEQ ID NO: 10555 - DNA, 201 bp, Homo sapiens
gagacactgaaatatgccctggagcttcagaagctcaacaccaacgtggctaagaatgtcatcatgttcctgggagatgggatgggtgtctccacagtgayggctgcccgcatcctcaagggtcagctccaccacaaccctggggaggagaccaggctggagatggacaagttccccttcgtggccctctccaagacgtac

SEQ ID NO: 10556 - DNA, 201 bp, Homo sapiens
gtgacggctgcccgcatcctcaagggtcagctccaccacaaccctggggaggagaccaggctggagatggacaagttccccttcgtggccctctccaagaygtacaacaccaatgcccaggtccctgacagcgccggcaccgccaccgcctacctgtgtggggtgaaggccaatgagggcaccgtgggggtaagcgcagcc

SEQ ID NO: 10557 - DNA, 201 bp, Homo sapiens
tgtggggtgaaggccaatgagggcaccgtgggggtaagcgcagccactgagcgttcccggtgcaacaccacccaggggaacgaggtcacctccatcctgcrctgggccaaggacgctgggaaatctgtgggcattgtgaccaccacgagagtgaaccatgccacccccagcgccgcctacgcccactcggctgaccgggac

SEQ ID NO: 10558 - DNA, 201 bp, Homo sapiens
ggggtaagcgcagccactgagcgttcccggtgcaacaccacccaggggaacgaggtcacctccatcctgcgctgggccaaggacgctgggaaatctgtggkcattgtgaccaccacgagagtgaaccatgccacccccagcgccgcctacgcccactcggctgaccgggactggtactcagacaacgagatgccccctgag

SEQ ID NO: 10559 - DNA, 201 bp, Homo sapiens
ctacgcccactcggctgaccgggactggtactcagacaacgagatgccccctgaggccttgagccagggctgtaaggacatcgcctaccagctcatgcatracatcagggacattgacgtgatcatggggggtggccggaaatacatgtaccccaagaataaaactgatgtggagtatgagagtgacgagaaagccagggg

SEQ ID NO: 10560 - DNA, 201 bp, Homo sapiens
cgcccactcggctgaccgggactggtactcagacaacgagatgccccctgaggccttgagccagggctgtaaggacatcgcctaccagctcatgcataacwtcagggacattgacgtgatcatggggggtggccggaaatacatgtaccccaagaataaaactgatgtggagtatgagagtgacgagaaagccaggggcac

SEQ ID NO: 10561 - DNA, 201 bp, Homo sapiens
tactcagacaacgagatgccccctgaggccttgagccagggctgtaaggacatcgcctaccagctcatgcataacatcagggacattgacgtgatcatggkgggtggccggaaatacatgtaccccaagaataaaactgatgtggagtatgagagtgacgagaaagccaggggcacgaggctggacggcctggacctcgtt

SEQ ID NO: 10562 - DNA, 201 bp, Homo sapiens
gggacattgacgtgatcatggggggtggccggaaatacatgtaccccaagaataaaactgatgtggagtatgagagtgacgagaaagccaggggcacgagkctggacggcctggacctcgttgacacctggaagagcttcaaaccgagatacaagcactcccacttcatctggaaccgcacggaactcctgacccttgacc

SEQ ID NO: 10563 - DNA, 201 bp, Homo sapiens
gaataaaactgatgtggagtatgagagtgacgagaaagccaggggcacgaggctggacggcctggacctcgttgacacctggaagagcttcaaaccgagayacaagcactcccacttcatctggaaccgcacggaactcctgacccttgacccccacaatgtggactacctattgggtctcttcgagccaggggacatgca

SEQ ID NO: 10564 - DNA, 201 bp, Homo sapiens
acggaactcctgacccttgacccccacaatgtggactacctattgggtctcttcgagccaggggacatgcagtacgagctgaacaggaacaacgtgacggwcccgtcactctccgagatggtggtggtggccatccagatcctgcggaagaaccccaaaggcttcttcttgctggtggaaggaggcagaattgaccacggg

SEQ ID NO: 10565 - DNA, 201 bp, Homo sapiens
gccaagcaggccctgcatgaggcggtggagatggaccgggccatcgggcaggcaggcagcttgacctcctcggaagacactctgaccgtggtcactgcggwccattcccacgtcttcacatttggtggatacaccccccgtggcaactctatctttggtctggcccccatgctgagtgacacagacaagaagcccttcact

SEQ ID NO: 10566 - DNA, 201 bp, Homo sapiens
aagttccccttcgtggccctctccaagacgtacaacaccaatgcccaggtccctgacagcgccggcaccgccaccgcctacctgtgtggggtgaaggccartgagggcaccgtgggggtaagcgcagccactgagcgttcccggtgcaacaccacccaggggaacgaggtcacctccatcctgcgctgggccaaggacgct

SEQ ID NO: 10567 - DNA, 201 bp, Homo sapiens
ggaagaaccccaaaggcttcttcttgctggtggaaggaggcagaattgaccacgggcaccatgaaggaaaagccaagcaggccctgcatgaggcggtggasatggaccgggccatcgggcaggcaggcagcttgacctcctcggaagacactctgaccgtggtcactgcggaccattcccacgtcttcacatttggtggat

SEQ ID NO: 10568 - DNA, 201 bp, Homo sapiens
aaagccaagcaggccctgcatgaggcggtggagatggaccgggccatcgggcaggcaggcagcttgacctcctcggaagacactctgaccgtggtcactgyggaccattcccacgtcttcacatttggtggatacaccccccgtggcaactctatctttggtctggcccccatgctgagtgacacagacaagaagcccttc

SEQ ID NO: 10569 - DNA, 201 bp, Homo sapiens
gcctcttatttttctagcgaacgtatttctccagacccagaggccctgaagcctccgtggaacattctggatctgaccctcccagtctcatctcctgaccytcccactcccatctccttacctctggaaccccccaggccctacaatgctcatgtccctgtccccaggcccagccctccttcaggggagttgaggtctttc

SEQ ID NO: 10570 - DNA, 201 bp, Homo sapiens
caacgagatgccccctgaggccttgagccagggctgtaaggacatcgcctaccagctcatgcataacatcagggacattgacgtgatcatggggggtggcyggaaatacatgtaccccaagaataaaactgatgtggagtatgagagtgacgagaaagccaggggcacgaggctggacggcctggacctcgttgacacctg

SEQ ID NO: 10571 - DNA, 201 bp, Homo sapiens
cgagatgccccctgaggccttgagccagggctgtaaggacatcgcctaccagctcatgcataacatcagggacattgacgtgatcatggggggtggccggraatacatgtaccccaagaataaaactgatgtggagtatgagagtgacgagaaagccaggggcacgaggctggacggcctggacctcgttgacacctggaa

SEQ ID NO: 10572 - DNA, 201 bp, Homo sapiens
gagagtgacgagaaagccaggggcacgaggctggacggcctggacctcgttgacacctggaagagcttcaaaccgagatacaagcactcccacttcatctrgaaccgcacggaactcctgacccttgacccccacaatgtggactacctattgggtctcttcgagccaggggacatgcagtacgagctgaacaggaacaac

SEQ ID NO: 10573 - DNA, 201 bp, Homo sapiens
ctggaagagcttcaaaccgagatacaagcactcccacttcatctggaaccgcacggaactcctgacccttgacccccacaatgtggactacctattgggtytcttcgagccaggggacatgcagtacgagctgaacaggaacaacgtgacggacccgtcactctccgagatggtggtggtggccatccagatcctgcggaa

SEQ ID NO: 10574 - DNA, 201 bp, Homo sapiens
gagcttcaaaccgagatacaagcactcccacttcatctggaaccgcacggaactcctgacccttgacccccacaatgtggactacctattgggtctcttcdagccaggggacatgcagtacgagctgaacaggaacaacgtgacggacccgtcactctccgagatggtggtggtggccatccagatcctgcggaagaaccc

SEQ ID NO: 10575 - DNA, 201 bp, Homo sapiens
tccaccacaaccctggggaggagaccaggctggagatggacaagttccccttcgtggccctctccaagacgtacaacaccaatgcccaggtccctgacagygccggcaccgccaccgcctacctgtgtggggtgaaggccaatgagggcaccgtgggggtaagcgcagccactgagcgttcccggtgcaacaccacccagg

SEQ ID NO: 10576 - DNA, 201 bp, Homo sapiens
ccgagatacaagcactcccacttcatctggaaccgcacggaactcctgacccttgacccccacaatgtggactacctattgggtctcttcgagccaggggmcatgcagtacgagctgaacaggaacaacgtgacggacccgtcactctccgagatggtggtggtggccatccagatcctgcggaagaaccccaaaggcttc

SEQ ID NO: 10577 - DNA, 201 bp, Homo sapiens
accgagatacaagcactcccacttcatctggaaccgcacggaactcctgacccttgacccccacaatgtggactacctattgggtctcttcgagccagggkacatgcagtacgagctgaacaggaacaacgtgacggacccgtcactctccgagatggtggtggtggccatccagatcctgcggaagaaccccaaaggctt

SEQ ID NO: 10578 - DNA, 201 bp, Homo sapiens
gagatacaagcactcccacttcatctggaaccgcacggaactcctgacccttgacccccacaatgtggactacctattgggtctcttcgagccaggggacrtgcagtacgagctgaacaggaacaacgtgacggacccgtcactctccgagatggtggtggtggccatccagatcctgcggaagaaccccaaaggcttctt

SEQ ID NO: 10579 - DNA, 201 bp, Homo sapiens
aggggacatgcagtacgagctgaacaggaacaacgtgacggacccgtcactctccgagatggtggtggtggccatccagatcctgcggaagaaccccaaasgcttcttcttgctggtggaaggaggcagaattgaccacgggcaccatgaaggaaaagccaagcaggccctgcatgaggcggtggagatggaccgggccat

SEQ ID NO: 10580 - DNA, 201 bp, Homo sapiens
gacatgcagtacgagctgaacaggaacaacgtgacggacccgtcactctccgagatggtggtggtggccatccagatcctgcggaagaaccccaaaggctkcttcttgctggtggaaggaggcagaattgaccacgggcaccatgaaggaaaagccaagcaggccctgcatgaggcggtggagatggaccgggccatcggg

SEQ ID NO: 10581 - DNA, 201 bp, Homo sapiens
ggtggccatccagatcctgcggaagaaccccaaaggcttcttcttgctggtggaaggaggcagaattgaccacgggcaccatgaaggaaaagccaagcagrccctgcatgaggcggtggagatggaccgggccatcgggcaggcaggcagcttgacctcctcggaagacactctgaccgtggtcactgcggaccattccca

SEQ ID NO: 10582 - DNA, 201 bp, Homo sapiens
gccctgcatgaggcggtggagatggaccgggccatcgggcaggcaggcagcttgacctcctcggaagacactctgaccgtggtcactgcggaccattcccrcgtcttcacatttggtggatacaccccccgtggcaactctatctttggtctggcccccatgctgagtgacacagacaagaagcccttcactgccatcctg

SEQ ID NO: 10583 - DNA, 201 bp, Homo sapiens
tgggaaatctgtgggcattgtgaccaccacgagagtgaaccatgccacccccagcgccgcctacgcccactcggctgaccgggactggtactcagacaacragatgccccctgaggccttgagccagggctgtaaggacatcgcctaccagctcatgcataacatcagggacattgacgtgatcatggggggtggccggaa

SEQ ID NO: 10584 - DNA, 201 bp, Homo sapiens
acgagagaatgtctccatggtggactatgctcacaacaactaccaggcgcagtctgctgtgcccctgcgccacgagacccacggcggggaggacgtggccrtcttctccaagggccccatggcgcacctgctgcacggcgtccacgagcagaactacgtcccccacgtgatggcgtatgcagcctgcatcggggccaacct

SEQ ID NO: 10585 - DNA, 201 bp, Homo sapiens
acatttggtggatacaccccccgtggcaactctatctttggtctggcccccatgctgagtgacacagacaagaagcccttcactgccatcctgtatggcartgggcctggctacaaggtggtgggcggtgaacgagagaatgtctccatggtggactatgctcacaacaactaccaggcgcagtctgctgtgcccctgcgc

SEQ ID NO: 10586 - DNA, 201 bp, Homo sapiens
caactaccaggcgcagtctgctgtgcccctgcgccacgagacccacggcggggaggacgtggccgtcttctccaagggccccatggcgcacctgctgcacrgcgtccacgagcagaactacgtcccccacgtgatggcgtatgcagcctgcatcggggccaacctcggccactgtgctcctgccagctcggcaggcagcct

SEQ ID NO: 10587 - DNA, 201 bp, Homo sapiens
ccccgtggcaactctatctttggtctggcccccatgctgagtgacacagacaagaagcccttcactgccatcctgtatggcaatgggcctggctacaaggyggtgggcggtgaacgagagaatgtctccatggtggactatgctcacaacaactaccaggcgcagtctgctgtgcccctgcgccacgagacccacggcggg

SEQ ID NO: 10588 - DNA, 201 bp, Homo sapiens
cggtgaacgagagaatgtctccatggtggactatgctcacaacaactaccaggcgcagtctgctgtgcccctgcgccacgagacccacggcggggaggacrtggccgtcttctccaagggccccatggcgcacctgctgcacggcgtccacgagcagaactacgtcccccacgtgatggcgtatgcagcctgcatcggggc

SEQ ID NO: 10589 - DNA, 201 bp, Homo sapiens
gcgcagtctgctgtgcccctgcgccacgagacccacggcggggaggacgtggccgtcttctccaagggccccatggcgcacctgctgcacggcgtccacgrgcagaactacgtcccccacgtgatggcgtatgcagcctgcatcggggccaacctcggccactgtgctcctgccagctcggcaggcagccttgctgcaggc

SEQ ID NO: 10590 - DNA, 201 bp, Homo sapiens
ggaggacgtggccgtcttctccaagggccccatggcgcacctgctgcacggcgtccacgagcagaactacgtcccccacgtgatggcgtatgcagcctgcwtcggggccaacctcggccactgtgctcctgccagctcggcaggcagccttgctgcaggccccctgctgctcgcgctggccctctaccccctgagcgtcct

SEQ ID NO: 10591 - DNA, 201 bp, Homo sapiens
ggtggtgggcggtgaacgagagaatgtctccatggtggactatgctcacaacaactaccaggcgcagtctgctgtgcccctgcgccacgagacccacggcrgggaggacgtggccgtcttctccaagggccccatggcgcacctgctgcacggcgtccacgagcagaactacgtcccccacgtgatggcgtatgcagcctg

SEQ ID NO: 10592 - DNA, 201 bp, Homo sapiens
gtactggccattggcacctgccttactaactccttagtgccagagaaagagaaagaccccaagtactggcgagaccaagcgcaagagacactgaaatatgycctggagcttcagaagctcaacaccaacgtggctaagaatgtcatcatgttcctgggagatgggatgggtgtctccacagtgacggctgcccgcatcctc

SEQ ID NO: 10593 - DNA, 201 bp, Homo sapiens
aaagtctgccgcccacctcgctcccctctggaatcttccccaagggccaaacccacttctggcctccagcctttgctccctccccgctgccctttggccamcagggtagatttctcttgggcaggcagagagtacagactgcagacattctcaaagcctcttatttttctagcgaacgtatttctccagacccagaggccc

SEQ ID NO: 10594 - DNA, 201 bp, Homo sapiens
ggagcttcagaagctcaacaccaacgtggctaagaatgtcatcatgttcctgggagatgggatgggtgtctccacagtgacggctgcccgcatcctcaagrgtcagctccaccacaaccctggggaggagaccaggctggagatggacaagttccccttcgtggccctctccaagacgtacaacaccaatgcccaggtccc

SEQ ID NO: 10595 - DNA, 201 bp, Homo sapiens
gcgctggccctctaccccctgagcgtcctgttctgagggcccagggcccgggcacccacaagcccgtgacagatgccaacttcccacacggcagccccccyctcaaggggcagggaggtgggggcctcctcagcctctgcaactgcaagaaaggggacccaggaaaccaaagtctgccgcccacctcgctcccctctggaa

SEQ ID NO: 10596 - DNA, 201 bp, Homo sapiens
gcccgtgacagatgccaacttcccacacggcagcccccccctcaaggggcagggaggtgggggcctcctcagcctctgcaactgcaagaaaggggacccargaaaccaaagtctgccgcccacctcgctcccctctggaatcttccccaagggccaaacccacttctggcctccagcctttgctccctccccgctgccctt

SEQ ID NO: 10597 - DNA, 201 bp, Homo sapiens
ggaggagaccaggctggagatggacaagttccccttcgtggccctctccaagacgtacaacaccaatgcccaggtccctgacagcgccggcaccgccaccrcctacctgtgtggggtgaaggccaatgagggcaccgtgggggtaagcgcagccactgagcgttcccggtgcaacaccacccaggggaacgaggtcacctc

SEQ ID NO: 10598 - DNA, 201 bp, Homo sapiens
gctggagatggacaagttccccttcgtggccctctccaagacgtacaacaccaatgcccaggtccctgacagcgccggcaccgccaccgcctacctgtgtrgggtgaaggccaatgagggcaccgtgggggtaagcgcagccactgagcgttcccggtgcaacaccacccaggggaacgaggtcacctccatcctgcgctg

SEQ ID NO: 10599 - DNA, 201 bp, Homo sapiens
ggccctctccaagacgtacaacaccaatgcccaggtccctgacagcgccggcaccgccaccgcctacctgtgtggggtgaaggccaatgagggcaccgtgrgggtaagcgcagccactgagcgttcccggtgcaacaccacccaggggaacgaggtcacctccatcctgcgctgggccaaggacgctgggaaatctgtggg

SEQ ID NO: 10600 - DNA, 201 bp, Homo sapiens
ggacatgcagtacgagctgaacaggaacaacgtgacggacccgtcactctccgagatggtggtggtggccatccagatcctgcggaagaaccccaaaggcytcttcttgctggtggaaggaggcagaattgaccacgggcaccatgaaggaaaagccaagcaggccctgcatgaggcggtggagatggaccgggccatcgg

SEQ ID NO: 10601 - DNA, 201 bp, Homo sapiens
aggaacaacgtgacggacccgtcactctccgagatggtggtggtggccatccagatcctgcggaagaaccccaaaggcttcttcttgctggtggaaggagrcagaattgaccacgggcaccatgaaggaaaagccaagcaggccctgcatgaggcggtggagatggaccgggccatcgggcaggcaggcagcttgacctcc

SEQ ID NO: 10602 - DNA, 201 bp, Homo sapiens
ggccatcgggcaggcaggcagcttgacctcctcggaagacactctgaccgtggtcactgcggaccattcccacgtcttcacatttggtggatacacccccygtggcaactctatctttggtctggcccccatgctgagtgacacagacaagaagcccttcactgccatcctgtatggcaatgggcctggctacaaggtggt

SEQ ID NO: 10603 - DNA, 201 bp, Homo sapiens
gccatcgggcaggcaggcagcttgacctcctcggaagacactctgaccgtggtcactgcggaccattcccacgtcttcacatttggtggatacaccccccrtggcaactctatctttggtctggcccccatgctgagtgacacagacaagaagcccttcactgccatcctgtatggcaatgggcctggctacaaggtggtg

SEQ ID NO: 10604 - DNA, 201 bp, Homo sapiens
gacctcctcggaagacactctgaccgtggtcactgcggaccattcccacgtcttcacatttggtggatacaccccccgtggcaactctatctttggtctgkcccccatgctgagtgacacagacaagaagcccttcactgccatcctgtatggcaatgggcctggctacaaggtggtgggcggtgaacgagagaatgtctc

SEQ ID NO: 10605 - DNA, 201 bp, Homo sapiens
cccacgtgatggcgtatgcagcctgcatcggggccaacctcggccactgtgctcctgccagctcggcaggcagccttgctgcaggccccctgctgctcgckctggccctctaccccctgagcgtcctgttctgagggcccagggcccgggcacccacaagcccgtgacagatgccaacttcccacacggcagcccccccct

SEQ ID NO: 10606 - DNA, 201 bp, Homo sapiens
gagtgacacagacaagaagcccttcactgccatcctgtatggcaatgggcctggctacaaggtggtgggcggtgaacgagagaatgtctccatggtggacyatgctcacaacaactaccaggcgcagtctgctgtgcccctgcgccacgagacccacggcggggaggacgtggccgtcttctccaagggccccatggcgca

SEQ ID NO: 10607 - DNA, 201 bp, Homo sapiens
gacgtgatcatggggggtggccggaaatacatgtaccccaagaataaaactgatgtggagtatgagagtgacgagaaagccaggggcacgaggctggacgkcctggacctcgttgacacctggaagagcttcaaaccgagatacaagcactcccacttcatctggaaccgcacggaactcctgacccttgacccccacaat

SEQ ID NO: 10608 - DNA, 201 bp, Homo sapiens
ggcgcagtctgctgtgcccctgcgccacgagacccacggcggggaggacgtggccgtcttctccaagggccccatggcgcacctgctgcacggcgtccacragcagaactacgtcccccacgtgatggcgtatgcagcctgcatcggggccaacctcggccactgtgctcctgccagctcggcaggcagccttgctgcagg

SEQ ID NO: 10609 - DNA, 201 bp, Homo sapiens
tctgctgtgcccctgcgccacgagacccacggcggggaggacgtggccgtcttctccaagggccccatggcgcacctgctgcacggcgtccacgagcagawctacgtcccccacgtgatggcgtatgcagcctgcatcggggccaacctcggccactgtgctcctgccagctcggcaggcagccttgctgcaggccccctg

SEQ ID NO: 10610 - DNA, 201 bp, Homo sapiens
ggggaggacgtggccgtcttctccaagggccccatggcgcacctgctgcacggcgtccacgagcagaactacgtcccccacgtgatggcgtatgcagcctscatcggggccaacctcggccactgtgctcctgccagctcggcaggcagccttgctgcaggccccctgctgctcgcgctggccctctaccccctgagcgtc

SEQ ID NO: 10611 - DNA, 201 bp, Homo sapiens
tggcacctgccttactaactccttagtgccagagaaagagaaagaccccaagtactggcgagaccaagcgcaagagacactgaaatatgccctggagcttyagaagctcaacaccaacgtggctaagaatgtcatcatgttcctgggagatgggatgggtgtctccacagtgacggctgcccgcatcctcaagggtcagct

SEQ ID NO: 10612 - DNA, 201 bp, Homo sapiens
cgtggccctctccaagacgtacaacaccaatgcccaggtccctgacagcgccggcaccgccaccgcctacctgtgtggggtgaaggccaatgagggcaccrtgggggtaagcgcagccactgagcgttcccggtgcaacaccacccaggggaacgaggtcacctccatcctgcgctgggccaaggacgctgggaaatctgt

SEQ ID NO: 10613 - DNA, 201 bp, Homo sapiens
ggacgtggccgtcttctccaagggccccatggcgcacctgctgcacggcgtccacgagcagaactacgtcccccacgtgatggcgtatgcagcctgcatcrgggccaacctcggccactgtgctcctgccagctcggcaggcagccttgctgcaggccccctgctgctcgcgctggccctctaccccctgagcgtcctgtt

SEQ ID NO: 10614 - DNA, 201 bp, Homo sapiens
cttcagaagctcaacaccaacgtggctaagaatgtcatcatgttcctgggagatgggatgggtgtctccacagtgacggctgcccgcatcctcaagggtcrgctccaccacaaccctggggaggagaccaggctggagatggacaagttccccttcgtggccctctccaagacgtacaacaccaatgcccaggtccctgac

SEQ ID NO: 10615 - DNA, 201 bp, Homo sapiens
aagacgtacaacaccaatgcccaggtccctgacagcgccggcaccgccaccgcctacctgtgtggggtgaaggccaatgagggcaccgtgggggtaagcgyagccactgagcgttcccggtgcaacaccacccaggggaacgaggtcacctccatcctgcgctgggccaaggacgctgggaaatctgtgggcattgtgacc

SEQ ID NO: 10616 - DNA, 201 bp, Homo sapiens
aacgagatgccccctgaggccttgagccagggctgtaaggacatcgcctaccagctcatgcataacatcagggacattgacgtgatcatggggggtggccrgaaatacatgtaccccaagaataaaactgatgtggagtatgagagtgacgagaaagccaggggcacgaggctggacggcctggacctcgttgacacctgg

SEQ ID NO: 10617 - DNA, 201 bp, Homo sapiens
ggacccgtcactctccgagatggtggtggtggccatccagatcctgcggaagaaccccaaaggcttcttcttgctggtggaaggaggcagaattgaccacrggcaccatgaaggaaaagccaagcaggccctgcatgaggcggtggagatggaccgggccatcgggcaggcaggcagcttgacctcctcggaagacactct

SEQ ID NO: 10618 - DNA, 201 bp, Homo sapiens
ccacgtcttcacatttggtggatacaccccccgtggcaactctatctttggtctggcccccatgctgagtgacacagacaagaagcccttcactgccatcmtgtatggcaatgggcctggctacaaggtggtgggcggtgaacgagagaatgtctccatggtggactatgctcacaacaactaccaggcgcagtctgctgt

SEQ ID NO: 10619 - DNA, 201 bp, Homo sapiens
cctggggaggagaccaggctggagatggacaagttccccttcgtggccctctccaagacgtacaacaccaatgcccaggtccctgacagcgccggcaccgscaccgcctacctgtgtggggtgaaggccaatgagggcaccgtgggggtaagcgcagccactgagcgttcccggtgcaacaccacccaggggaacgaggtc

SEQ ID NO: 10620 - DNA, 201 bp, Homo sapiens
cggtgcaacaccacccaggggaacgaggtcacctccatcctgcgctgggccaaggacgctgggaaatctgtgggcattgtgaccaccacgagagtgaaccrtgccacccccagcgccgcctacgcccactcggctgaccgggactggtactcagacaacgagatgccccctgaggccttgagccagggctgtaaggacatc

SEQ ID NO: 10621 - DNA, 201 bp, Homo sapiens
acctccatcctgcgctgggccaaggacgctgggaaatctgtgggcattgtgaccaccacgagagtgaaccatgccacccccagcgccgcctacgcccactyggctgaccgggactggtactcagacaacgagatgccccctgaggccttgagccagggctgtaaggacatcgcctaccagctcatgcataacatcagggac

SEQ ID NO: 10622 - DNA, 201 bp, Homo sapiens
ctgaagcctccgtggaacattctggatctgaccctcccagtctcatctcctgaccctcccactcccatctccttacctctggaaccccccaggccctacartgctcatgtccctgtccccaggcccagccctccttcaggggagttgaggtctttctcctcaggacaaggccttgctcactcactcactccaagaccacca

SEQ ID NO: 10623 - DNA, 201 bp, Homo sapiens; identical to SEQ ID NO: 10542

SEQ ID NO: 10624 - DNA, 201 bp, Homo sapiens; identical to SEQ ID NO: 10543

SEQ ID NO: 10625 - DNA, 201 bp, Homo sapiens; identical to SEQ ID NO: 10544

SEQ ID NO: 10626 - DNA, 201 bp, Homo sapiens; identical to SEQ ID NO: 10545

SEQ ID NO: 10627 - DNA, 201 bp, Homo sapiens; identical to SEQ ID NO: 10546

SEQ ID NO: 10628 - DNA, 201 bp, Homo sapiens; identical to SEQ ID NO: 10547

SEQ ID NO: 10629 - DNA, 201 bp, Homo sapiens; identical to SEQ ID NO: 10548

SEQ ID NO: 10630 - DNA, 201 bp, Homo sapiens; identical to SEQ ID NO: 10549

SEQ ID NO: 10631 - DNA, 201 bp, Homo sapiens; identical to SEQ ID NO: 10550

SEQ ID NO: 10632 - DNA, 201 bp, Homo sapiens; identical to SEQ ID NO: 10551

SEQ ID NO: 10633 - DNA, 201 bp, Homo sapiens; identical to SEQ ID NO: 10552

SEQ ID NO: 10634 - DNA, 201 bp, Homo sapiens; identical to SEQ ID NO: 10553

SEQ ID NO: 10635 - DNA, 201 bp, Homo sapiens; identical to SEQ ID NO: 10554

SEQ ID NO: 10636 - DNA, 201 bp, Homo sapiens; identical to SEQ ID NO: 10555

SEQ ID NO: 10637 - DNA, 201 bp, Homo sapiens; identical to SEQ ID NO: 10556

SEQ ID NO: 10638 - DNA, 201 bp, Homo sapiens; identical to SEQ ID NO: 10557

SEQ ID NO: 10639 - DNA, 201 bp, Homo sapiens; identical to SEQ ID NO: 10558

SEQ ID NO: 10640 - DNA, 201 bp, Homo sapiens; identical to SEQ ID NO: 10559

SEQ ID NO: 10641 - DNA, 201 bp, Homo sapiens; identical to SEQ ID NO: 10560

SEQ ID NO: 10642 - DNA, 201 bp, Homo sapiens; identical to SEQ ID NO: 10561

SEQ ID NO: 10643 - DNA, 201 bp, Homo sapiens; identical to SEQ ID NO: 10562

SEQ ID NO: 10644 - DNA, 201 bp, Homo sapiens; identical to SEQ ID NO: 10563

SEQ ID NO: 10645 - DNA, 201 bp, Homo sapiens; identical to SEQ ID NO: 10564

SEQ ID NO: 10646 - DNA, 201 bp, Homo sapiens; identical to SEQ ID NO: 10565

SEQ ID NO: 10647 - DNA, 201 bp, Homo sapiens; identical to SEQ ID NO: 10566

SEQ ID NO: 10648 - DNA, 201 bp, Homo sapiens; identical to SEQ ID NO: 10567

SEQ ID NO: 10649 - DNA, 201 bp, Homo sapiens; identical to SEQ ID NO: 10568

SEQ ID NO: 10650 - DNA, 201 bp, Homo sapiens; identical to SEQ ID NO: 10569

SEQ ID NO: 10651 - DNA, 201 bp, Homo sapiens; identical to SEQ ID NO: 10570

SEQ ID NO: 10652 - DNA, 201 bp, Homo sapiens; identical to SEQ ID NO: 10571

SEQ ID NO: 10653 - DNA, 201 bp, Homo sapiens; identical to SEQ ID NO: 10572

SEQ ID NO: 10654 - DNA, 201 bp, Homo sapiens; identical to SEQ ID NO: 10573

SEQ ID NO: 10655 - DNA, 201 bp, Homo sapiens; identical to SEQ ID NO: 10574

SEQ ID NO: 10656 - DNA, 201 bp, Homo sapiens; identical to SEQ ID NO: 10575

SEQ ID NO: 10657 - DNA, 201 bp, Homo sapiens; identical to SEQ ID NO: 10576

SEQ ID NO: 10658 - DNA, 201 bp, Homo sapiens; identical to SEQ ID NO: 10577

SEQ ID NO: 10659 - DNA, 201 bp, Homo sapiens; identical to SEQ ID NO: 10578

SEQ ID NO: 10660 - DNA, 201 bp, Homo sapiens; identical to SEQ ID NO: 10579

SEQ ID NO: 10661 - DNA, 201 bp, Homo sapiens; identical to SEQ ID NO: 10580

SEQ ID NO: 10662 - DNA, 201 bp, Homo sapiens; identical to SEQ ID NO: 10581

SEQ ID NO: 10663 - DNA, 201 bp, Homo sapiens; identical to SEQ ID NO: 10582

SEQ ID NO: 10664 - DNA, 201 bp, Homo sapiens; identical to SEQ ID NO: 10583

SEQ ID NO: 10665 - DNA, 201 bp, Homo sapiens; identical to SEQ ID NO: 10584

SEQ ID NO: 10666 - DNA, 201 bp, Homo sapiens; identical to SEQ ID NO: 10585

SEQ ID NO: 10667 - DNA, 201 bp, Homo sapiens; identical to SEQ ID NO: 10586

SEQ ID NO: 10668 - DNA, 201 bp, Homo sapiens; identical to SEQ ID NO: 10587

SEQ ID NO: 10669 - DNA, 201 bp, Homo sapiens; identical to SEQ ID NO: 10588

SEQ ID NO: 10670 - DNA, 201 bp, Homo sapiens; identical to SEQ ID NO: 10589

SEQ ID NO: 10671 - DNA, 201 bp, Homo sapiens; identical to SEQ ID NO: 10590

SEQ ID NO: 10672 - DNA, 201 bp, Homo sapiens; identical to SEQ ID NO: 10591

SEQ ID NO: 10673 - DNA, 201 bp, Homo sapiens; identical to SEQ ID NO: 10592

SEQ ID NO: 10674 - DNA, 201 bp, Homo sapiens; identical to SEQ ID NO: 10593

SEQ ID NO: 10675 - DNA, 201 bp, Homo sapiens; identical to SEQ ID NO: 10594

SEQ ID NO: 10676 - DNA, 201 bp, Homo sapiens; identical to SEQ ID NO: 10595

SEQ ID NO: 10677 - DNA, 201 bp, Homo sapiens; identical to SEQ ID NO: 10596

SEQ ID NO: 10678 - DNA, 201 bp, Homo sapiens; identical to SEQ ID NO: 10597

SEQ ID NO: 10679 - DNA, 201 bp, Homo sapiens; identical to SEQ ID NO: 10598

SEQ ID NO: 10680 - DNA, 201 bp, Homo sapiens; identical to SEQ ID NO: 10599

SEQ ID NO: 10681 - DNA, 201 bp, Homo sapiens; identical to SEQ ID NO: 10600

SEQ ID NO: 10682 - DNA, 201 bp, Homo sapiens; identical to SEQ ID NO: 10601

SEQ ID NO: 10683 - DNA, 201 bp, Homo sapiens; identical to SEQ ID NO: 10602

SEQ ID NO: 10684 - DNA, 201 bp, Homo sapiens; identical to SEQ ID NO: 10603

SEQ ID NO: 10685 - DNA, 201 bp, Homo sapiens; identical to SEQ ID NO: 10604

SEQ ID NO: 10686 - DNA, 201 bp, Homo sapiens; identical to SEQ ID NO: 10605

SEQ ID NO: 10687 - DNA, 201 bp, Homo sapiens; identical to SEQ ID NO: 10606

SEQ ID NO: 10688 - DNA, 201 bp, Homo sapiens; identical to SEQ ID NO: 10607

SEQ ID NO: 10689 - DNA, 201 bp, Homo sapiens; identical to SEQ ID NO: 10608

SEQ ID NO: 10690 - DNA, 201 bp, Homo sapiens; identical to SEQ ID NO: 10609

SEQ ID NO: 10691 - DNA, 201 bp, Homo sapiens; identical to SEQ ID NO: 10610

SEQ ID NO: 10692 - DNA, 201 bp, Homo sapiens; identical to SEQ ID NO: 10611

SEQ ID NO: 10693 - DNA, 201 bp, Homo sapiens; identical to SEQ ID NO: 10612

SEQ ID NO: 10694 - DNA, 201 bp, Homo sapiens; identical to SEQ ID NO: 10613

SEQ ID NO: 10695 - DNA, 201 bp, Homo sapiens; identical to SEQ ID NO: 10614

SEQ ID NO: 10696 - DNA, 201 bp, Homo sapiens; identical to SEQ ID NO: 10615

SEQ ID NO: 10697 - DNA, 201 bp, Homo sapiens; identical to SEQ ID NO: 10616

SEQ ID NO: 10698 - DNA, 201 bp, Homo sapiens; identical to SEQ ID NO: 10617

SEQ ID NO: 10699 - DNA, 201 bp, Homo sapiens; identical to SEQ ID NO: 10618

SEQ ID NO: 10700 - DNA, 201 bp, Homo sapiens; identical to SEQ ID NO: 10619

SEQ ID NO: 10701 - DNA, 201 bp, Homo sapiens; identical to SEQ ID NO: 10620

SEQ ID NO: 10702 - DNA, 201 bp, Homo sapiens; identical to SEQ ID NO: 10621

SEQ ID NO: 10703 - DNA, 201 bp, Homo sapiens; identical to SEQ ID NO: 10622

SEQ ID NO: 10704 - DNA, 201 bp, Homo sapiens; identical to SEQ ID NO: 10542

SEQ ID NO: 10705 - DNA, 201 bp, Homo sapiens; identical to SEQ ID NO: 10543

SEQ ID NO: 10706 - DNA, 201 bp, Homo sapiens; identical to SEQ ID NO: 10544

SEQ ID NO: 10707 - DNA, 201 bp, Homo sapiens; identical to SEQ ID NO: 10545

SEQ ID NO: 10708 - DNA, 201 bp, Homo sapiens; identical to SEQ ID NO: 10546

SEQ ID NO: 10709 - DNA, 201 bp, Homo sapiens; identical to SEQ ID NO: 10547

SEQ ID NO: 10710 - DNA, 201 bp, Homo sapiens; identical to SEQ ID NO: 10548

SEQ ID NO: 10711 - DNA, 201 bp, Homo sapiens; identical to SEQ ID NO: 10549

SEQ ID NO: 10712 - DNA, 201 bp, Homo sapiens; identical to SEQ ID NO: 10550

SEQ ID NO: 10713 - DNA, 201 bp, Homo sapiens; identical to SEQ ID NO: 10551

SEQ ID NO: 10714 - DNA, 201 bp, Homo sapiens; identical to SEQ ID NO: 10552

SEQ ID NO: 10715 - DNA, 201 bp, Homo sapiens; identical to SEQ ID NO: 10553

SEQ ID NO: 10716 - DNA, 201 bp, Homo sapiens; identical to SEQ ID NO: 10554

SEQ ID NO: 10717 - DNA, 201 bp, Homo sapiens; identical to SEQ ID NO: 10555

SEQ ID NO: 10718 - DNA, 201 bp, Homo sapiens; identical to SEQ ID NO: 10556

SEQ ID NO: 10719 - DNA, 201 bp, Homo sapiens; identical to SEQ ID NO: 10557

SEQ ID NO: 10720 - DNA, 201 bp, Homo sapiens; identical to SEQ ID NO: 10558

SEQ ID NO: 10721 - DNA, 201 bp, Homo sapiens; identical to SEQ ID NO: 10559

SEQ ID NO: 10722 - DNA, 201 bp, Homo sapiens; identical to SEQ ID NO: 10560

SEQ ID NO: 10723 - DNA, 201 bp, Homo sapiens; identical to SEQ ID NO: 10561

SEQ ID NO: 10724 - DNA, 201 bp, Homo sapiens; identical to SEQ ID NO: 10562

SEQ ID NO: 10725 - DNA, 201 bp, Homo sapiens; identical to SEQ ID NO: 10563

SEQ ID NO: 10726 - DNA, 201 bp, Homo sapiens; identical to SEQ ID NO: 10564

SEQ ID NO: 10727 - DNA, 201 bp, Homo sapiens; identical to SEQ ID NO: 10565

SEQ ID NO: 10728 - DNA, 201 bp, Homo sapiens; identical to SEQ ID NO: 10566

SEQ ID NO: 10729 - DNA, 201 bp, Homo sapiens; identical to SEQ ID NO: 10567

SEQ ID NO: 10730 - DNA, 201 bp, Homo sapiens; identical to SEQ ID NO: 10568

SEQ ID NO: 10731 - DNA, 201 bp, Homo sapiens; identical to SEQ ID NO: 10569

SEQ ID NO: 10732 - DNA, 201 bp, Homo sapiens; identical to SEQ ID NO: 10570

SEQ ID NO: 10733 - DNA, 201 bp, Homo sapiens; identical to SEQ ID NO: 10571

SEQ ID NO: 10734 - DNA, 201 bp, Homo sapiens; identical to SEQ ID NO: 10572

SEQ ID NO: 10735 - DNA, 201 bp, Homo sapiens; identical to SEQ ID NO: 10573

SEQ ID NO: 10736 - DNA, 201 bp, Homo sapiens; identical to SEQ ID NO: 10574

SEQ ID NO: 10737 - DNA, 201 bp, Homo sapiens; identical to SEQ ID NO: 10575

SEQ ID NO: 10738 - DNA, 201 bp, Homo sapiens; identical to SEQ ID NO: 10576

SEQ ID NO: 10739 - DNA, 201 bp, Homo sapiens; identical to SEQ ID NO: 10577

SEQ ID NO: 10740 - DNA, 201 bp, Homo sapiens; identical to SEQ ID NO: 10578

SEQ ID NO: 10741 - DNA, 201 bp, Homo sapiens; identical to SEQ ID NO: 10579

SEQ ID NO: 10742 - DNA, 201 bp, Homo sapiens; identical to SEQ ID NO: 10580

SEQ ID NO: 10743 - DNA, 201 bp, Homo sapiens; identical to SEQ ID NO: 10581

SEQ ID NO: 10744 - DNA, 201 bp, Homo sapiens; identical to SEQ ID NO: 10582

SEQ ID NO: 10745 - DNA, 201 bp, Homo sapiens; identical to SEQ ID NO: 10583

SEQ ID NO: 10746 - DNA, 201 bp, Homo sapiens; identical to SEQ ID NO: 10584

SEQ ID NO: 10747 - DNA, 201 bp, Homo sapiens; identical to SEQ ID NO: 10585

SEQ ID NO: 10748 - DNA, 201 bp, Homo sapiens; identical to SEQ ID NO: 10586

SEQ ID NO: 10749 - DNA, 201 bp, Homo sapiens; identical to SEQ ID NO: 10587

SEQ ID NO: 10750 - DNA, 201 bp, Homo sapiens; identical to SEQ ID NO: 10588

SEQ ID NO: 10751 - DNA, 201 bp, Homo sapiens; identical to SEQ ID NO: 10589

SEQ ID NO: 10752 - DNA, 201 bp, Homo sapiens; identical to SEQ ID NO: 10590

SEQ ID NO: 10753 - DNA, 201 bp, Homo sapiens; identical to SEQ ID NO: 10591

SEQ ID NO: 10754 - DNA, 201 bp, Homo sapiens; identical to SEQ ID NO: 10592

SEQ ID NO: 10755 - DNA, 201 bp, Homo sapiens; identical to SEQ ID NO: 10593

SEQ ID NO: 10756 - DNA, 201 bp, Homo sapiens; identical to SEQ ID NO: 10594

SEQ ID NO: 10757 - DNA, 201 bp, Homo sapiens; identical to SEQ ID NO: 10595

SEQ ID NO: 10758 - DNA, 201 bp, Homo sapiens; identical to SEQ ID NO: 10596

SEQ ID NO: 10759 - DNA, 201 bp, Homo sapiens; identical to SEQ ID NO: 10597

SEQ ID NO: 10760 - DNA, 201 bp, Homo sapiens; identical to SEQ ID NO: 10598

SEQ ID NO: 10761 - DNA, 201 bp, Homo sapiens; identical to SEQ ID NO: 10599

SEQ ID NO: 10762 - DNA, 201 bp, Homo sapiens; identical to SEQ ID NO: 10600

SEQ ID NO: 10763 - DNA, 201 bp, Homo sapiens; identical to SEQ ID NO: 10601

SEQ ID NO: 10764 - DNA, 201 bp, Homo sapiens; identical to SEQ ID NO: 10602

SEQ ID NO: 10765 - DNA, 201 bp, Homo sapiens; identical to SEQ ID NO: 10603

SEQ ID NO: 10766 - DNA, 201 bp, Homo sapiens; identical to SEQ ID NO: 10604

SEQ ID NO: 10767 - DNA, 201 bp, Homo sapiens; identical to SEQ ID NO: 10605

SEQ ID NO: 10768 - DNA, 201 bp, Homo sapiens; identical to SEQ ID NO: 10606

SEQ ID NO: 10769 - DNA, 201 bp, Homo sapiens; identical to SEQ ID NO: 10607

SEQ ID NO: 10770 - DNA, 201 bp, Homo sapiens; identical to SEQ ID NO: 10608

SEQ ID NO: 10771 - DNA, 201 bp, Homo sapiens; identical to SEQ ID NO: 10609

SEQ ID NO: 10772 - DNA, 201 bp, Homo sapiens; identical to SEQ ID NO: 10610

SEQ ID NO: 10773 - DNA, 201 bp, Homo sapiens; identical to SEQ ID NO: 10611

SEQ ID NO: 10774 - DNA, 201 bp, Homo sapiens; identical to SEQ ID NO: 10612

SEQ ID NO: 10775 - DNA, 201 bp, Homo sapiens; identical to SEQ ID NO: 10613

SEQ ID NO: 10776 - DNA, 201 bp, Homo sapiens; identical to SEQ ID NO: 10614

SEQ ID NO: 10777 - DNA, 201 bp, Homo sapiens; identical to SEQ ID NO: 10615

SEQ ID NO: 10778 - DNA, 201 bp, Homo sapiens; identical to SEQ ID NO: 10616

SEQ ID NO: 10779 - DNA, 201 bp, Homo sapiens; identical to SEQ ID NO: 10617

SEQ ID NO: 10780 - DNA, 201 bp, Homo sapiens; identical to SEQ ID NO: 10618

SEQ ID NO: 10781 - DNA, 201 bp, Homo sapiens; identical to SEQ ID NO: 10619

SEQ ID NO: 10782 - DNA, 201 bp, Homo sapiens; identical to SEQ ID NO: 10620

SEQ ID NO: 10783 - DNA, 201 bp, Homo sapiens; identical to SEQ ID NO: 10621

SEQ ID NO: 10784 - DNA, 201 bp, Homo sapiens; identical to SEQ ID NO: 10622

SEQ ID NO: 10785 - DNA, 201 bp, Homo sapiens; identical to SEQ ID NO: 10542

SEQ ID NO: 10786 - DNA, 201 bp, Homo sapiens; identical to SEQ ID NO: 10543

SEQ ID NO: 10787 - DNA, 201 bp, Homo sapiens; identical to SEQ ID NO: 10544

SEQ ID NO: 10788 - DNA, 201 bp, Homo sapiens; identical to SEQ ID NO: 10545

SEQ ID NO: 10789 - DNA, 201 bp, Homo sapiens; identical to SEQ ID NO: 10546

SEQ ID NO: 10790 - DNA, 201 bp, Homo sapiens; identical to SEQ ID NO: 10547

SEQ ID NO: 10791 - DNA, 201 bp, Homo sapiens; identical to SEQ ID NO: 10548

SEQ ID NO: 10792 - DNA, 201 bp, Homo sapiens; identical to SEQ ID NO: 10549

SEQ ID NO: 10793 - DNA, 201 bp, Homo sapiens; identical to SEQ ID NO: 10550

SEQ ID NO: 10794 - DNA, 201 bp, Homo sapiens; identical to SEQ ID NO: 10551

SEQ ID NO: 10795 - DNA, 201 bp, Homo sapiens; identical to SEQ ID NO: 10552

SEQ ID NO: 10796 - DNA, 201 bp, Homo sapiens; identical to SEQ ID NO: 10553

SEQ ID NO: 10797 - DNA, 201 bp, Homo sapiens; identical to SEQ ID NO: 10554

SEQ ID NO: 10798 - DNA, 201 bp, Homo sapiens; identical to SEQ ID NO: 10555

SEQ ID NO: 10799 - DNA, 201 bp, Homo sapiens; identical to SEQ ID NO: 10556

SEQ ID NO: 10800 - DNA, 201 bp, Homo sapiens; identical to SEQ ID NO: 10557

SEQ ID NO: 10801 - DNA, 201 bp, Homo sapiens; identical to SEQ ID NO: 10558

SEQ ID NO: 10802 - DNA, 201 bp, Homo sapiens; identical to SEQ ID NO: 10559

SEQ ID NO: 10803 - DNA, 201 bp, Homo sapiens; identical to SEQ ID NO: 10560

SEQ ID NO: 10804 - DNA, 201 bp, Homo sapiens; identical to SEQ ID NO: 10561

SEQ ID NO: 10805 - DNA, 201 bp, Homo sapiens; identical to SEQ ID NO: 10562

SEQ ID NO: 10806 - DNA, 201 bp, Homo sapiens; identical to SEQ ID NO: 10563

SEQ ID NO: 10807 - DNA, 201 bp, Homo sapiens; identical to SEQ ID NO: 10564

SEQ ID NO: 10808 - DNA, 201 bp, Homo sapiens; identical to SEQ ID NO: 10565

SEQ ID NO: 10809 - DNA, 201 bp, Homo sapiens; identical to SEQ ID NO: 10566

SEQ ID NO: 10810 - DNA, 201 bp, Homo sapiens; identical to SEQ ID NO: 10567

SEQ ID NO: 10811 - DNA, 201 bp, Homo sapiens; identical to SEQ ID NO: 10568

SEQ ID NO: 10812 - DNA, 201 bp, Homo sapiens; identical to SEQ ID NO: 10569

SEQ ID NO: 10813 - DNA, 201 bp, Homo sapiens; identical to SEQ ID NO: 10570

SEQ ID NO: 10814 - DNA, 201 bp, Homo sapiens; identical to SEQ ID NO: 10571

SEQ ID NO: 10815 - DNA, 201 bp, Homo sapiens; identical to SEQ ID NO: 10572

SEQ ID NO: 10816 - DNA, 201 bp, Homo sapiens; identical to SEQ ID NO: 10573

SEQ ID NO: 10817 - DNA, 201 bp, Homo sapiens; identical to SEQ ID NO: 10574

SEQ ID NO: 10818 - DNA, 201 bp, Homo sapiens; identical to SEQ ID NO: 10575

SEQ ID NO: 10819 - DNA, 201 bp, Homo sapiens; identical to SEQ ID NO: 10576

SEQ ID NO: 10820 - DNA, 201 bp, Homo sapiens; identical to SEQ ID NO: 10577

SEQ ID NO: 10821 - DNA, 201 bp, Homo sapiens; identical to SEQ ID NO: 10578

SEQ ID NO: 10822 - DNA, 201 bp, Homo sapiens; identical to SEQ ID NO: 10579

SEQ ID NO: 10823 - DNA, 201 bp, Homo sapiens; identical to SEQ ID NO: 10580

SEQ ID NO: 10824 - DNA, 201 bp, Homo sapiens; identical to SEQ ID NO: 10581

SEQ ID NO: 10825 - DNA, 201 bp, Homo sapiens; identical to SEQ ID NO: 10582

SEQ ID NO: 10826 - DNA, 201 bp, Homo sapiens; identical to SEQ ID NO: 10583

SEQ ID NO: 10827 - DNA, 201 bp, Homo sapiens; identical to SEQ ID NO: 10584

SEQ ID NO: 10828 - DNA, 201 bp, Homo sapiens; identical to SEQ ID NO: 10585

SEQ ID NO: 10829 - DNA, 201 bp, Homo sapiens; identical to SEQ ID NO: 10586

SEQ ID NO: 10830 - DNA, 201 bp, Homo sapiens; identical to SEQ ID NO: 10587

SEQ ID NO: 10831 - DNA, 201 bp, Homo sapiens; identical to SEQ ID NO: 10588

SEQ ID NO: 10832 - DNA, 201 bp, Homo sapiens; identical to SEQ ID NO: 10589

SEQ ID NO: 10833 - DNA, 201 bp, Homo sapiens; identical to SEQ ID NO: 10590

SEQ ID NO: 10834 - DNA, 201 bp, Homo sapiens; identical to SEQ ID NO: 10591

SEQ ID NO: 10835 - DNA, 201 bp, Homo sapiens
gcctcctttgtttcttcacttgccgcctggccaggccgctcagagaaagagaaagaccccaagtactggcgagaccaagcgcaagagacactgaaatatgycctggagcttcagaagctcaacaccaacgtggctaagaatgtcatcatgttcctgggagatgggatgggtgtctccacagtgacggctgcccgcatcctc

SEQ ID NO: 10836 - DNA, 201 bp, Homo sapiens; identical to SEQ ID NO: 10593

SEQ ID NO: 10837 - DNA, 201 bp, Homo sapiens; identical to SEQ ID NO: 10594

SEQ ID NO: 10838 - DNA, 201 bp, Homo sapiens; identical to SEQ ID NO: 10595

SEQ ID NO: 10839 - DNA, 201 bp, Homo sapiens; identical to SEQ ID NO: 10596

SEQ ID NO: 10840 - DNA, 201 bp, Homo sapiens; identical to SEQ ID NO: 10597

SEQ ID NO: 10841 - DNA, 201 bp, Homo sapiens; identical to SEQ ID NO: 10598

SEQ ID NO: 10842 - DNA, 201 bp, Homo sapiens; identical to SEQ ID NO: 10599

SEQ ID NO: 10843 - DNA, 201 bp, Homo sapiens; identical to SEQ ID NO: 10600

SEQ ID NO: 10844 - DNA, 201 bp, Homo sapiens; identical to SEQ ID NO: 10601

SEQ ID NO: 10845 - DNA, 201 bp, Homo sapiens; identical to SEQ ID NO: 10602

SEQ ID NO: 10846 - DNA, 201 bp, Homo sapiens; identical to SEQ ID NO: 10603

SEQ ID NO: 10847 - DNA, 201 bp, Homo sapiens; identical to SEQ ID NO: 10604

SEQ ID NO: 10848 - DNA, 201 bp, Homo sapiens; identical to SEQ ID NO: 10605

SEQ ID NO: 10849 - DNA, 201 bp, Homo sapiens; identical to SEQ ID NO: 10606

SEQ ID NO: 10850 - DNA, 201 bp, Homo sapiens; identical to SEQ ID NO: 10607

SEQ ID NO: 10851 - DNA, 201 bp, Homo sapiens; identical to SEQ ID NO: 10608

SEQ ID NO: 10852 - DNA, 201 bp, Homo sapiens; identical to SEQ ID NO: 10609

SEQ ID NO: 10853 - DNA, 201 bp, Homo sapiens; identical to SEQ ID NO: 10610

SEQ ID NO: 10854 - DNA, 201 bp, Homo sapiens
ttcttcacttgccgcctggccaggccgctcagagaaagagaaagaccccaagtactggcgagaccaagcgcaagagacactgaaatatgccctggagcttyagaagctcaacaccaacgtggctaagaatgtcatcatgttcctgggagatgggatgggtgtctccacagtgacggctgcccgcatcctcaagggtcagct

SEQ ID NO: 10855 - DNA, 201 bp, Homo sapiens; identical to SEQ ID NO: 10612

SEQ ID NO: 10856 - DNA, 201 bp, Homo sapiens; identical to SEQ ID NO: 10613

SEQ ID NO: 10857 - DNA, 201 bp, Homo sapiens; identical to SEQ ID NO: 10614

SEQ ID NO: 10858 - DNA, 201 bp, Homo sapiens; identical to SEQ ID NO: 10615

SEQ ID NO: 10859 - DNA, 201 bp, Homo sapiens; identical to SEQ ID NO: 10616

SEQ ID NO: 10860 - DNA, 201 bp, Homo sapiens; identical to SEQ ID NO: 10617

SEQ ID NO: 10861 - DNA, 201 bp, Homo sapiens; identical to SEQ ID NO: 10618

SEQ ID NO: 10862 - DNA, 201 bp, Homo sapiens; identical to SEQ ID NO: 10619

SEQ ID NO: 10863 - DNA, 201 bp, Homo sapiens; identical to SEQ ID NO: 10620

SEQ ID NO: 10864 - DNA, 201 bp, Homo sapiens; identical to SEQ ID NO: 10621

SEQ ID NO: 10865 - DNA, 201 bp, Homo sapiens; identical to SEQ ID NO: 10622

SEQ ID NO: 10866 - DNA, 201 bp, Homo sapiens
aataattatatattacattctattgtctttcttatataactgcagaaagataaatatcactttgtttgttcctgtaggttttctttagtgtaatccatagyagttattgcattggagcagcagtccctcactttgaaaccttcgcaatagcccgaggagctgcctttcatattttccaggttattgataagaaacccagta

SEQ ID NO: 10867 - DNA, 201 bp, Homo sapiens
tggagggcagaaacagaggatcgcaattgctcgtgccttagttcgaaaccccaagattctgattttagatgaggctacgtctgccctggattcagaaagcragtcagctgttcaagctgcactggagaaggatacccccaggtattcattttgacctaatttcacctcaagtggagaatcgctgaccttgaaccagcgccc

SEQ ID NO: 10868 - DNA, 201 bp, Homo sapiens
tattgcattggagcagcagtccctcactttgaaaccttcgcaatagcccgaggagctgcctttcatattttccaggttattgataagaaacccagtatagrtaacttttccacagctggatataaacctgaatccatagaaggaactgtggaatttaaaaatgtttctttcaattatccatcaagaccatctatcaagatt

SEQ ID NO: 10869 - DNA, 201 bp, Homo sapiens
cagttattgcattggagcagcagtccctcactttgaaaccttcgcaatagcccgaggagctgcctttcatattttccaggttattgataagaaacccagtrtagataacttttccacagctggatataaacctgaatccatagaaggaactgtggaatttaaaaatgtttctttcaattatccatcaagaccatctatcaa

SEQ ID NO: 10870 - DNA, 201 bp, Homo sapiens
agcctgttttgttcgggaccaccatcagtaacaatatcaagtatggacgagatgatgtgactgatgaagagatggagagagcagcaagggaagcaaatgcrtatgattttatcatggagtttcctaataaatttaatacattggtaggggaaaaaggagctcaaatgagtggagggcagaaacagaggatcgcaattgctc

SEQ ID NO: 10871 - DNA, 201 bp, Homo sapiens
tctggagagacagtcgccttggtcggtctcaatggcagtgggaagagtacggtagtccagcttctgcagaggttatatgatccggatgatggctttatcayggtggatgagaatgacatcagagctttaaatgtgcggcattatcgagaccatattggagtggttagtcaagagcctgttttgttcgggaccaccatcagt

SEQ ID NO: 10872 - DNA, 116 bp, Homo sapiens
gatcaagtgtaatctrtgttcttttttatttggtcatatcttccattctttcttacctaattcctctaatatctctctgtgagcctaaaccaataattatatattacattctattg

SEQ ID NO: 10873 - DNA, 147 bp, Homo sapiens
cctaattcctctaatatctctctgttttctttagtgtaatccatagyagttattgcattggagcagcagtccctcactttgaaaccttcgcaatagcccgaggagctgcctttcatattttccaggttattgataagaaacccagta

SEQ ID NO: 10874 - DNA, 201 bp, Homo sapiens; identical to SEQ ID NO: 10867

SEQ ID NO: 10875 - DNA, 201 bp, Homo sapiens; identical to SEQ ID NO: 10868

SEQ ID NO: 10876 - DNA, 201 bp, Homo sapiens; identical to SEQ ID NO: 10869

SEQ ID NO: 10877 - DNA, 201 bp, Homo sapiens; identical to SEQ ID NO: 10870

SEQ ID NO: 10878 - DNA, 201 bp, Homo sapiens; identical to SEQ ID NO: 10871

SEQ ID NO: 10879 - DNA, 201 bp, Homo sapiens
gctccctcccaggcttgggcctggaacaggacaggcaggggcccgaagaaagtgatgaatttcagagctgatgtgttcacctgggcagatcccccaaatcyggaagtcaaagttctcatggtcagaagttctcatggtgcacgagtcctcagcactctgccggcagtgggggtgggggcccatgcccgcgggggagagaag

SEQ ID NO: 10880 - DNA, 201 bp, Homo sapiens
ccgccagctgcatccccccttccccgcaggagaactcctacgtgtccagcactggcagagcccacagtggggctgctccatggcagcccctggcagcgccrtcaggagccagtgcccaggcagcagagcagctgcagagaggccccaaccagcccgtggagagtgacgagagcctaggcggcctctctgctgccctgcgct

SEQ ID NO: 10881 - DNA, 201 bp, Homo sapiens
ttctcatggtcagaagttctcatggtgcacgagtcctcagcactctgccggcagtgggggtgggggcccatgcccgcgggggagagaaggaggtggccctrctgttctaggctctgtgggcataggcaggcagagtggaaccctgcctccatgccagcatctgggggcaaggaaggctggcatcatccagtgaggaggctg

SEQ ID NO: 10882 - DNA, 119 bp, Homo sapiens
ccgcccaggagctttcggmaggcccggccccggcccctttccgagcagcccgggcctccgccctgccctctgtccccaacgccgggagccgccgttcgtcctccagagccccgcccggg

SEQ ID NO: 10883 - DNA, 201 bp, Homo sapiens
gcagcacccacctccaacctcgggccagtgtcttcaggctttactggggacctgcgagctggcctaatgtggtggcctgcaagccaggccatccctgggcrccacagacgagctccgagccaggtcaggcttcggaggccacaagctcagcctcaggcccaggcactgattgtggcagaggggccactacccaaggtctag

SEQ ID NO: 10884 - DNA, 201 bp, Homo sapiens
gaggctgcagtgagtcatgattgtatgactgcactccagcctgggtgacagagcaagaccctgtttcaaaaagaaaaaccctgggaaaagtgaagtatggytgtaagtctcatggttcagtcctagcaagaagcgagaattctgagatcctccagaaagtcgagcagcacccacctccaacctcgggccagtgtcttcagg

SEQ ID NO: 10885 - DNA, 201 bp, Homo sapiens
gctggagcccagtaggtcaagaccagccagggcaacatgatgagaccctgtctctgccaaaaaattttttaaactattagcctggcgtggtagcgcacgcytgtggtcccagctgctggggaggctgaagtaggaggatcatttatgcttgggaggtcgaggctgcagtgagtcatgattgtatgactgcactccagcctg

SEQ ID NO: 10886 - DNA, 201 bp, Homo sapiens
aggcctggagcccccggaagttgccatcctcagcctccaccttcctctccccagcttttccaggctcccagacccattcagggcctgagctcggcctggtyccaagccctgcttccctgtggcctccaccgccatctccagccccttcttctaccaagccaggcccagagagctcagtgtccctcctgcagggagcccgcc

SEQ ID NO: 10887 - DNA, 201 bp, Homo sapiens
agccctgcttccctgtggcctccaccgccatctccagccccttcttctaccaagccaggcccagagagctcagtgtccctcctgcagggagcccgcccctytccgttttgctggcccctctgtgagatttcccggggcacccacaacttctcggaggagctcaagatcggggagggtggctttgggtgcgtgtaccgggcg

SEQ ID NO: 10888 - DNA, 201 bp, Homo sapiens
ggtcagagggctgtgaagacgcacggtgccaggaccaagtatctggtgtacgagaggctagagaagctgcaggcagtggtggcgggggtgcccgggcattyggaggccgccagctgcatccccccttccccgcaggagaactcctacgtgtccagcactggcagagcccacagtggggctgctccatggcagcccctggca

SEQ ID NO: 10889 - DNA, 201 bp, Homo sapiens; identical to SEQ ID NO: 10879

SEQ ID NO: 10890 - DNA, 201 bp, Homo sapiens; identical to SEQ ID NO: 10880

SEQ ID NO: 10891 - DNA, 201 bp, Homo sapiens; identical to SEQ ID NO: 10881

SEQ ID NO: 10892 - DNA, 201 bp, Homo sapiens; identical to SEQ ID NO: 10883

SEQ ID NO: 10893 - DNA, 201 bp, Homo sapiens; identical to SEQ ID NO: 10884

SEQ ID NO: 10894 - DNA, 201 bp, Homo sapiens; identical to SEQ ID NO: 10885

SEQ ID NO: 10895 - DNA, 201 bp, Homo sapiens; identical to SEQ ID NO: 10886

SEQ ID NO: 10896 - DNA, 201 bp, Homo sapiens; identical to SEQ ID NO: 10887

SEQ ID NO: 10897 - DNA, 201 bp, Homo sapiens
tgctgcctgcaccgccgggccaaaaggaggcctcctatgacccaggtgtacgagaggctagagaagctgcaggcagtggtggcgggggtgcccgggcattyggaggccgccagctgcatccccccttccccgcaggagaactcctacgtgtccagcactggcagagcccacagtggggctgctccatggcagcccctggca

SEQ ID NO: 10898 - DNA, 201 bp, Homo sapiens; identical to SEQ ID NO: 10879

SEQ ID NO: 10899 - DNA, 201 bp, Homo sapiens; identical to SEQ ID NO: 10880

SEQ ID NO: 10900 - DNA, 201 bp, Homo sapiens; identical to SEQ ID NO: 10881

SEQ ID NO: 10901 - DNA, 201 bp, Homo sapiens; identical to SEQ ID NO: 10883

SEQ ID NO: 10902 - DNA, 201 bp, Homo sapiens; identical to SEQ ID NO: 10884

SEQ ID NO: 10903 - DNA, 201 bp, Homo sapiens; identical to SEQ ID NO: 10885

SEQ ID NO: 10904 - DNA, 201 bp, Homo sapiens; identical to SEQ ID NO: 10886

SEQ ID NO: 10905 - DNA, 201 bp, Homo sapiens; identical to SEQ ID NO: 10887

SEQ ID NO: 10906 - DNA, 201 bp, Homo sapiens; identical to SEQ ID NO: 10888

SEQ ID NO: 10907 - DNA, 119 bp, Homo sapiens; identical to SEQ ID NO: 10882

SEQ ID NO: 10908 - DNA, 201 bp, Homo sapiens; identical to SEQ ID NO: 10886

SEQ ID NO: 10909 - DNA, 201 bp, Homo sapiens; identical to SEQ ID NO: 10887

SEQ ID NO: 10910 - DNA, 201 bp, Homo sapiens; identical to SEQ ID NO: 10879

SEQ ID NO: 10911 - DNA, 201 bp, Homo sapiens; identical to SEQ ID NO: 10880

SEQ ID NO: 10912 - DNA, 201 bp, Homo sapiens; identical to SEQ ID NO: 10881

SEQ ID NO: 10913 - DNA, 119 bp, Homo sapiens; identical to SEQ ID NO: 10882

SEQ ID NO: 10914 - DNA, 201 bp, Homo sapiens; identical to SEQ ID NO: 10883

SEQ ID NO: 10915 - DNA, 201 bp, Homo sapiens; identical to SEQ ID NO: 10884

SEQ ID NO: 10916 - DNA, 201 bp, Homo sapiens; identical to SEQ ID NO: 10885

SEQ ID NO: 10917 - DNA, 201 bp, Homo sapiens; identical to SEQ ID NO: 10886

SEQ ID NO: 10918 - DNA, 201 bp, Homo sapiens; identical to SEQ ID NO: 10887

SEQ ID NO: 10919 - DNA, 201 bp, Homo sapiens; identical to SEQ ID NO: 10897

SEQ ID NO: 10920 - DNA, 201 bp, Homo sapiens; identical to SEQ ID NO: 10879

SEQ ID NO: 10921 - DNA, 201 bp, Homo sapiens
gggccaaaaggaggcctcctatgacccaggagaactcctacgtgtccagcactggcagagcccacagtggggctgctccatggcagcccctggcagcgccrtcaggagccagtgcccaggcagcagagcagctgcagagaggccccaaccagcccgtggagagtgacgagagcctaggcggcctctctgctgccctgcgct

SEQ ID NO: 10922 - DNA, 201 bp, Homo sapiens; identical to SEQ ID NO: 10881

SEQ ID NO: 10923 - DNA, 201 bp, Homo sapiens; identical to SEQ ID NO: 10883

SEQ ID NO: 10924 - DNA, 201 bp, Homo sapiens; identical to SEQ ID NO: 10884

SEQ ID NO: 10925 - DNA, 201 bp, Homo sapiens; identical to SEQ ID NO: 10885

SEQ ID NO: 10926 - DNA, 201 bp, Homo sapiens; identical to SEQ ID NO: 10886

SEQ ID NO: 10927 - DNA, 201 bp, Homo sapiens; identical to SEQ ID NO: 10887

SEQ ID NO: 10928 - DNA, 201 bp, Homo sapiens
agcaatcttctccctcggtctcggggagtcgctgtacatcctggtggggcagcagggagaggacgcctgtcccggagtgagcgcagccagtggggatgggscggcgccggcgccgggggcgagggctgcctgggggccgggggagcgtgctttcctcggtgccgggtcaccagcacagcgaggggaggctcccgggccccg

SEQ ID NO: 10929 - DNA, 179 bp, Homo sapiens
aggtgggcgtggccagaccagctttaggtccggggagtgtctcgccagcggcagcacacccctgtaagtggtggccagrgctgccgtggcaaaatgagctgtcaactttaggttgacaggggtgtggccgcgaccgcaagggcttttgttgccgggtggacccaacagggatgggctgc

SEQ ID NO: 10930 - DNA, 201 bp, Homo sapiens
gtgtggttcggagccgcgggcgccattctctgctctagcccggggtcccaggagacttttctgcggtcctcgcccctgccgctggcaagtcccagcccccrggacccgaaagtcagcgccccgcctagtatcttggagccagcctccccgctgaattctccgggcaccgaggggtcttggctgttttctacctgcggggcc

SEQ ID NO: 10931 - DNA, 201 bp, Homo sapiens
gcttcctggaacacgccgctggccccacaggtgcgcgctggcgagctggaaccgttgctggtggcggccggaggcggcggtcgggcctacctgaggccgcrggaccgaggccggactcaggcctcccccgagaaactggagaaccgctcggaggcgcccgggagcggcgggagaggcggggcggcaggtggtgggggcggc

SEQ ID NO: 10932 - DNA, 201 bp, Homo sapiens
gggcgggagccctctcccagtggcagtgcccctggacagctggagggcgcttcctggaacacgccgctggccccacaggtgcgcgctggcgagctggaacygttgctggtggcggccggaggcggcggtcgggcctacctgaggccgcgggaccgaggccggactcaggcctcccccgagaaactggagaaccgctcggag

SEQ ID NO: 10933 - DNA, 201 bp, Homo sapiens
cacgcggcgatggatgggagcgaaggggtcccggggccccctgggcgggagccctctcccagtggcagtgcccctggacagctggagggcgcttcctggamcacgccgctggccccacaggtgcgcgctggcgagctggaaccgttgctggtggcggccggaggcggcggtcgggcctacctgaggccgcgggaccgaggc

SEQ ID NO: 10934 - DNA, 201 bp, Homo sapiens
tgtcaccgaggtttccccagccaatgttactctgctcagagccctgggccatggtgcctttggggaggtgtatgagggactggtaattggccttcctgggractccagtcccctgcaggtagctatcaagaccctgccagaactctgctcgcctcaggatgagctggatttcctcatggaggccctcatcatcagcaagtt

SEQ ID NO: 10935 - DNA, 179 bp, Homo sapiens; identical to SEQ ID NO: 10929

SEQ ID NO: 10936 - DNA, 165 bp, Homo sapiens
gggcccagccacttccagcttttgatcttggggccagaggccgccttacacacaccccaggtgtccatggggagcactggattgctctcccattatgagcrtccttcatctgggcagaccccccaccctgcagatgcttctaataaaaagctcttctcatcctcc

SEQ ID NO: 10937 - DNA, 201 bp, Homo sapiens
gccagttattaccgcaggggggaccgggccttgctcccagtcaagtggatgcccccagaggccttcctggagggcatcttcacatccaagacagattcctrgtcttttggggtgctgctctgggagatcttctcactgggctacatgccctatcctgggcgcaccaaccaggaggtgctggacttcgtcgttggaggaggc

SEQ ID NO: 10938 - DNA, 201 bp, Homo sapiens; identical to SEQ ID NO: 10930

SEQ ID NO: 10939 - DNA, 201 bp, Homo sapiens
gtggcaacctcaacactgagcctccttatggtgtgtggggtcctgattctgggtacgaagcgtctagcaggcacagttgattcaaggctgctcctctccartgagctgggatgggtttctgcggggtcccggggctgacttcaagaccactcaccgcagcagagccgtggtagactcctctgggattctaagataggaagg

SEQ ID NO: 10940 - DNA, 201 bp, Homo sapiens
gcttcctggaacacgccgctggccccacaggtgcgcgctggcgagctggaaccgttgctggtggcggccggaggcggcggtcgggcctacctgaggccgcrggaccgaggccggactcaggcctcccccgagaaactggagaaccgctcggaggcgcccgggagcggcgggagaggcggggcggcagggggcgacgcttca

SEQ ID NO: 10941 - DNA, 201 bp, Homo sapiens; identical to SEQ ID NO: 10932

SEQ ID NO: 10942 - DNA, 201 bp, Homo sapiens; identical to SEQ ID NO: 10934

SEQ ID NO: 10943 - DNA, 201 bp, Homo sapiens
cctgggctgggctgggggcccctgcccttatccaggccccctgggcgggagccctctcccagtggcagtgcccctggacagctggagggcgcttcctggamcacgccgctggccccacaggtgcgcgctggcgagctggaaccgttgctggtggcggccggaggcggcggtcgggcctacctgaggccgcgggaccgaggc

SEQ ID NO: 10944 - DNA, 112 bp, Homo sapiens
gtggtggccagrgctgccgtggcaaaatgagctgtcaactttaggttgacaggggtgtggccgcgaccgcaagggcttttgttgccgggtggacccaacagggatgggctgc

SEQ ID NO: 10945 - DNA, 201 bp, Homo sapiens; identical to SEQ ID NO: 10937

SEQ ID NO: 10946 - DNA, 165 bp, Homo sapiens; identical to SEQ ID NO: 10936

SEQ ID NO: 10947 - DNA, 201 bp, Homo sapiens
gtacgtgctcccttcggcgctcagcgttggggtcccaatcctctccccaggggcgctcacgcaccggctctccgtccgtcccttggggtccccctatcccygcgctgggctgggctggcctgggctgggctgggggcccctgcccttatccaggccccctgggcgggagccctctcccagtggcagtgcccctggacagct

SEQ ID NO: 10948 - DNA, 201 bp, Homo sapiens
ggtacgtgctcccttcggcgctcagcgttggggtcccaatcctctccccaggggcgctcacgcaccggctctccgtccgtcccttggggtccccctatccytgcgctgggctgggctggcctgggctgggctgggggcccctgcccttatccaggccccctgggcgggagccctctcccagtggcagtgcccctggacagc

SEQ ID NO: 10949 - DNA, 201 bp, Homo sapiens; identical to SEQ ID NO: 10939

SEQ ID NO: 10950 - DNA, 201 bp, Homo sapiens; identical to SEQ ID NO: 10931

SEQ ID NO: 10951 - DNA, 201 bp, Homo sapiens; identical to SEQ ID NO: 10932

SEQ ID NO: 10952 - DNA, 201 bp, Homo sapiens; identical to SEQ ID NO: 10934

SEQ ID NO: 10953 - DNA, 201 bp, Homo sapiens; identical to SEQ ID NO: 10933

SEQ ID NO: 10954 - DNA, 179 bp, Homo sapiens; identical to SEQ ID NO: 10929

SEQ ID NO: 10955 - DNA, 201 bp, Homo sapiens; identical to SEQ ID NO: 10937

SEQ ID NO: 10956 - DNA, 165 bp, Homo sapiens; identical to SEQ ID NO: 10936

SEQ ID NO: 10957 - DNA, 201 bp, Homo sapiens; identical to SEQ ID NO: 10930

SEQ ID NO: 10958 - DNA, 201 bp, Homo sapiens
ggtggcaacctcaacactgagcctccttatggtgtgtggggtcctgattctgggtacgaagcgtctagcaggcacagttgattcaaggctgctcctctccrtgaagcagaagaagtggcagggcctgcaggagatgaggctgccgagccctgagcttgagctgagcaagcttcgaacctctgccatcaggacagcccccaa

SEQ ID NO: 10959 - DNA, 201 bp, Homo sapiens; identical to SEQ ID NO: 10940

SEQ ID NO: 10960 - DNA, 201 bp, Homo sapiens; identical to SEQ ID NO: 10932

SEQ ID NO: 10961 - DNA, 201 bp, Homo sapiens; identical to SEQ ID NO: 10934

SEQ ID NO: 10962 - DNA, 201 bp, Homo sapiens; identical to SEQ ID NO: 10943

SEQ ID NO: 10963 - DNA, 112 bp, Homo sapiens; identical to SEQ ID NO: 10944

SEQ ID NO: 10964 - DNA, 201 bp, Homo sapiens; identical to SEQ ID NO: 10937

SEQ ID NO: 10965 - DNA, 165 bp, Homo sapiens; identical to SEQ ID NO: 10936

SEQ ID NO: 10966 - DNA, 201 bp, Homo sapiens; identical to SEQ ID NO: 10947

SEQ ID NO: 10967 - DNA, 201 bp, Homo sapiens; identical to SEQ ID NO: 10948

SEQ ID NO: 10968 - DNA, 201 bp, Homo sapiens; identical to SEQ ID NO: 10958

SEQ ID NO: 10969 - DNA, 201 bp, Homo sapiens
ggtggcgggggcgccacctacgttttccgggtgcgcgctggcgagctggaaccgttgctggtggcggccggaggcggcggtcgggcctacctgaggccgcrggaccgaggccggactcaggcctcccccgagaaactggagaaccgctcggaggcgcccgggagcggcgggagaggcggggcggcaggtggtgggggcggc

SEQ ID NO: 10970 - DNA, 201 bp, Homo sapiens
gggagcgaaggggtcccggggtcgcggcgctgggcgggaggtggcgggggtggcgggggcgccacctacgttttccgggtgcgcgctggcgagctggaacygttgctggtggcggccggaggcggcggtcgggcctacctgaggccgcgggaccgaggccggactcaggcctcccccgagaaactggagaaccgctcggag

SEQ ID NO: 10971 - DNA, 201 bp, Homo sapiens; identical to SEQ ID NO: 10934

SEQ ID NO: 10972 - DNA, 179 bp, Homo sapiens; identical to SEQ ID NO: 10929

SEQ ID NO: 10973 - DNA, 201 bp, Homo sapiens; identical to SEQ ID NO: 10930

SEQ ID NO: 10974 - DNA, 201 bp, Homo sapiens; identical to SEQ ID NO: 10937

SEQ ID NO: 10975 - DNA, 165 bp, Homo sapiens; identical to SEQ ID NO: 10936

SEQ ID NO: 10976 - DNA, 201 bp, Homo sapiens
ggtggcgggggcgccacctacgttttccgggtgcgcgctggcgagctggaaccgttgctggtggcggccggaggcggcggtcgggcctacctgaggccgcrggaccgaggccggactcaggcctcccccgagaaactggagaaccgctcggaggcgcccgggagcggcgggagaggcggggcggcagggggcgacgcttca

SEQ ID NO: 10977 - DNA, 201 bp, Homo sapiens; identical to SEQ ID NO: 10970

SEQ ID NO: 10978 - DNA, 201 bp, Homo sapiens; identical to SEQ ID NO: 10934

SEQ ID NO: 10979 - DNA, 179 bp, Homo sapiens; identical to SEQ ID NO: 10929

SEQ ID NO: 10980 - DNA, 201 bp, Homo sapiens; identical to SEQ ID NO: 10930

SEQ ID NO: 10981 - DNA, 201 bp, Homo sapiens; identical to SEQ ID NO: 10937

SEQ ID NO: 10982 - DNA, 165 bp, Homo sapiens; identical to SEQ ID NO: 10936

SEQ ID NO: 10983 - DNA, 201 bp, Homo sapiens
cagtgtaaatgggctacttgtcataagccctaagtcacaggtcaacaaactgagaggcaaaagcacttggttgagcttgtgtatctagtgagtatggattyagggaccagattcccagccccacgaactgctaagcaaccccacctcctaaacacatgagtgccgattaacttcacagaaaaacacacaaggcaaagttca

SEQ ID NO: 10984 - DNA, 201 bp, Homo sapiens
caaaatcctaaaggatcaatagtagctggcaaaaagaagcaggaggaagcgcattctaggtagaggagacagcctggacaaaggtctgagggaggaaggarcacaaggagtgcaggacactttcatgagtgcaggacactttcataactgcatgaacttcatagagatgggatcctttagcatgttctctgtgcacatgct

SEQ ID NO: 10985 - DNA, 201 bp, Homo sapiens
tctcccgcccttgtgccccacaacctggccaacagtactggaagaaactggacacagtcaccagcatcccaggggagggcaaaacagccatgtcgtgcccygatgaagagcaattctgatcacagctgttactcactgagcaccagccaggcaccaggcaccccataacacggcttcctgtgctctccctccagagcctgt

SEQ ID NO: 10986 - DNA, 201 bp, Homo sapiens
caacaaactgagaggcaaaagcacttggttgagcttgtgtatctagtgagtatggattcagggaccagattcccagccccacgaactgctaagcaaccccmcctcctaaacacatgagtgccgattaacttcacagaaaaacacacaaggcaaagttcagcgaggtgaaattctccaagctataaagatcagggaagactt

SEQ ID NO: 10987 - DNA, 201 bp, Homo sapiens
attgcactcctgtccctctggccttccatctctcccgcccttgtgccccacaacctggccaacagtactggaagaaactggacacagtcaccagcatcccmggggagggcaaaacagccatgtcgtgccctgatgaagagcaattctgatcacagctgttactcactgagcaccagccaggcaccaggcaccccataacac

SEQ ID NO: 10988 - DNA, 201 bp, Homo sapiens
tggcaaaaagaagcaggaggaagcgcattctaggtagaggagacagcctggacaaaggtctgagggaggaaggaacacaaggagtgcaggacactttcatragtgcaggacactttcataactgcatgaacttcatagagatgggatcctttagcatgttctctgtgcacatgcttgaccatgttctttcacatgcttttt

SEQ ID NO: 10989 - DNA, 201 bp, Homo sapiens
catgtcgtgccctgatgaagagcaattctgatcacagctgttactcactgagcaccagccaggcaccaggcaccccataacacggcttcctgtgctctccytccagagcctgtcgcagctctaggagggagctatacaatgatgtctttattagtgtcatcatgagaagcccaataagcagtatgccctaacagttagtag

SEQ ID NO: 10990 - DNA, 201 bp, Homo sapiens
tactggaagaaactggacacagtcaccagcatcccaggggagggcaaaacagccatgtcgtgccctgatgaagagcaattctgatcacagctgttactcamtgagcaccagccaggcaccaggcaccccataacacggcttcctgtgctctccctccagagcctgtcgcagctctaggagggagctatacaatgatgtctt

SEQ ID NO: 10991 - DNA, 201 bp, Homo sapiens
ttctgatcacagctgttactcactgagcaccagccaggcaccaggcaccccataacacggcttcctgtgctctccctccagagcctgtcgcagctctaggrgggagctatacaatgatgtctttattagtgtcatcatgagaagcccaataagcagtatgccctaacagttagtaggccaggctctggagctaagctgcat

SEQ ID NO: 10992 - DNA, 201 bp, Homo sapiens
tgaggctatcctgtctctggacaccgggtatcgcgcgccggtgaccctggtgcggaagggctgctggaccgggcctcctgcgggccagacgcaatcgaacscggacgcgctgccgccagactactcggtggtgcgcggctgcacaactgacaaatgcaacgcccacctcatgactcatgacgccctccccaacctgagcca

SEQ ID NO: 10993 - DNA, 201 bp, Homo sapiens
gagtgctacgcctgtatcggggtccaccaggatgactgcgctatcggcaggtcccgacgagtccagtgtcaccaggaccagaccgcctgcttccagggcartggcagaatgacagttggcaatttctcagtccctgtgtacatcagaacctgccaccggccctcctgcaccaccgagggcaccaccagcccctggacagcc

SEQ ID NO: 10994 - DNA, 201 bp, Homo sapiens
aaaataaactctataacatgacaagaactacttcacagtagttgcagtgaggattcaacgagatgaacatttagtacttgggacacagcagtggcccagtrtaaatgggctacttgtcataagccctaagtcacaggtcaacaaactgagaggcaaaagcacttggttgagcttgtgtatctagtgagtatggattcaggg

SEQ ID NO: 10995 - DNA, 201 bp, Homo sapiens
ttcaacgagatgaacatttagtacttgggacacagcagtggcccagtgtaaatgggctacttgtcataagccctaagtcacaggtcaacaaactgagaggyaaaagcacttggttgagcttgtgtatctagtgagtatggattcagggaccagattcccagccccacgaactgctaagcaaccccacctcctaaacacatg

SEQ ID NO: 10996 - DNA, 201 bp, Homo sapiens
agtgagtatggattcagggaccagattcccagccccacgaactgctaagcaaccccacctcctaaacacatgagtgccgattaacttcacagaaaaacacmcaaggcaaagttcagcgaggtgaaattctccaagctataaagatcagggaagacttcctggaggaattcacccttgagcaaaatcctaaaggatcaatag

SEQ ID NO: 10997 - DNA, 201 bp, Homo sapiens
tccaagctataaagatcagggaagacttcctggaggaattcacccttgagcaaaatcctaaaggatcaatagtagctggcaaaaagaagcaggaggaagcrcattctaggtagaggagacagcctggacaaaggtctgagggaggaaggaacacaaggagtgcaggacactttcatgagtgcaggacactttcataactgc

SEQ ID NO: 10998 - DNA, 201 bp, Homo sapiens
acacctcattcttgctgcttcagcccctatcacatagctcactggaaaatgatgttaaagtaagaattgcactcctgtccctctggccttccatctctccygcccttgtgccccacaacctggccaacagtactggaagaaactggacacagtcaccagcatcccaggggagggcaaaacagccatgtcgtgccctgatga

SEQ ID NO: 10999 - DNA, 201 bp, Homo sapiens
gaaataattgtgtcatgattaatgtgtatttactgtactaattagaaaatatagtttgaggccgggcacggtggctcacgcctgtaatcccagtacttggkaggccaaggcaggcatatcaacttgaggccaggagttaaagagcagcctggctaacatggtgaaaccccatctctactaaaaatacaaaaaattagccga

SEQ ID NO: 11000 - DNA, 201 bp, Homo sapiens
cctgggagacatgaccagtgaagaagtgatgtctttgatgagttccctgagagttcccagccagtggcagagaaatatcacatataagtcaaaccctaatyggatattgcctgattctgtggactggagagagaaagggtgtgttactgaagtgaaatatcaaggttcttgtggtgcttgctgggctttcagtgctgtggg

SEQ ID NO: 11001 - DNA, 201 bp, Homo sapiens
gtgatgcttcacaacctggagcattcaatgggaatgcactcatacgatctgggcatgaaccacctgggagacatgaccagtgaagaagtgatgtctttgaygagttccctgagagttcccagccagtggcagagaaatatcacatataagtcaaaccctaatcggatattgcctgattctgtggactggagagagaaaggg

SEQ ID NO: 11002 - DNA, 201 bp, Homo sapiens
tcatgtgacaagttccaatttcttttcaagtcaattgaactgaaatctccttgttgctttgaaatcttagaagagagcccactaattcaaggactcttacygtaggagcaactgctggttctatcacaatgaaacggctggtttgtgtgctcttggtgtgctcctctgcagtggcacagttgcataaagatcctaccctgg

SEQ ID NO: 11003 - DNA, 201 bp, Homo sapiens
tactgaagtgaaatatcaaggttcttgtggtgcttgctgggctttcagtgctgtgggggccctggaagcacagctgaagctgaaaacaggaaagctggtgwctctcagtgcccagaacctggtggattgctcaactgaaaaatatggaaacaaaggctgcaatggtggcttcatgacaacggctttccagtacatcattga

SEQ ID NO: 11004 - DNA, 201 bp, Homo sapiens
tgtgacaagttccaatttcttttcaagtcaattgaactgaaatctccttgttgctttgaaatcttagaagagagcccactaattcaaggactcttactgtrggagcaactgctggttctatcacaatgaaacggctggtttgtgtgctcttggtgtgctcctctgcagtggcacagttgcataaagatcctaccctggatc

SEQ ID NO: 11005 - DNA, 201 bp, Homo sapiens
cagacgcttcctatccctacaaagccatggtgtctactatgaaccatcctgtactcagaatgtgaatcatggtgtacttgtggttggctatggtgatcttsatgggaaagaatactggcttgtgaaaaacagctggggccacaactttggtgaagaaggatatattcggatggcaagaaataaaggaaatcattgtgggat

SEQ ID NO: 11006 - DNA, 201 bp, Homo sapiens
tccttgttgctttgaaatcttagaagagagcccactaattcaaggactcttactgtaggagcaactgctggttctatcacaatgaaacggctggtttgtgygctcttggtgtgctcctctgcagtggcacagttgcataaagatcctaccctggatcaccactggcatctctggaagaaaacctatggcaaacaatacaag

SEQ ID NO: 11007 - DNA, 201 bp, Homo sapiens
gaagtggtgtctactatgaaccatcctgtactcagaatgtgaatcatggtgtacttgtggttggctatggtgatcttaatgggaaagaatactggcttgtkaaaaacagctggggccacaactttggtgaagaaggatatattcggatggcaagaaataaaggaaatcattgtgggattgctagctttccctcttacccag

SEQ ID NO: 11008 - DNA, 201 bp, Homo sapiens
cttaacttaatttttcctgctgtatccagaagaaataattgtgtcatgattaatgtgtatttactgtactaattagaaaatatagtttgaggccgggcackgtggctcacgcctgtaatcccagtacttgggaggccaaggcaggcatatcaacttgaggccaggagttaaagagcagcctggctaacatggtgaaacccc

SEQ ID NO: 11009 - DNA, 201 bp, Homo sapiens; identical to SEQ ID NO: 11000

SEQ ID NO: 11010 - DNA, 201 bp, Homo sapiens; identical to SEQ ID NO: 11001

SEQ ID NO: 11011 - DNA, 201 bp, Homo sapiens
gcacggtggctcacgcctgtaatcccagtacttgggaggccaaggcaggcatatcaacttgaggccaggagttaaagagcagcctggctaacatggtgaarccccatctctactaaaaatacaaaaaattagccgagcacggtggtgcatgcctgtaatcccagctacttgggaggctgaggcacgagattccttgaaccc

SEQ ID NO: 11012 - DNA, 201 bp, Homo sapiens; identical to SEQ ID NO: 11002

SEQ ID NO: 11013 - DNA, 201 bp, Homo sapiens; identical to SEQ ID NO: 11003

SEQ ID NO: 11014 - DNA, 201 bp, Homo sapiens
cagacgcttcctatccctacaaagccatggatcagaaatgtcaatatgactcaaaatatcgtgctgccacatgttcaaagtacactgaacttccttatggsagagaagatgtcctgaaagaagctgtggccaataaaggcccagtgtctgttggtgtagatgcgcgtcatccttctttcttcctctacagaagtggtgtct

SEQ ID NO: 11015 - DNA, 201 bp, Homo sapiens; identical to SEQ ID NO: 11004

SEQ ID NO: 11016 - DNA, 201 bp, Homo sapiens; identical to SEQ ID NO: 11006

SEQ ID NO: 11017 - DNA, 201 bp, Homo sapiens; identical to SEQ ID NO: 11007

SEQ ID NO: 11018 - DNA, 201 bp, Homo sapiens; identical to SEQ ID NO: 11000

SEQ ID NO: 11019 - DNA, 201 bp, Homo sapiens
atgattaatgtgtatttactgtactaattagaaaatatagtttgaggcgtgagccactgagcccagcctacttttcagtttttaacataatttttgttttrtccacaacttttcaagtattgaaagtagaataaaaacatgggttcttagtctttagctatctgttaaagcctatgaatgccttcttaaaatcatgttttt

SEQ ID NO: 11020 - DNA, 201 bp, Homo sapiens; identical to SEQ ID NO: 11001

SEQ ID NO: 11021 - DNA, 201 bp, Homo sapiens; identical to SEQ ID NO: 11002

SEQ ID NO: 11022 - DNA, 201 bp, Homo sapiens
aatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagat

SEQ ID NO: 11023 - DNA, 201 bp, Homo sapiens; identical to SEQ ID NO: 11003

SEQ ID NO: 11024 - DNA, 201 bp, Homo sapiens
atgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatg

SEQ ID NO: 11025 - DNA, 201 bp, Homo sapiens; identical to SEQ ID NO: 11014

SEQ ID NO: 11026 - DNA, 201 bp, Homo sapiens; identical to SEQ ID NO: 11004

SEQ ID NO: 11027 - DNA, 201 bp, Homo sapiens
tgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgc

SEQ ID NO: 11028 - DNA, 201 bp, Homo sapiens
gccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgca

SEQ ID NO: 11029 - DNA, 201 bp, Homo sapiens; identical to SEQ ID NO: 11006

SEQ ID NO: 11030 - DNA, 143 bp, Homo sapiens
cctggagggaccgaaggtgccgagggctccgcatcgcaaccawggcgctgcgctggggcatcgtgtctgtcggcctcatctccagcgacttcacagccgtgctgcagacgctgcctcgctctgagcaccaggtggtggcggtg

SEQ ID NO: 11031 - DNA, 201 bp, Homo sapiens
ggcccgatcccgagccctcttccttatggaggccatctggacccgcttctttcctgcctccgaggctctgaggtctgttttggcccagggaactctaggasacctccgggtggctcgggcagaatttgggaagaatctcatccacgttccccgggccgtagaccgggcccaggctgggggggccctgctggacatcggcat

SEQ ID NO: 11032 - DNA, 201 bp, Homo sapiens
tagaccgggcccaggctgggggggccctgctggacatcggcatctactgtgtccagttcacctccatggtctttggagggcagaagccagagaagatttcygtcgtgggaaggcgtcatgaaacaggtgtggatgacactgtcacggtgctcctgcagtacccaggggaggtccatggcagcttcacctgcagcatcaccg

SEQ ID NO: 11033 - DNA, 201 bp, Homo sapiens
cgtgggaaggcgtcatgaaacaggtgtggatgacactgtcacggtgctcctgcagtacccaggggaggtccatggcagcttcacctgcagcatcaccgtgyagctctccaacacggcctccgtgagcggcaccaagggcatggtacagctcctcaacccctgctggtgcccgaccgagctggtggtgaagggggagcataa

SEQ ID NO: 11034 - DNA, 201 bp, Homo sapiens
gcggtggcggcccgcgatctgagccgtgcgaaggagtttgcacagaaacacgacatccccaaggcctacggctcctatgaggagctggccaaggacccgarcgtggaggtggcctacattggcacccagcacccccagcacaaggcggcggtgatgctgtgcttggcggcgggcaaggccgttctgtgcgagaagcccacg

SEQ ID NO: 11035 - DNA, 201 bp, Homo sapiens
gggcatggtacagctcctcaacccctgctggtgcccgaccgagctggtggtgaagggggagcataaggagttcccgctgcccccagtcccaaaggactgcrattttgacaacggggcaggcatgagttatgaggccaagcacgtctgggagtgcctacgcaagggtatgaaggaaagtcctgtgattcccctgtcggaaag

SEQ ID NO: 11036 - DNA, 201 bp, Homo sapiens
ggagctggccaaggacccgagcgtggaggtggcctacattggcacccagcacccccagcacaaggcggcggtgatgctgtgcttggcggcgggcaaggccrttctgtgcgagaagcccacgggcgtgaacgcggcggaagttcgcgagatggtcgcggaggcccgatcccgagccctcttccttatggaggccatctggac

SEQ ID NO: 11037 - DNA, 201 bp, Homo sapiens
cctacattggcacccagcacccccagcacaaggcggcggtgatgctgtgcttggcggcgggcaaggccgttctgtgcgagaagcccacgggcgtgaacgcrgcggaagttcgcgagatggtcgcggaggcccgatcccgagccctcttccttatggaggccatctggacccgcttctttcctgcctccgaggctctgaggt

SEQ ID NO: 11038 - DNA, 201 bp, Homo sapiens
aggagctggccaaggacccgagcgtggaggtggcctacattggcacccagcacccccagcacaaggcggcggtgatgctgtgcttggcggcgggcaaggcsgttctgtgcgagaagcccacgggcgtgaacgcggcggaagttcgcgagatggtcgcggaggcccgatcccgagccctcttccttatggaggccatctgga

SEQ ID NO: 11039 - DNA, 201 bp, Homo sapiens
gctcctcaacccctgctggtgcccgaccgagctggtggtgaagggggagcataaggagttcccgctgcccccagtcccaaaggactgcaattttgacaacrgggcaggcatgagttatgaggccaagcacgtctgggagtgcctacgcaagggtatgaaggaaagtcctgtgattcccctgtcggaaagtgagctcctggc

SEQ ID NO: 11040 - DNA, 145 bp, Homo sapiens
cctggagggaccgaaggtgccgagggctccgcatcgcaaccatgscgctgcgctggggcatcgtgtctgtcggcctcatctccagcgacttcacagccgtgctgcagacgctgcctcgctctgagcaccaggtggtggcggtggc

SEQ ID NO: 11041 - DNA, 201 bp, Homo sapiens
gtgctcctgcagtacccaggggaggtccatggcagcttcacctgcagcatcaccgtgcagctctccaacacggcctccgtgagcggcaccaagggcatggyacagctcctcaacccctgctggtgcccgaccgagctggtggtgaagggggagcataaggagttcccgctgcccccagtcccaaaggactgcaattttgac

SEQ ID NO: 11042 - DNA, 201 bp, Homo sapiens
ccaaaggactgcaattttgacaacggggcaggcatgagttatgaggccaagcacgtctgggagtgcctacgcaagggtatgaaggaaagtcctgtgattcycctgtcggaaagtgagctcctggctgacatccttgaagaggtgaggaaggccattggagtcaccttcccccaagacaaacgctgatgtatccccgaataa

SEQ ID NO: 11043 - DNA, 201 bp, Homo sapiens
cgggcgtgaacgcggcggaagttcgcgagatggtcgcggaggcccgatcccgagccctcttccttatggaggccatctggacccgcttctttcctgcctcygaggctctgaggtctgttttggcccagggaactctaggagacctccgggtggctcgggcagaatttgggaagaatctcatccacgttccccgggccgtag

SEQ ID NO: 11044 - DNA, 201 bp, Homo sapiens
ttgccaggtcctggacccctgctccagtacctgagcctgcccttcttccgagagatgaatgtggatggggactggcccccgcttgaggagcccagccctgytgcacccccagattacatggatacccggcgctgtcccacctcatctttccttcgttctccagaaacccctcctgtatcccccagggaatcacttcctggg

SEQ ID NO: 11045 - DNA, 159 bp, Homo sapiens
ggtatggaatgtatgtgctgaccccctaggtgagtctggggattggaacagggatcttaggtctgcctctctctctctctctctctctctctctctctctstgtgtgtgtgtgtgtgtgtgaagttttttacaggtgaataaacaaagtttgaaagatg

SEQ ID NO: 11046 - DNA, 158 bp, Homo sapiens
agagtggagccgagcggtgcggagcagatctggtggttctccggagagcagcttcctygggtgttacatgagccaagccctcactgtacagaagagtgagagctgaaacctgttccctgagctgatcagaaggacatcccttggcccctccatctggg

SEQ ID NO: 11047 - DNA, 201 bp, Homo sapiens
atggtgtggtgcctcggcctggccgtcctcagcctggtcatcagccagggggctgacggtcgagggaagcctgaggtggtatcggtggtgggccgggctgrggagagtgtggtgctgggctgtgacctgctgcccccggccggccggccccccctgcatgtcatcgagtggctgcgctttggattcctgcttcccatcttc

SEQ ID NO: 11048 - DNA, 201 bp, Homo sapiens
cgtctccacttccggtctggaggtctacccttcgcgcacgcagctgccgggcctcctgcctcagcccgtgctggccggcgtggtgggcggagtctgctttytgggagtggccgtccttgtgagcatcctggccggctgcctcctgaaccggcgcagggctgcccgccgccgccgcaagcgcctccgccaagatccacctct

SEQ ID NO: 11049 - DNA, 201 bp, Homo sapiens
ggcctcctgcctcagcccgtgctggccggcgtggtgggcggagtctgctttctgggagtggccgtccttgtgagcatcctggccggctgcctcctgaaccsgcgcagggctgcccgccgccgccgcaagcgcctccgccaagatccacctcttatcttctctccgaccgggaagtcagctgcaccctctgctctgggctca

SEQ ID NO: 11050 - DNA, 201 bp, Homo sapiens
cgagaactatgagtgggactcagaattccctggggacatggaattgctggagactttgcacctgggcttggccagctcccggctcagacctgaagctgagmcagagctaggtgtgaagactccagaggagggctgcctcctgaacactgcccatgttactggccctgaggcccgctgtgctgcccttcgggaggaattcct

SEQ ID NO: 11051 - DNA, 201 bp, Homo sapiens
tggccttccgccgccgccgagatgctactagggctcggctaccagcctatcgacagccagtcccccaccccgaacaggccactctgctgtgaacatccctratgtgaggctgtgaaaaggcatatggacctgcaaaggaggcccccaaccagacagacctagtttcaaacgagggcactgcccctgcctgcccctttggtg

SEQ ID NO: 11052 - DNA, 201 bp, Homo sapiens
agcccccttacacagccctggctgactggacactgagggagcggctgctgccaggccttctccctgctgcccctcgaggcagcctcaccagccagagcagbgggcgaggcagcgcttcgttcctgcggcccccctccacagccccctctgcaggaggcagctacctcagccctgctccaggagacaccagcagctgggcca

SEQ ID NO: 11053 - DNA, 201 bp, Homo sapiens
gcccggtcctttgactgtagcagcagcagccccagtggggcaccccagcccctctgcattgaagacatcagccctgtggcaccccctccagcagccccacycagtcccttgccaggtcctggacccctgctccagtacctgagcctgcccttcttccgagagatgaatgtggatggggactggcccccgcttgaggagccc

SEQ ID NO: 11054 - DNA, 201 bp, Homo sapiens
aattcctggccttccgccgccgccgagatgctactagggctcggctaccagcctatcgacagccagtcccccaccccgaacaggccactctgctgtgaacrtccctaatgtgaggctgtgaaaaggcatatggacctgcaaaggaggcccccaaccagacagacctagtttcaaacgagggcactgcccctgcctgcccct

SEQ ID NO: 11055 - DNA, 201 bp, Homo sapiens
actgagggcagcgccacccacgccacccagctgctagtgctaggacccccagtcatcgtggtgccccccaagaacagcacagtcaatgcctcccaggatgyttcattggcctgccatgctgaggcataccctgctaacctcacctacagctggttccaggacaacatcaatgtcttccacattagccgcctgcagccccgg

SEQ ID NO: 11056 - DNA, 201 bp, Homo sapiens
cccacgccacccagctgctagtgctaggacccccagtcatcgtggtgccccccaagaacagcacagtcaatgcctcccaggatgtttcattggcctgccaygctgaggcataccctgctaacctcacctacagctggttccaggacaacatcaatgtcttccacattagccgcctgcagccccgggtgcggatcctggtgg

SEQ ID NO: 11057 - DNA, 201 bp, Homo sapiens
tccacattagccgcctgcagccccgggtgcggatcctggtggacgggagcctgcggctgctggccacccagcctgatgatgccggctgctacacctgtgtrcccagcaatggcctcctgcatccaccctcagcctctgcctacctcactgtgctctacccagcccaggtgacagctatgcctcctgagacacccctgccca

SEQ ID NO: 11058 - DNA, 201 bp, Homo sapiens
gggatcctgccggaactcccagcccccacccggatcctccatctagccggggacccttacctctggagcccatttgccggggcccagacgggcgctttgtkatggggcccactgtggcggccccccaggaaaggtcaggccgggagcaggcagaacctcggactccagcccagcgtctggcccggtcctttgactgtagca

SEQ ID NO: 11059 - DNA, 201 bp, Homo sapiens
gttacatgagccaagccctcactgtacagaagagtgagagctgaaacctgttccctgagctgatcagaaggacatcccttggcccctccatctgggctccygtggataggaggggctgggtgagcaggccagctgggctatggtgtggtgcctcggcctggccgtcctcagcctggtcatcagccagggggctgacggtcg

SEQ ID NO: 11060 - DNA, 201 bp, Homo sapiens
cccaggaaaggtcaggccgggagcaggcagaacctcggactccagcccagcgtctggcccggtcctttgactgtagcagcagcagccccagtggggcaccycagcccctctgcattgaagacatcagccctgtggcaccccctccagcagccccacccagtcccttgccaggtcctggacccctgctccagtacctgagcc

SEQ ID NO: 11061 - DNA, 201 bp, Homo sapiens
aagatctaaaggacatggaacgaaggcagcaacaaaaactgaagatgcaagctgagattaagcgcatcaatgatgaaaaccagaaacagaaagcagaactsctggctcaggagaagctggcagaccagatggtgatggagtttaccaagaagaagatggctcgagaagcagagtttgaggctgagcaggagagaatccgga

SEQ ID NO: 11062 - DNA, 201 bp, Homo sapiens
gaggagctcaaggacatgagcaagattatcctcaatgctaagtgccatgccatccgggatgcccaaatcctggagaagcagcagatccaaaaagaactggrcacagaagagaagcggttggatcagatgatggaagtggagcggcagaaatccattcaaaggcaggaggaactggagaggaagaggagggaggaaagaatt

SEQ ID NO: 11063 - DNA, 201 bp, Homo sapiens
agtccggagtcagggcgtgtggctgaggagatgccactaagcacagctggcatcctgagctcctcttctgccgcttccaacaggtcaaggaataaggctcrctatcggaccaaagccgtgagctctgaggtggatgagagcctctttggagatatcaagtccccagcccagggccagagcgacagccccattgtgctgctc

SEQ ID NO: 11064 - DNA, 201 bp, Homo sapiens
aggcggcaaattgtggaacagatggaaaagaaccaggaggagcgatcgctgcttgctgagcagcgggagcaggagaaggagcagatgctggaatatatggracagctccaagaggaagatctaaaggacatggaacgaaggcagcaacaaaaactgaagatgcaagctgagattaagcgcatcaatgatgaaaaccagaaa

SEQ ID NO: 11065 - DNA, 201 bp, Homo sapiens
agatatcaagtccccagcccagggccagagcgacagccccattgtgctgctccgagataagcatacccttcaaaaaactctcactgctttgggcttggatygcaagccagagaccatccagctcatcacccgggacatggtccgagaactcattgttcccacagaggatccctccggggagtccctaatcatcagccctga

SEQ ID NO: 11066 - DNA, 180 bp, Homo sapiens
tactgcattgaagctgagcgcaaagctaacatcctgccagctacctctgtgaactgaggggagccttcgtggccctcaggatgccttcgggggacagattytgcccagtctctgggcatccataattgctgctaacctagacatttcatagttacagattaaatctacttgactttaagg

SEQ ID NO: 11067 - DNA, 201 bp, Homo sapiens
ccaacaagctgcggatggagcaggaggaggagctcaaggacatgagcaagattatcctcaatgctaagtgccatgccatccgggatgcccaaatcctggaraagcagcagatccaaaaagaactggacacagaagagaagcggttggatcagatgatggaagtggagcggcagaaatccattcaaaggcaggaggaactgg

SEQ ID NO: 11068 - DNA, 201 bp, Homo sapiens
tgggaacaaggtccttttgcacctcaacctcatccggaaccgcatcacagaggtggggctggagggcttcctcgccacggtgcagtatcagatgcagttckccaaggccaagagtgcatccaagggtccagtggggctgctgtggctgtccctggctgtgagtccctttcactctctcctgctgaagcagacgttgcccct

SEQ ID NO: 11069 - DNA, 201 bp, Homo sapiens
catccggaaccgcatcacagaggtggggctggagggcttcctcgccacggtgcagtatcagatgcagttctccaaggccaagagtgcatccaagggtccartggggctgctgtggctgtccctggctgtgagtccctttcactctctcctgctgaagcagacgttgcccctatcagctgtcatactagacagctgctgcag

SEQ ID NO: 11070 - DNA, 201 bp, Homo sapiens
gaggtggtcaaccctctcctggagcctgtggagcaccgagatgggaaagttttcatgcctgggaacaaggtccttttgcacctcaacctcatccggaaccrcatcacagaggtggggctggagggcttcctcgccacggtgcagtatcagatgcagttctccaaggccaagagtgcatccaagggtccagtggggctgctg

SEQ ID NO: 11071 - DNA, 201 bp, Homo sapiens
agagacgctgcggacaacaccagcatgtcgagcgagcagagcgcgccgggggcctcacccagggccccgcgtccggggacccagaagtcttctggcgcggygaccaaaaagggagagcgcgcggccaaagagaagccagcgaccgttctgcctcccgtgggggaggaggagcccaaaagccctgaggagtaccagtgctcc

SEQ ID NO: 11072 - DNA, 201 bp, Homo sapiens
tcaaccacatcggtgacgagggcgcaggctacatcgcggacggcctccggctgaaccgttccctgctctggctgtccctggcccacaaccgcatccaggayaagggcgccctgaagctggctgaggtcctgcgcgccttcgagctgacacacaccgaagtggtggagcgccgacgcctcctgctggaaaaagggacacagg

SEQ ID NO: 11073 - DNA, 201 bp, Homo sapiens
acgagggcgcaggctacatcgcggacggcctccggctgaaccgttccctgctctggctgtccctggcccacaaccgcatccaggacaagggcgccctgaarctggctgaggtcctgcgcgccttcgagctgacacacaccgaagtggtggagcgccgacgcctcctgctggaaaaagggacacaggagcgctcgcgatcgc

SEQ ID NO: 11074 - DNA, 201 bp, Homo sapiens
gagatgggaaagttttcatgcctgggaacaaggtccttttgcacctcaacctcatccggaaccgcatcacagaggtggggctggagggcttcctcgccacrgtgcagtatcagatgcagttctccaaggccaagagtgcatccaagggtccagtggggctgctgtggctgtccctggctgtgagtccctttcactctctcc

SEQ ID NO: 11075 - DNA, 201 bp, Homo sapiens
ctgtcctatgtaagaattgtcactgtgatattgaggatttcctcttctgaagggaggcaaaaggctttttctacctgtgcaggccacctcatggtcttccygatattctttggcagtgtatcactcatgtacttgcgtttcagcgacacttatccaccagttttggacacagccattgcactgatgtttactgtacttgct

SEQ ID NO: 11076 - DNA, 149 bp, Homo sapiens
caccagttttggacacagccattgcactgatgtttactgtacttgctccattcttcaatcccatcatttatagcctgagaaacaaggacatgaacaatgcrattaaaaaactgttctgtcttcaaaaagtgttgaacaagcctggaggt

SEQ ID NO: 11077 - DNA, 201 bp, Homo sapiens
cagaggggatcttgctgaccaccatggccattgacagatacgttgccatctgcaaccctcttcgctatcaaatgatcatgaccccccggctctgtgctcamctctctgcaggttcctgcctcttcggtttccttatcctgcttcccgagattgtgatgatttccacactgcctttctgtgggcccaaccaaatccatcaga

SEQ ID NO: 11078 - DNA, 110 bp, Homo sapiens
atggagagcrgaaaccaatcaacagtgactgaatttatcttcactggattccctcagcttcaggatggtagtctcctgtacttctttcctttacttttcatctatacttt

SEQ ID NO: 11079 - DNA, 201 bp, Homo sapiens
gattctgattgaggatgtgattcatgctgtgaccatcatcattaccttcctaatcattgccctgtcctatgtaagaattgtcactgtgatattgaggattycctcttctgaagggaggcaaaaggctttttctacctgtgcaggccacctcatggtcttcccgatattctttggcagtgtatcactcatgtacttgcgttt

SEQ ID NO: 11080 - DNA, 201 bp, Homo sapiens
ttctgaagggaggcaaaaggctttttctacctgtgcaggccacctcatggtcttcccgatattctttggcagtgtatcactcatgtacttgcgtttcagcracacttatccaccagttttggacacagccattgcactgatgtttactgtacttgctccattcttcaatcccatcatttatagcctgagaaacaaggacat

SEQ ID NO: 11081 - DNA, 201 bp, Homo sapiens
tggggcgcctcaagctgtgcgagggcgcgggcagcctgcacttcgtggacgcctttctctggaacggcagcatctacttcccctactacccctacaactayacgagcggcgctgccaccggctggcccagcatggcgcgcatcgcgcagagcaccgaggtgctgttccagggccaggcatccctcgactgcggccacggcc

SEQ ID NO: 11082 - DNA, 201 bp, Homo sapiens
tgaagatatgcataacagagacgccaacgacaagaatgaaagtctcacagctttggatgccctaatctgtaataaaagctttcttgttactgtcatccacmcccttgaaaagcagaagaacttttctgtgaaggacaggtgtctgtttgcctccttcctaaccattgcactgcaaaccaagctggtctacctgaccagcat

SEQ ID NO: 11083 - DNA, 201 bp, Homo sapiens
gacccaaggagaacaaggggaacagaaccaaccaggctttacaggtcttctacattaagtccattgagccacagaaagtatcgacattagggaaaagcaaygtgatagtaacgggagcaaactttacccgggcatcgaacatcacaatgatcctgaaaggaaccagtacctgtgataaggatgtgatacaggttagccatg

SEQ ID NO: 11084 - DNA, 201 bp, Homo sapiens
gcatcaagactgcaagcaccattgccaactcttctaagaaagttcgggtcaagctgggaaacctggagctctacgtcgagcaggagtcagttccttccacrtggtattttctgattgtgctccctgtcttgctagtgattgtcatttttgcggccgtgggggtgaccaggcacaaatcgaaggagctgagtcgcaaacaga

SEQ ID NO: 11085 - DNA, 201 bp, Homo sapiens
ctgttcggagtgtttaacagccacagaccctcactgcggttggtgccattcgctacaaaggtgcacttttcaaggagattgtgtacattcagagaacttasaaaactggctggatatttcgtctggagcaaaaaagtgccctaaaattcagataattcgaagcagtaaagaaaagactacagtgactatggtgggaagctt

SEQ ID NO: 11086 - DNA, 201 bp, Homo sapiens
tgcagtatcgggaggaccccagattcacggggtatcgggtggaatccgaggtggacacagaactggaagtgaaaattcaaaaagaaaatgacaacttcaayatttccaaaaaagacattgaaattactctcttccatggggaaaatgggcaattaaattgcagttttgaaaatattactagaaatcaagatcttaccacca

SEQ ID NO: 11087 - DNA, 201 bp, Homo sapiens
cgcgccgccctccccgctctccttcctgggcgagctgcggggatggggcggccgcgggagcccgagcgcgcgcaggaaccgccgccgccgccgcccgcgtytccgttgccgcgcgcctgagccgccgtcgccgccgcgcgccctgcccgggggcggcccccccagccccatggaggtctcccggaggaaggcgccgccgcg

SEQ ID NO: 11088 - DNA, 201 bp, Homo sapiens
acagagacgccaacgacaagaatgaaagtctcacagctttggatgccctaatctgtaataaaagctttcttgttactgtcatccacacccttgaaaagcaraagaacttttctgtgaaggacaggtgtctgtttgcctccttcctaaccattgcactgcaaaccaagctggtctacctgaccagcatcctagaggtgctga

SEQ ID NO: 11089 - DNA, 201 bp, Homo sapiens
ttgctataaaatacttttttgactttttggacgcccaggctgaaaacaaaaaaatcacagatcctgacgtcgtacatatttggaaaacaaacagccttccycttcgcttctgggtaaacatcctgaagaaccctcagtttgtctttgacattaagaagacaccacatatagacggctgtttgtcagtgattgcccaggcat

SEQ ID NO: 11090 - DNA, 201 bp, Homo sapiens
cggcgctctgcctcttcagaatgagtgagatccaggcgcgcgccaagagggtcagctgggacttcaagacggccgagagccactgcaaagaaggggatcarcctgaaagagtccaaccaatcgcatcatctaccttgatccattccgacctgacatccgtttatggcaccgtggtaatgaacaggactgttttattcttgg

SEQ ID NO: 11091 - DNA, 201 bp, Homo sapiens
ctgttcccttccttgactacaaacattttgctctgagaactttcttccctgagtcaggtggcttcacccacatcttcactgaagatatgcataacagagaygccaacgacaagaatgaaagtctcacagctttggatgccctaatctgtaataaaagctttcttgttactgtcatccacacccttgaaaagcagaagaact

SEQ ID NO: 11092 - DNA, 201 bp, Homo sapiens
aaatcacagatcctgacgtcgtacatatttggaaaacaaacagccttcctcttcgcttctgggtaaacatcctgaagaaccctcagtttgtctttgacatyaagaagacaccacatatagacggctgtttgtcagtgattgcccaggcattcatggatgcattttctctcacagagcagcaactagggaaggaagcaccaa

SEQ ID NO: 11093 - DNA, 201 bp, Homo sapiens; identical to SEQ ID NO: 11081

SEQ ID NO: 11094 - DNA, 201 bp, Homo sapiens; identical to SEQ ID NO: 11082

SEQ ID NO: 11095 - DNA, 201 bp, Homo sapiens; identical to SEQ ID NO: 11083

SEQ ID NO: 11096 - DNA, 201 bp, Homo sapiens; identical to SEQ ID NO: 11084

SEQ ID NO: 11097 - DNA, 201 bp, Homo sapiens; identical to SEQ ID NO: 11085

SEQ ID NO: 11098 - DNA, 201 bp, Homo sapiens; identical to SEQ ID NO: 11086

SEQ ID NO: 11099 - DNA, 201 bp, Homo sapiens; identical to SEQ ID NO: 11087

SEQ ID NO: 11100 - DNA, 201 bp, Homo sapiens
tctatatgagtgagtgtctccttgctttagatttctggtgaaccctgtggttatgaatacttgtgtgtgatttaaaaaaaaaaagatacattttacatttyatcgaattgctgttcacactggagtattatatataaatatatatatttgaggcccaaggcctgaaaaatattagtatacaacttggtatcttagtcttac

SEQ ID NO: 11101 - DNA, 201 bp, Homo sapiens; identical to SEQ ID NO: 11088

SEQ ID NO: 11102 - DNA, 201 bp, Homo sapiens; identical to SEQ ID NO: 11089

SEQ ID NO: 11103 - DNA, 201 bp, Homo sapiens; identical to SEQ ID NO: 11090

SEQ ID NO: 11104 - DNA, 201 bp, Homo sapiens; identical to SEQ ID NO: 11091

SEQ ID NO: 11105 - DNA, 201 bp, Homo sapiens; identical to SEQ ID NO: 11092

SEQ ID NO: 11106 - DNA, 201 bp, Homo sapiens
gggctgggccctccctgccacactagcttcccagggctgcccccgacaggctggctctcagtggaggccagagatctggaatcggggtcagcggggctacrgtccttccaggggctctggggcagctcccagcctcttcccatgctggtggccaccgtgtcccttgctgcggctgcatcttccagtctctcctccgtcttc

SEQ ID NO: 11107 - DNA, 201 bp, Homo sapiens
ccgacaggctggctctcagtggaggccagagatctggaatcggggtcagcggggctacagtccttccaggggctctggggcagctcccagcctcttcccaygctggtggccaccgtgtcccttgctgcggctgcatcttccagtctctcctccgtcttcctgtggccgctctctttataagaaccctggtcattgaattta

SEQ ID NO: 11108 - DNA, 201 bp, Homo sapiens
tcaaggaggctgtcaagaacctcgagtggattgcaggtggcacctggacaccctcagccctcaagtttgcctacgaccgcctcatcaaggagagccggcgscagaagacacgtgtgtttgcggtggtcatcacggacgggcgccacgaccctcgggacgatgacctcaacttgcgggcgctgtgcgaccgcgacgtcacag

SEQ ID NO: 11109 - DNA, 201 bp, Homo sapiens
aggaggctgtcaagaacctcgagtggattgcaggtggcacctggacaccctcagccctcaagtttgcctacgaccgcctcatcaaggagagccggcgccaraagacacgtgtgtttgcggtggtcatcacggacgggcgccacgaccctcgggacgatgacctcaacttgcgggcgctgtgcgaccgcgacgtcacagtga

SEQ ID NO: 11110 - DNA, 201 bp, Homo sapiens
cgaggagaccaaggcggcaagggggaccctggccgcccaggacgcagagggcccccgggagaaatcggggccaagggaagcaaggggtatcaaggcaacartggagccccaggaagtcctggtgtgaaaggagccaagggcgggcctgggccccgcggacccaaaggcgagccggggcgcaggggagaccccggcaccaag

SEQ ID NO: 11111 - DNA, 201 bp, Homo sapiens
cggacatcctgctcttccacatgaagcagttcgtgccgcagttcatcagccagctgcagaacgagttctacctggaccaggtggcgctgagctggcgctayggcggcctgcacttctctgaccaggtggaggtgttcagcccaccgggcagcgaccgggcctccttcatcaagaacctgcagggcatcagctccttccgcc

SEQ ID NO: 11112 - DNA, 201 bp, Homo sapiens
tcaagtttgcctacgaccgcctcatcaaggagagccggcgccagaagacacgtgtgtttgcggtggtcatcacggacgggcgccacgaccctcgggacgaygacctcaacttgcgggcgctgtgcgaccgcgacgtcacagtgacggccatcggcatcggggacatgttccacgagaagcacgagagtgaaaacctctact

SEQ ID NO: 11113 - DNA, 201 bp, Homo sapiens
tcgccgtggcccccaaccagaacctgaaggagcagggcctgcgggacatcgccagcacgccgcacgagctctaccgcaacgactacgccaccatgctgccygactccaccgagatcgaccaggacaccatcaaccgcatcatcaaggtcatgaaacacgaagcctacggagagtgctacaaggtgagctgcctggaaatcc

SEQ ID NO: 11114 - DNA, 201 bp, Homo sapiens
gccatcgctaaggaccccaagtccgagacagggacgcgtgtgggcgtggtgcagtacagccacgagggcacctttgaggccatccagctggacgacgaacrtatcgactccctgtcgagcttcaaggaggctgtcaagaacctcgagtggattgcaggtggcacctggacaccctcagccctcaagtttgcctacgaccgc

SEQ ID NO: 11115 - DNA, 201 bp, Homo sapiens
aggagagccggcgccagaagacacgtgtgtttgcggtggtcatcacggacgggcgccacgaccctcgggacgatgacctcaacttgcgggcgctgtgcgaycgcgacgtcacagtgacggccatcggcatcggggacatgttccacgagaagcacgagagtgaaaacctctactccatcgcctgcgacaagccacagcagg

SEQ ID NO: 11116 - DNA, 201 bp, Homo sapiens
acagccacgagggcacctttgaggccatccagctggacgacgaacatatcgactccctgtcgagcttcaaggaggctgtcaagaacctcgagtggattgcrggtggcacctggacaccctcagccctcaagtttgcctacgaccgcctcatcaaggagagccggcgccagaagacacgtgtgtttgcggtggtcatcacgg

SEQ ID NO: 11117 - DNA, 201 bp, Homo sapiens
ccagaacctgaaggagcagggcctgcgggacatcgccagcacgccgcacgagctctaccgcaacgactacgccaccatgctgcccgactccaccgagatcraccaggacaccatcaaccgcatcatcaaggtcatgaaacacgaagcctacggagagtgctacaaggtgagctgcctggaaatccctgggccctctggccc

SEQ ID NO: 11118 - DNA, 201 bp, Homo sapiens
gccacgagggcacctttgaggccatccagctggacgacgaacatatcgactccctgtcgagcttcaaggaggctgtcaagaacctcgagtggattgcaggyggcacctggacaccctcagccctcaagtttgcctacgaccgcctcatcaaggagagccggcgccagaagacacgtgtgtttgcggtggtcatcacggacg

SEQ ID NO: 11119 - DNA, 201 bp, Homo sapiens
cgggcacccgcccagccgggctgggccctccctgccacactagcttcccagggctgcccccgacaggctggctctcagtggaggccagagatctggaatcsgggtcagcggggctacagtccttccaggggctctggggcagctcccagcctcttcccatgctggtggccaccgtgtcccttgctgcggctgcatcttcca

SEQ ID NO: 11120 - DNA, 201 bp, Homo sapiens
agtggattgcaggtggcacctggacaccctcagccctcaagtttgcctacgaccgcctcatcaaggagagccggcgccagaagacacgtgtgtttgcggtrgtcatcacggacgggcgccacgaccctcgggacgatgacctcaacttgcgggcgctgtgcgaccgcgacgtcacagtgacggccatcggcatcggggaca

SEQ ID NO: 11121 - DNA, 191 bp, Homo sapiens
tccttccaggggctctggggcagctcccagcctcttcccatgctggtggccaccgtgtcccttgctgcggctgcatcttccagtctctcctccgtcttccwgtggccgctctctttataagaaccctggtcattgaatttaaggcccaccccaagtccagaatgacctcgcaagacccttaactcactccc

SEQ ID NO: 11122 - DNA, 201 bp, Homo sapiens
gtcagcggggctacagtccttccaggggctctggggcagctcccagcctcttcccatgctggtggccaccgtgtcccttgctgcggctgcatcttccagtytctcctccgtcttcctgtggccgctctctttataagaaccctggtcattgaatttaaggcccaccccaagtccagaatgacctcgcaagacccttaactc

SEQ ID NO: 11123 - DNA, 201 bp, Homo sapiens
agagtgctacaaggtgagctgcctggaaatccctgggccctctggccccaagggctaccgtggacagaagggtgccaagggcaacatgggtgagccgggaragcctggccagaagggaagacagggagacccgggcatcgaaggccccattggattcccaggacccaagggcgttcctggcttcaaaggagagaagggtga

SEQ ID NO: 11124 - DNA, 201 bp, Homo sapiens
gctggagaggttggcaacaaaggagccaagggagaccgaggcttgcctggacccagaggcccccagggagctcttggggagcccggaaagcagggatctcrgggagaccccggtgatgcaggaccccgtggagactcaggacagccaggccccaagggagaccccggcaggcctggattcagctacccaggaccccgagga

SEQ ID NO: 11125 - DNA, 201 bp, Homo sapiens
cgggagaaatcggggccaagggaagcaaggggtatcaaggcaacaatggagccccaggaagtcctggtgtgaaaggagccaagggcgggcctgggccccgyggacccaaaggcgagccggggcgcaggggagaccccggcaccaagggcagcccaggcagcgatggccccaagggggagaagggggaccctggccctgagg

SEQ ID NO: 11126 - DNA, 201 bp, Homo sapiens; identical to SEQ ID NO: 11108

SEQ ID NO: 11127 - DNA, 201 bp, Homo sapiens; identical to SEQ ID NO: 11109

SEQ ID NO: 11128 - DNA, 201 bp, Homo sapiens; identical to SEQ ID NO: 11112

SEQ ID NO: 11129 - DNA, 201 bp, Homo sapiens; identical to SEQ ID NO: 11111

SEQ ID NO: 11130 - DNA, 201 bp, Homo sapiens
acccggcttcttcgaccgcttcatccgctggatctgctagcgccgccgcccgggccccgcagtcgagggtcgtgagcccaccccgtccatggtgctaagcrggcccgggtcccacacggccagcaccgctgctcactcggacgacgccctgggcctgcacctctccagctcctcccacggggtccccgtagccccggcccc

SEQ ID NO: 11131 - DNA, 201 bp, Homo sapiens; identical to SEQ ID NO: 11113

SEQ ID NO: 11132 - DNA, 201 bp, Homo sapiens; identical to SEQ ID NO: 11114

SEQ ID NO: 11133 - DNA, 201 bp, Homo sapiens; identical to SEQ ID NO: 11115

SEQ ID NO: 11134 - DNA, 201 bp, Homo sapiens; identical to SEQ ID NO: 11116

SEQ ID NO: 11135 - DNA, 201 bp, Homo sapiens; identical to SEQ ID NO: 11117

SEQ ID NO: 11136 - DNA, 201 bp, Homo sapiens; identical to SEQ ID NO: 11118

SEQ ID NO: 11137 - DNA, 201 bp, Homo sapiens; identical to SEQ ID NO: 11120

SEQ ID NO: 11138 - DNA, 201 bp, Homo sapiens; identical to SEQ ID NO: 11123

SEQ ID NO: 11139 - DNA, 201 bp, Homo sapiens; identical to SEQ ID NO: 11124

SEQ ID NO: 11140 - DNA, 201 bp, Homo sapiens
gcagtcgagggtcgtgagcccaccccgtccatggtgctaagcgggcccgggtcccacacggccagcaccgctgctcactcggacgacgccctgggcctgcrcctctccagctcctcccacggggtccccgtagccccggcccccgcccagccccaggtctccccaggccctccgcaggctgcccggcctccctccccctgc

SEQ ID NO: 11141 - DNA, 201 bp, Homo sapiens
tcgagggtcgtgagcccaccccgtccatggtgctaagcgggcccgggtcccacacggccagcaccgctgctcactcggacgacgccctgggcctgcacctytccagctcctcccacggggtccccgtagccccggcccccgcccagccccaggtctccccaggccctccgcaggctgcccggcctccctccccctgcagcc

SEQ ID NO: 11142 - DNA, 201 bp, Homo sapiens
ccgtggacatcgtcttcctgctggacggctccgagcggctgggtgagcagaacttccacaaggcccggcgcttcgtggagcaggtggcgcggcggctgacrctggcccggagggacgacgaccctctcaacgcacgcgtggcgctgctgcagtttggtggccccggcgagcagcaggtggccttcccgctgagccacaacc

SEQ ID NO: 11143 - DNA, 201 bp, Homo sapiens
cggcgcactccatgcgcaagcagaacgtggtacccaccgtgctggccttgggcagcgacgtggacatggacgtgctcaccacgctcagcctgggtgaccgygccgccgtgttccacgagaaggactatgacagcctggcgcaacccggcttcttcgaccgcttcatccgctggatctgctagcgccgccgcccgggccccg

SEQ ID NO: 11144 - DNA, 201 bp, Homo sapiens
atcgtcttcctgctggacggctccgagcggctgggtgagcagaacttccacaaggcccggcgcttcgtggagcaggtggcgcggcggctgacgctggcccrgagggacgacgaccctctcaacgcacgcgtggcgctgctgcagtttggtggccccggcgagcagcaggtggccttcccgctgagccacaacctcacggcc

SEQ ID NO: 11145 - DNA, 201 bp, Homo sapiens; identical to SEQ ID NO: 11110

SEQ ID NO: 11146 - DNA, 201 bp, Homo sapiens
cccggagggacgacgaccctctcaacgcacgcgtggcgctgctgcagtttggtggccccggcgagcagcaggtggccttcccgctgagccacaacctcackgccatccacgaggcgctggagaccacacaatacctgaactccttctcgcacgtgggcgcaggcgtggtgcacgccatcaatgccatcgtgcgcagcccgc

SEQ ID NO: 11147 - DNA, 201 bp, Homo sapiens
cacgcgtggcgctgctgcagtttggtggccccggcgagcagcaggtggccttcccgctgagccacaacctcacggccatccacgaggcgctggagaccacrcaatacctgaactccttctcgcacgtgggcgcaggcgtggtgcacgccatcaatgccatcgtgcgcagcccgcgtggcggggcccggaggcacgcagagc

SEQ ID NO: 11148 - DNA, 201 bp, Homo sapiens
ccacgaggcgctggagaccacacaatacctgaactccttctcgcacgtgggcgcaggcgtggtgcacgccatcaatgccatcgtgcgcagcccgcgtggcrgggcccggaggcacgcagagctgtccttcgtgttcctcacggacggcgtcacgggcaacgacagtctgcacgagtcggcgcactccatgcgcaagcagaa

SEQ ID NO: 11149 - DNA, 201 bp, Homo sapiens
tgctggccttgggcagcgacgtggacatggacgtgctcaccacgctcagcctgggtgaccgcgccgccgtgttccacgagaaggactatgacagcctggcrcaacccggcttcttcgaccgcttcatccgctggatctgctagcgccgccgcccgggccccgcagtcgagggtcgtgagcccaccccgtccatggtgctaa

SEQ ID NO: 11150 - DNA, 201 bp, Homo sapiens
cttgggcagcgacgtggacatggacgtgctcaccacgctcagcctgggtgaccgcgccgccgtgttccacgagaaggactatgacagcctggcgcaacccrgcttcttcgaccgcttcatccgctggatctgctagcgccgccgcccgggccccgcagtcgagggtcgtgagcccaccccgtccatggtgctaagcgggcc

SEQ ID NO: 11151 - DNA, 201 bp, Homo sapiens
tatgacagcctggcgcaacccggcttcttcgaccgcttcatccgctggatctgctagcgccgccgcccgggccccgcagtcgagggtcgtgagcccacccygtccatggtgctaagcgggcccgggtcccacacggccagcaccgctgctcactcggacgacgccctgggcctgcacctctccagctcctcccacggggtc

SEQ ID NO: 11152 - DNA, 201 bp, Homo sapiens
catggacgtgctcaccacgctcagcctgggtgaccgcgccgccgtgttccacgagaaggactatgacagcctggcgcaacccggcttcttcgaccgcttcmtccgctggatctgctagcgccgccgcccgggccccgcagtcgagggtcgtgagcccaccccgtccatggtgctaagcgggcccgggtcccacacggccag

SEQ ID NO: 11153 - DNA, 201 bp, Homo sapiens
gcttcttcgaccgcttcatccgctggatctgctagcgccgccgcccgggccccgcagtcgagggtcgtgagcccaccccgtccatggtgctaagcgggccsgggtcccacacggccagcaccgctgctcactcggacgacgccctgggcctgcacctctccagctcctcccacggggtccccgtagccccggcccccgccc

SEQ ID NO: 11154 - DNA, 201 bp, Homo sapiens
gcactccatgcgcaagcagaacgtggtacccaccgtgctggccttgggcagcgacgtggacatggacgtgctcaccacgctcagcctgggtgaccgcgccrccgtgttccacgagaaggactatgacagcctggcgcaacccggcttcttcgaccgcttcatccgctggatctgctagcgccgccgcccgggccccgcagt

SEQ ID NO: 11155 - DNA, 201 bp, Homo sapiens
gcgcaacccggcttcttcgaccgcttcatccgctggatctgctagcgccgccgcccgggccccgcagtcgagggtcgtgagcccaccccgtccatggtgckaagcgggcccgggtcccacacggccagcaccgctgctcactcggacgacgccctgggcctgcacctctccagctcctcccacggggtccccgtagccccg

SEQ ID NO: 11156 - DNA, 201 bp, Homo sapiens; identical to SEQ ID NO: 11125

SEQ ID NO: 11157 - DNA, 201 bp, Homo sapiens
cccgcagtcgagggtcgtgagcccaccccgtccatggtgctaagcgggcccgggtcccacacggccagcaccgctgctcactcggacgacgccctgggccygcacctctccagctcctcccacggggtccccgtagccccggcccccgcccagccccaggtctccccaggccctccgcaggctgcccggcctccctccccc

SEQ ID NO: 11158 - DNA, 201 bp, Homo sapiens; identical to SEQ ID NO: 11106

SEQ ID NO: 11159 - DNA, 201 bp, Homo sapiens; identical to SEQ ID NO: 11107

SEQ ID NO: 11160 - DNA, 201 bp, Homo sapiens; identical to SEQ ID NO: 11108

SEQ ID NO: 11161 - DNA, 201 bp, Homo sapiens; identical to SEQ ID NO: 11109

SEQ ID NO: 11162 - DNA, 201 bp, Homo sapiens; identical to SEQ ID NO: 11110

SEQ ID NO: 11163 - DNA, 201 bp, Homo sapiens; identical to SEQ ID NO: 11111

SEQ ID NO: 11164 - DNA, 201 bp, Homo sapiens; identical to SEQ ID NO: 11112

SEQ ID NO: 11165 - DNA, 201 bp, Homo sapiens; identical to SEQ ID NO: 11113

SEQ ID NO: 11166 - DNA, 201 bp, Homo sapiens; identical to SEQ ID NO: 11114

SEQ ID NO: 11167 - DNA, 201 bp, Homo sapiens; identical to SEQ ID NO: 11115

SEQ ID NO: 11168 - DNA, 201 bp, Homo sapiens; identical to SEQ ID NO: 11116

SEQ ID NO: 11169 - DNA, 201 bp, Homo sapiens; identical to SEQ ID NO: 11117

SEQ ID NO: 11170 - DNA, 201 bp, Homo sapiens; identical to SEQ ID NO: 11118

SEQ ID NO: 11171 - DNA, 201 bp, Homo sapiens; identical to SEQ ID NO: 11119

SEQ ID NO: 11172 - DNA, 201 bp, Homo sapiens; identical to SEQ ID NO: 11120

SEQ ID NO: 11173 - DNA, 191 bp, Homo sapiens; identical to SEQ ID NO: 11121

SEQ ID NO: 11174 - DNA, 201 bp, Homo sapiens; identical to SEQ ID NO: 11122

SEQ ID NO: 11175 - DNA, 201 bp, Homo sapiens; identical to SEQ ID NO: 11123

SEQ ID NO: 11176 - DNA, 201 bp, Homo sapiens; identical to SEQ ID NO: 11124

SEQ ID NO: 11177 - DNA, 201 bp, Homo sapiens; identical to SEQ ID NO: 11125

SEQ ID NO: 11178 - DNA, 201 bp, Homo sapiens
caaaatataacacttctactcttcaccacgatatcatgttactaaagttgaaggagaaagccagcctgaccctggctgtggggacactccccttcccatcmcaattcaactttgtcccacctgggagaatgtgccgggtggctggctggggaagaacaggtgtgttgaagccgggctcagacactctgcaagaggtgaagc

SEQ ID NO: 11179 - DNA, 201 bp, Homo sapiens
cgcccctacatggcctacctggaaattgtaacttccaacggtccctcaaaattttgtggtggtttccttataagacggaactttgtgctgacggctgctcrttgtgcaggaaggtctataacagtcacccttggagcccataacataacagaggaagaagacacatggcagaagcttgaggttataaagcaattccgtcat

SEQ ID NO: 11180 - DNA, 201 bp, Homo sapiens
ccatcacaattcaactttgtcccacctgggagaatgtgccgggtggctggctggggaagaacaggtgtgttgaagccgggctcagacactctgcaagaggygaagctgagactcatggatccccaggcctgcagccacttcagagactttgaccacaatcttcagctgtgtgtgggcaatcccaggaagacaaaatctgca

SEQ ID NO: 11181 - DNA, 201 bp, Homo sapiens
cttgtgctccagagctgaagctggggagatcatcgggggcacagaatgcaagccacattcccgcccctacatggcctacctggaaattgtaacttccaacsgtccctcaaaattttgtggtggtttccttataagacggaactttgtgctgacggctgctcattgtgcaggaaggtctataacagtcacccttggagccca

SEQ ID NO: 11182 - DNA, 164 bp, Homo sapiens
tcctggatcctgagccagcctgaaagggaagctggaactggacctgagcagcaaagtgtgtgccactcattctggtctacccttggtccctcagccacaaycctaagcctccagaagtatcctacaggtcacagaactctcaataaacctcagtgaagacacag

SEQ ID NO: 11183 - DNA, 201 bp, Homo sapiens; identical to SEQ ID NO: 11178

SEQ ID NO: 11184 - DNA, 201 bp, Homo sapiens; identical to SEQ ID NO: 11179

SEQ ID NO: 11185 - DNA, 201 bp, Homo sapiens; identical to SEQ ID NO: 11180

SEQ ID NO: 11186 - DNA, 201 bp, Homo sapiens; identical to SEQ ID NO: 11181

SEQ ID NO: 11187 - DNA, 164 bp, Homo sapiens; identical to SEQ ID NO: 11182

SEQ ID NO: 11188 - DNA, 201 bp, Homo sapiens
agacatgcagtgtggccggctgggggcagacggcccccctgggaaaacactcacacacactacaagaggtgaagatgacagtgcaggaagatcgaaagtgygaatctgacttacgccattattacgacagtaccattgagttgtgcgtgggggacccagagattaaaaagacttcctttaagggggactctggaggccctc

SEQ ID NO: 11189 - DNA, 155 bp, Homo sapiens
atgaagtcactgagcctgctccacctctttcctctcccaagagctaaaagagagyaaggaggaaacaacagcagctccaaccagggcagccttcctgagaagatgcaaccaatcctgcttctgctggccttcctcctgctgcccagggcagatgc

SEQ ID NO: 11190 - DNA, 160 bp, Homo sapiens
atgaagtcactgagcctgctccacctctttcctctcccaagagctaaaagagagcaaggrggaaacaacagcagctccaaccagggcagccttcctgagaagatgcaaccaatcctgcttctgctggccttcctcctgctgcccagggcagatgcagggg

SEQ ID NO: 11191 - DNA, 201 bp, Homo sapiens
atcgggggacatgaggccaagccccactcccgcccctacatggcttatcttatgatctgggatcagaagtctctgaagaggtgcggtggcttcctgatacragacgacttcgtgctgacagctgctcactgttggggaagctccataaatgtcaccttgggggcccacaatatcaaagaacaggagccgacccagcagttt

SEQ ID NO: 11192 - DNA, 201 bp, Homo sapiens
tgggggcccacaatatcaaagaacaggagccgacccagcagtttatccctgtgaaaagacccatcccccatccagcctataatcctaagaacttctccaaygacatcatgctactgcagctggagagaaaggccaagcggaccagagctgtgcagcccctcaggctacctagcaacaaggcccaggtgaagccagggcaga

SEQ ID NO: 11193 - DNA, 189 bp, Homo sapiens
tgcctccacgagcctgcaccaaagtctcaagctttgtacactggataaagaaaaccatgaaacgctactaactacaggaagcaaactaagcccccgctgtratgaaacaccttctctggagccaagtccagatttacactgggagaggtgccagcaactgaataaatacctcttagctgagtggaaaag

SEQ ID NO: 11194 - DNA, 201 bp, Homo sapiens
agaggtgcggtggcttcctgatacgagacgacttcgtgctgacagctgctcactgttggggaagctccataaatgtcaccttgggggcccacaatatcaargaacaggagccgacccagcagtttatccctgtgaaaagacccatcccccatccagcctataatcctaagaacttctccaacgacatcatgctactgcagc

SEQ ID NO: 11195 - DNA, 201 bp, Homo sapiens
ccagggcattgtctcctatggacgaaacaatggcatgcctccacgagcctgcaccaaagtctcaagctttgtacactggataaagaaaaccatgaaacgcyactaactacaggaagcaaactaagcccccgctgtaatgaaacaccttctctggagccaagtccagatttacactgggagaggtgccagcaactgaataaa

SEQ ID NO: 11196 - DNA, 201 bp, Homo sapiens
gacagctgctcactgttggggaagctccataaatgtcaccttgggggcccacaatatcaaagaacaggagccgacccagcagtttatccctgtgaaaagasccatcccccatccagcctataatcctaagaacttctccaacgacatcatgctactgcagctggagagaaaggccaagcggaccagagctgtgcagcccct

SEQ ID NO: 11197 - DNA, 201 bp, Homo sapiens
agtctgatcagttctgcaagatgcccatcaacaacaagatggcccagtggggcaacaagcctgtatgctgagcaggaggcagacttgcagagcttgttttktttcatcctgtccgtaaggggtcagcgctcttgctttgctcttttcaatgaatagcacttatgttactggtgtccagctgagtttctcttgggtataaag

SEQ ID NO: 11198 - DNA, 201 bp, Homo sapiens
catggtttgccggggaaaagctcacctttgtggattttctcacctatgatatcttggatcagaaccgtatatttgaccccaagtgcctggatgagttcccraacctgaaggctttcatgtgccgttttgaggctttggagaaaatcgctgcctacttacagtctgatcagttctgcaagatgcccatcaacaacaagatgg

SEQ ID NO: 11199 - DNA, 201 bp, Homo sapiens
aagacgtaaaaagaaaaaaccataggctgctctgcctgtggagtaaccattctttattcttttactttttaaaataataacaatcacaaaggaaagatttrccaattgaataggatcaaattctacaacttttcctaaggcacccacaaataaatgacaagtgagacaaaaagcactagtataaagattatataaagacct

SEQ ID NO: 11200 - DNA, 201 bp, Homo sapiens
agaagttacccttaagctaggatgttgctcagaagtgaccatcccaactttggtgcgggcacaataaatcagcctaaatgtccctaatttaacccagctcrttataatgtcattaaacatgacattagcattgtggttttagcacccccatgggttttgcttaggcactcatgggtaataaccaagatggagtccctttgg

SEQ ID NO: 11201 - DNA, 201 bp, Homo sapiens
gtcagggcgcccgcgcgtgggccccgcccccttatgtcgggtataaagcccctcccgctcacagtttccctagtcctcgaaggctcggaagcccgtcaccstgtcgtgcgagtcgtctatggttctcgggtactgggatattcgtgggctggcgcacgccatccgcctgctcctggagttcacggatacctcttatgagga

SEQ ID NO: 11202 - DNA, 201 bp, Homo sapiens
cgcgcctgcgcacggccctgtggagccgcggaggcaagggacggagaacggggcggaggcggagtcagggcgcccgcgcgtgggccccgcccccttatgtmgggtataaagcccctcccgctcacagtttccctagtcctcgaaggctcggaagcccgtcaccatgtcgtgcgagtcgtctatggttctcgggtactggga

SEQ ID NO: 11203 - DNA, 201 bp, Homo sapiens
tgtatgctgagcaggaggcagacttgcagagcttgttttgtttcatcctgtccgtaaggggtcagcgctcttgctttgctcttttcaatgaatagcacttmtgttactggtgtccagctgagtttctcttgggtataaaggctaaaagggaaaaaggatatgtggagaatcatcaagatatgaattgaatcgctgcgatac

SEQ ID NO: 11204 - DNA, 201 bp, Homo sapiens
gggccccgcccccttatgtcgggtataaagcccctcccgctcacagtttccctagtcctcgaaggctcggaagcccgtcaccatgtcgtgcgagtcgtctmtggttctcgggtactgggatattcgtgggctggcgcacgccatccgcctgctcctggagttcacggatacctcttatgaggagaaacggtacacgtgcgg

SEQ ID NO: 11205 - DNA, 201 bp, Homo sapiens
ccagattgccatcccctatggaccagaagccaaggatctctctagtgatggtcagagggcccaaatggcagggatacccagtgatgtcaggaggaatagtrcagacagaaggtgctaagcagacaattcaactgccatgttttgccaccccctgtgagcagggattaggtgttcaggccagtatcttgggcatgggggagc

SEQ ID NO: 11206 - DNA, 201 bp, Homo sapiens
tcacctttgtggattttctcacctatgatatcttggatcagaaccgtatatttgaccccaagtgcctggatgagttcccaaacctgaaggctttcatgtgycgttttgaggctttggagaaaatcgctgcctacttacagtctgatcagttctgcaagatgcccatcaacaacaagatggcccagtggggcaacaagcctg

SEQ ID NO: 11207 - DNA, 201 bp, Homo sapiens
atattgatgaaaatgtaagaatttttgtgaccacggggtaggagaagtttctttaaagacgtaaaaagaaaaaaccataggctgctctgcctgtggagtarccattctttattcttttactttttaaaataataacaatcacaaaggaaagatttaccaattgaataggatcaaattctacaacttttcctaaggcaccca

SEQ ID NO: 11208 - DNA, 201 bp, Homo sapiens
ccgttttgaggctttggagaaaatcgctgcctacttacagtctgatcagttctgcaagatgcccatcaacaacaagatggcccagtggggcaacaagcctrtatgctgagcaggaggcagacttgcagagcttgttttgtttcatcctgtccgtaaggggtcagcgctcttgctttgctcttttcaatgaatagcacttat

SEQ ID NO: 11209 - DNA, 201 bp, Homo sapiens; identical to SEQ ID NO: 11197

SEQ ID NO: 11210 - DNA, 201 bp, Homo sapiens; identical to SEQ ID NO: 11198

SEQ ID NO: 11211 - DNA, 201 bp, Homo sapiens; identical to SEQ ID NO: 11199

SEQ ID NO: 11212 - DNA, 201 bp, Homo sapiens; identical to SEQ ID NO: 11202

SEQ ID NO: 11213 - DNA, 201 bp, Homo sapiens; identical to SEQ ID NO: 11203

SEQ ID NO: 11214 - DNA, 201 bp, Homo sapiens; identical to SEQ ID NO: 11204

SEQ ID NO: 11215 - DNA, 201 bp, Homo sapiens; identical to SEQ ID NO: 11206

SEQ ID NO: 11216 - DNA, 201 bp, Homo sapiens; identical to SEQ ID NO: 11207

SEQ ID NO: 11217 - DNA, 201 bp, Homo sapiens; identical to SEQ ID NO: 11208

SEQ ID NO: 11218 - DNA, 201 bp, Homo sapiens; identical to SEQ ID NO: 11197

SEQ ID NO: 11219 - DNA, 201 bp, Homo sapiens; identical to SEQ ID NO: 11198

SEQ ID NO: 11220 - DNA, 201 bp, Homo sapiens; identical to SEQ ID NO: 11199

SEQ ID NO: 11221 - DNA, 201 bp, Homo sapiens; identical to SEQ ID NO: 11200

SEQ ID NO: 11222 - DNA, 201 bp, Homo sapiens; identical to SEQ ID NO: 11201

SEQ ID NO: 11223 - DNA, 201 bp, Homo sapiens; identical to SEQ ID NO: 11202

SEQ ID NO: 11224 - DNA, 201 bp, Homo sapiens; identical to SEQ ID NO: 11203

SEQ ID NO: 11225 - DNA, 201 bp, Homo sapiens; identical to SEQ ID NO: 11204

SEQ ID NO: 11226 - DNA, 201 bp, Homo sapiens; identical to SEQ ID NO: 11205

SEQ ID NO: 11227 - DNA, 201 bp, Homo sapiens; identical to SEQ ID NO: 11206

SEQ ID NO: 11228 - DNA, 201 bp, Homo sapiens; identical to SEQ ID NO: 11207

SEQ ID NO: 11229 - DNA, 201 bp, Homo sapiens; identical to SEQ ID NO: 11208

SEQ ID NO: 11230 - DNA, 201 bp, Homo sapiens; identical to SEQ ID NO: 11197

SEQ ID NO: 11231 - DNA, 201 bp, Homo sapiens; identical to SEQ ID NO: 11198

SEQ ID NO: 11232 - DNA, 201 bp, Homo sapiens; identical to SEQ ID NO: 11199

SEQ ID NO: 11233 - DNA, 201 bp, Homo sapiens; identical to SEQ ID NO: 11201

SEQ ID NO: 11234 - DNA, 201 bp, Homo sapiens; identical to SEQ ID NO: 11202

SEQ ID NO: 11235 - DNA, 201 bp, Homo sapiens; identical to SEQ ID NO: 11203

SEQ ID NO: 11236 - DNA, 201 bp, Homo sapiens; identical to SEQ ID NO: 11204

SEQ ID NO: 11237 - DNA, 201 bp, Homo sapiens; identical to SEQ ID NO: 11206

SEQ ID NO: 11238 - DNA, 201 bp, Homo sapiens; identical to SEQ ID NO: 11207

SEQ ID NO: 11239 - DNA, 201 bp, Homo sapiens; identical to SEQ ID NO: 11208

SEQ ID NO: 11240 - DNA, 201 bp, Homo sapiens
aaagttgccattgcccggcgtatgccacctccagccaaccttccaagcctgaaagccgagaacaaaggcaatgaccccaatgtctcactagtgccaaaagwcggaacaggatgggcaagcaaacaggagcagtccgaccccaagagttccgatgcctcaaccgctcagccgccggaatcgcagccactgccggcttcacag

SEQ ID NO: 11241 - DNA, 201 bp, Homo sapiens
gaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggta

SEQ ID NO: 11242 - DNA, 201 bp, Homo sapiens
agaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactc

SEQ ID NO: 11243 - DNA, 201 bp, Homo sapiens
ccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcc

SEQ ID NO: 11244 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaa

SEQ ID NO: 11245 - DNA, 201 bp, Homo sapiens
aggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccct

SEQ ID NO: 11246 - DNA, 201 bp, Homo sapiens
gatacgtataagggcaagtccttagagatccagaaacccgctgttgcccctcgccatggcctgcagagtctcgggaaagttgccattgcccggcgtatgcsacctccagccaaccttccaagcctgaaagccgagaacaaaggcaatgaccccaatgtctcactagtgccaaaagacggaacaggatgggcaagcaaacag

SEQ ID NO: 11247 - DNA, 201 bp, Homo sapiens
ccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctc

SEQ ID NO: 11248 - DNA, 201 bp, Homo sapiens
gcagcaggataaaccgcctcgtttccggaggctgaagcaggaacgggagaatgccgcaagggggtctgagggcaagccctccctaacccttccagcctccrctcctggacctgaggaggccctcacaacagtcacagtggccccagcacctcgccgggcagctgccaagtctcctgatctgtcaaaccagaactcagacca

SEQ ID NO: 11249 - DNA, 201 bp, Homo sapiens; identical to SEQ ID NO: 11245

SEQ ID NO: 11250 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaagtcgtcctccagaggagcgtcccccggg

SEQ ID NO: 11251 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagt

SEQ ID NO: 11252 - DNA, 201 bp, Homo sapiens
atctggctccttcagacaaggaggctcccacacccaaggagggaacactcacccaggtccctctcgctcccccaccaccaggagccccaccttcaccagcsccagcccgcttcactgcccggggtgggcgagtcttcactcccagaggggtgccatctcgccggggccgaggaggagggaggccccctcctcaagtttgcc

SEQ ID NO: 11253 - DNA, 201 bp, Homo sapiens
acaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggca

SEQ ID NO: 11254 - DNA, 201 bp, Homo sapiens
gataaaccgcctcgtttccggaggctgaagcaggaacgggagaatgccgcaagggggtctgagggcaagccctccctaacccttccagcctccgctcctgsacctgaggaggccctcacaacagtcacagtggccccagcacctcgccgggcagctgccaagtctcctgatctgtcaaaccagaactcagaccaagccaat

SEQ ID NO: 11255 - DNA, 201 bp, Homo sapiens
aggctgcggatgaggatgacaaggggatgaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 11256 - DNA, 201 bp, Homo sapiens
ccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgcc

SEQ ID NO: 11257 - DNA, 201 bp, Homo sapiens; identical to SEQ ID NO: 11242

SEQ ID NO: 11258 - DNA, 201 bp, Homo sapiens
ggctgcggatgaggatgacaaggggatgaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 11259 - DNA, 201 bp, Homo sapiens; identical to SEQ ID NO: 11243

SEQ ID NO: 11260 - DNA, 201 bp, Homo sapiens
cggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctaccccccggcccagcccctccctcag

SEQ ID NO: 11261 - DNA, 201 bp, Homo sapiens
ggggagccatggactctcaattacatccaaacagtggaggcttccgccctgggacaccctcactgcacccttacagatcacagcccctatacctacccccsggcccagcccctccctcagcactgctctctggggtagctctcaagggccagtttctggatttctccacaatgcaagctacagagctggggaagttgccgg

SEQ ID NO: 11262 - DNA, 201 bp, Homo sapiens
cctaggagaccaccacctgccccccacgatggggacagaaaggagctgccccgggagcagcctctgccccctggccccattggcacagaacgatcacagcrtacagaccgaggcacagagcctggccccattcggccatcccatcgacctggtcccccagtccagtttggcactagtgacaaggactcagacttacgccta

SEQ ID NO: 11263 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggca

SEQ ID NO: 11264 - DNA, 201 bp, Homo sapiens
tacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 11265 - DNA, 191 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 11266 - DNA, 201 bp, Homo sapiens
ccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagt

SEQ ID NO: 11267 - DNA, 201 bp, Homo sapiens; identical to SEQ ID NO: 11240

SEQ ID NO: 11268 - DNA, 201 bp, Homo sapiens
gcagcaccagtggcagcagcatcaacagggctctgcccctcctaccccagtgcccccatcaccaccacagcctgtgaccctgggggctgtgccagctccamaggctccacccccgccccccaaggccctgtacccaggtgctctgggccggcccccacccatgcccccaatgaactttgatccccgatggatgatgattcc

SEQ ID NO: 11269 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaaggtccttctctggcctcaattcccgtctcaaggccacgccttccacctacagtggagtcttccgcacccagcgcgtcgacct

SEQ ID NO: 11270 - DNA, 201 bp, Homo sapiens
cgttccaggattatcaaaaactgagcagcaaccttgggggacctggatcatcacggactcccccaactggaaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 11271 - DNA, 201 bp, Homo sapiens
aaacggagcttctcaagtcagcggccaggcatggaacggcagaatcggcgccctggcccagggggcaaggctggcagcagtggcagcagcagtggaggagscggtgggggtcctggaggaaggaccgggccaggacgaggcgacaagaggagctggccctctcccaagaaccgaagtcgtcctccagaggagcgtcccccg

SEQ ID NO: 11272 - DNA, 201 bp, Homo sapiens
aggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 11273 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactc

SEQ ID NO: 11274 - DNA, 201 bp, Homo sapiens
gaaagagtgggtcctacctcttgccggggtcggggccgaggcgagtattttgccagagggaggggttttcgggggacctatgggggacgagggcggggagsccgaagccgggaattccgcagttaccgagagtttcgaggagatgatgggcgtggaggtgggacagggggaccaaaccaccctcctgctccccgaggccgc

SEQ ID NO: 11275 - DNA, 201 bp, Homo sapiens
aggtgggacagggggaccaaaccaccctcctgctccccgaggccgcactgccagcgagacacggagcgagggttcagagtatgaggaaatccccaagcggygccggcagcggggctcagaaacaggcagcgagacccatgagagtgatctggctccttcagacaaggaggctcccacacccaaggagggaacactcaccca

SEQ ID NO: 11276 - DNA, 201 bp, Homo sapiens
tcccacacccaaggagggaacactcacccaggtccctctcgctcccccaccaccaggagccccaccttcaccagccccagcccgcttcactgcccggggtsggcgagtcttcactcccagaggggtgccatctcgccggggccgaggaggagggaggccccctcctcaagtttgcccaggctggagccctccagccaagtc

SEQ ID NO: 11277 - DNA, 201 bp, Homo sapiens
tctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcggcctcccagaaaaccagagctgctacaggaggaatctttgcca

SEQ ID NO: 11278 - DNA, 201 bp, Homo sapiens
  misc_feature (1)...(201): n = A,T,C or G, or insertion/deletion polymorphism (see Tables 1-2)
cacagcaaccctgctggcatccaacaggctctggcccagcttagtagccgtcaagggagtgtaactgcaccagggggtcatccaaggcacaagcctgggcntccccaagcccctcagggcccctctcctaggcccccaacccgatacgagccccagagggtcaacagcggcctcagttctgacccccactttgaggagccg

SEQ ID NO: 11279 - DNA, 201 bp, Homo sapiens; identical to SEQ ID NO: 11246

SEQ ID NO: 11280 - DNA, 201 bp, Homo sapiens
attggcacagaacgatcacagcgtacagaccgaggcacagagcctggccccattcggccatcccatcgacctggtcccccagtccagtttggcactagtgrcaaggactcagacttacgcctagtggtaggagacagcttgaaagcagagaaggagctaacagcatcagtcactgaggccattcctgtatcacgagactgg

SEQ ID NO: 11281 - DNA, 201 bp, Homo sapiens
tacagaccgaggcacagagcctggccccattcggccatcccatcgacctggtcccccagtccagtttggcactagtgacaaggactcagacttacgcctartggtaggagacagcttgaaagcagagaaggagctaacagcatcagtcactgaggccattcctgtatcacgagactgggagctgcttcccagtgctgctgc

SEQ ID NO: 11282 - DNA, 201 bp, Homo sapiens; identical to SEQ ID NO: 11241

SEQ ID NO: 11283 - DNA, 201 bp, Homo sapiens
ccccagtccagtttggcactagtgacaaggactcagacttacgcctagtggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagc

SEQ ID NO: 11284 - DNA, 201 bp, Homo sapiens
tggaggcttccgccctgggacaccctcactgcacccttacagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 11285 - DNA, 201 bp, Homo sapiens
ctgcatccagtggaactaaagccgttccaggattatcaaaaactgagcagcaaccttgggggacctggatcatcacggactcccccaactggaaggtcctyctctggcctcaattcccgtctcaaggccacgccttccacctacagtggagtcttccgcacccagcgcgtcgacctttaccagcaggcctccccaccagat

SEQ ID NO: 11286 - DNA, 201 bp, Homo sapiens
ccacctgccccccacgatggggacagaaaggagctgccccgggagcagcctctgccccctggccccattggcacagaacgatcacagcgtacagaccgagscacagagcctggccccattcggccatcccatcgacctggtcccccagtccagtttggcactagtgacaaggactcagacttacgcctagtggtaggagac

SEQ ID NO: 11287 - DNA, 201 bp, Homo sapiens; identical to SEQ ID NO: 11247

SEQ ID NO: 11288 - DNA, 201 bp, Homo sapiens; identical to SEQ ID NO: 11245

SEQ ID NO: 11289 - DNA, 201 bp, Homo sapiens; identical to SEQ ID NO: 11248

SEQ ID NO: 11290 - DNA, 201 bp, Homo sapiens; identical to SEQ ID NO: 11250

SEQ ID NO: 11291 - DNA, 201 bp, Homo sapiens; identical to SEQ ID NO: 11251

SEQ ID NO: 11292 - DNA, 201 bp, Homo sapiens; identical to SEQ ID NO: 11252

SEQ ID NO: 11293 - DNA, 201 bp, Homo sapiens; identical to SEQ ID NO: 11253

SEQ ID NO: 11294 - DNA, 201 bp, Homo sapiens; identical to SEQ ID NO: 11254

SEQ ID NO: 11295 - DNA, 201 bp, Homo sapiens; identical to SEQ ID NO: 11242

SEQ ID NO: 11296 - DNA, 201 bp, Homo sapiens; identical to SEQ ID NO: 11255

SEQ ID NO: 11297 - DNA, 201 bp, Homo sapiens; identical to SEQ ID NO: 11256

SEQ ID NO: 11298 - DNA, 201 bp, Homo sapiens; identical to SEQ ID NO: 11243

SEQ ID NO: 11299 - DNA, 201 bp, Homo sapiens; identical to SEQ ID NO: 11258

SEQ ID NO: 11300 - DNA, 201 bp, Homo sapiens; identical to SEQ ID NO: 11260

SEQ ID NO: 11301 - DNA, 201 bp, Homo sapiens; identical to SEQ ID NO: 11261

SEQ ID NO: 11302 - DNA, 201 bp, Homo sapiens; identical to SEQ ID NO: 11262

SEQ ID NO: 11303 - DNA, 201 bp, Homo sapiens; identical to SEQ ID NO: 11263

SEQ ID NO: 11304 - DNA, 201 bp, Homo sapiens; identical to SEQ ID NO: 11264

SEQ ID NO: 11305 - DNA, 190 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattt

SEQ ID NO: 11306 - DNA, 201 bp, Homo sapiens; identical to SEQ ID NO: 11266

SEQ ID NO: 11307 - DNA, 201 bp, Homo sapiens; identical to SEQ ID NO: 11240

SEQ ID NO: 11308 - DNA, 201 bp, Homo sapiens; identical to SEQ ID NO: 11268

SEQ ID NO: 11309 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaagacgcccttcttcccttaggtccttctctggcctcaattcccgtctcaaggccacgccttccacctacagtggagtcttccg

SEQ ID NO: 11310 - DNA, 201 bp, Homo sapiens
aactgagcagcaaccttgggggacctggatcatcacggactcccccaactggaagacgcccttcttcccttaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 11311 - DNA, 201 bp, Homo sapiens; identical to SEQ ID NO: 11271

SEQ ID NO: 11312 - DNA, 201 bp, Homo sapiens; identical to SEQ ID NO: 11272

SEQ ID NO: 11313 - DNA, 201 bp, Homo sapiens; identical to SEQ ID NO: 11244

SEQ ID NO: 11314 - DNA, 201 bp, Homo sapiens; identical to SEQ ID NO: 11273

SEQ ID NO: 11315 - DNA, 201 bp, Homo sapiens; identical to SEQ ID NO: 11274

SEQ ID NO: 11316 - DNA, 201 bp, Homo sapiens; identical to SEQ ID NO: 11275

SEQ ID NO: 11317 - DNA, 201 bp, Homo sapiens; identical to SEQ ID NO: 11276

SEQ ID NO: 11318 - DNA, 201 bp, Homo sapiens; identical to SEQ ID NO: 11277

SEQ ID NO: 11319 - DNA, 201 bp, Homo sapiens; identical to SEQ ID NO: 11278
  misc_feature (1)...(201): n = A,T,C or G, or insertion/deletion polymorphism (see Tables 1-2)

SEQ ID NO: 11320 - DNA, 201 bp, Homo sapiens
aacccgctggcattttcgaccctctctccgtcttgttctccagttgcccctcgccatggcctgcagagtctcgggaaagttgccattgcccggcgtatgcsacctccagccaaccttccaagcctgaaagccgagaacaaaggcaatgaccccaatgtctcactagtgccaaaagacggaacaggatgggcaagcaaacag

SEQ ID NO: 11321 - DNA, 201 bp, Homo sapiens; identical to SEQ ID NO: 11280

SEQ ID NO: 11322 - DNA, 201 bp, Homo sapiens; identical to SEQ ID NO: 11281

SEQ ID NO: 11323 - DNA, 201 bp, Homo sapiens; identical to SEQ ID NO: 11241

SEQ ID NO: 11324 - DNA, 201 bp, Homo sapiens; identical to SEQ ID NO: 11283

SEQ ID NO: 11325 - DNA, 201 bp, Homo sapiens; identical to SEQ ID NO: 11284

SEQ ID NO: 11326 - DNA, 201 bp, Homo sapiens
aagccgttccaggattatcaaaaactgagcagcaaccttgggggacctggatcatcacggactcccccaactggaagacgcccttcttcccttaggtcctyctctggcctcaattcccgtctcaaggccacgccttccacctacagtggagtcttccgcacccagcgcgtcgacctttaccagcaggcctccccaccagat

SEQ ID NO: 11327 - DNA, 201 bp, Homo sapiens; identical to SEQ ID NO: 11286

SEQ ID NO: 11328 - DNA, 201 bp, Homo sapiens; identical to SEQ ID NO: 11247

SEQ ID NO: 11329 - DNA, 201 bp, Homo sapiens; identical to SEQ ID NO: 11245

SEQ ID NO: 11330 - DNA, 201 bp, Homo sapiens; identical to SEQ ID NO: 11248

SEQ ID NO: 11331 - DNA, 201 bp, Homo sapiens; identical to SEQ ID NO: 11250

SEQ ID NO: 11332 - DNA, 201 bp, Homo sapiens; identical to SEQ ID NO: 11251

SEQ ID NO: 11333 - DNA, 201 bp, Homo sapiens; identical to SEQ ID NO: 11252

SEQ ID NO: 11334 - DNA, 201 bp, Homo sapiens; identical to SEQ ID NO: 11253

SEQ ID NO: 11335 - DNA, 201 bp, Homo sapiens; identical to SEQ ID NO: 11254

SEQ ID NO: 11336 - DNA, 201 bp, Homo sapiens; identical to SEQ ID NO: 11242

SEQ ID NO: 11337 - DNA, 201 bp, Homo sapiens; identical to SEQ ID NO: 11255

SEQ ID NO: 11338 - DNA, 201 bp, Homo sapiens; identical to SEQ ID NO: 11256

SEQ ID NO: 11339 - DNA, 201 bp, Homo sapiens; identical to SEQ ID NO: 11243

SEQ ID NO: 11340 - DNA, 201 bp, Homo sapiens; identical to SEQ ID NO: 11258

SEQ ID NO: 11341 - DNA, 201 bp, Homo sapiens; identical to SEQ ID NO: 11260

SEQ ID NO: 11342 - DNA, 201 bp, Homo sapiens; identical to SEQ ID NO: 11261

SEQ ID NO: 11343 - DNA, 201 bp, Homo sapiens; identical to SEQ ID NO: 11262

SEQ ID NO: 11344 - DNA, 201 bp, Homo sapiens; identical to SEQ ID NO: 11263

SEQ ID NO: 11345 - DNA, 201 bp, Homo sapiens; identical to SEQ ID NO: 11264

SEQ ID NO: 11346 - DNA, 191 bp, Homo sapiens; identical to SEQ ID NO: 11265

SEQ ID NO: 11347 - DNA, 201 bp, Homo sapiens; identical to SEQ ID NO: 11266

SEQ ID NO: 11348 - DNA, 201 bp, Homo sapiens; identical to SEQ ID NO: 11240

SEQ ID NO: 11349 - DNA, 201 bp, Homo sapiens; identical to SEQ ID NO: 11268

SEQ ID NO: 11350 - DNA, 201 bp, Homo sapiens; identical to SEQ ID NO: 11269

SEQ ID NO: 11351 - DNA, 201 bp, Homo sapiens; identical to SEQ ID NO: 11270

SEQ ID NO: 11352 - DNA, 201 bp, Homo sapiens; identical to SEQ ID NO: 11271

SEQ ID NO: 11353 - DNA, 201 bp, Homo sapiens; identical to SEQ ID NO: 11272

SEQ ID NO: 11354 - DNA, 201 bp, Homo sapiens; identical to SEQ ID NO: 11244

SEQ ID NO: 11355 - DNA, 201 bp, Homo sapiens; identical to SEQ ID NO: 11273

SEQ ID NO: 11356 - DNA, 201 bp, Homo sapiens; identical to SEQ ID NO: 11274

SEQ ID NO: 11357 - DNA, 201 bp, Homo sapiens; identical to SEQ ID NO: 11275

SEQ ID NO: 11358 - DNA, 201 bp, Homo sapiens; identical to SEQ ID NO: 11276

SEQ ID NO: 11359 - DNA, 201 bp, Homo sapiens; identical to SEQ ID NO: 11277

SEQ ID NO: 11360 - DNA, 201 bp, Homo sapiens; identical to SEQ ID NO: 11278
  misc_feature (1)...(201): n = A,T,C or G, or insertion/deletion polymorphism (see Tables 1-2)

SEQ ID NO: 11361 - DNA, 201 bp, Homo sapiens; identical to SEQ ID NO: 11320

SEQ ID NO: 11362 - DNA, 201 bp, Homo sapiens; identical to SEQ ID NO: 11280

SEQ ID NO: 11363 - DNA, 201 bp, Homo sapiens; identical to SEQ ID NO: 11281

SEQ ID NO: 11364 - DNA, 201 bp, Homo sapiens; identical to SEQ ID NO: 11241

SEQ ID NO: 11365 - DNA, 201 bp, Homo sapiens; identical to SEQ ID NO: 11283

SEQ ID NO: 11366 - DNA, 201 bp, Homo sapiens; identical to SEQ ID NO: 11284

SEQ ID NO: 11367 - DNA, 201 bp, Homo sapiens; identical to SEQ ID NO: 11285

SEQ ID NO: 11368 - DNA, 201 bp, Homo sapiens; identical to SEQ ID NO: 11286

SEQ ID NO: 11369 - DNA, 201 bp, Homo sapiens; identical to SEQ ID NO: 11247

SEQ ID NO: 11370 - DNA, 201 bp, Homo sapiens; identical to SEQ ID NO: 11245

SEQ ID NO: 11371 - DNA, 201 bp, Homo sapiens; identical to SEQ ID NO: 11248

SEQ ID NO: 11372 - DNA, 201 bp, Homo sapiens; identical to SEQ ID NO: 11250

SEQ ID NO: 11373 - DNA, 201 bp, Homo sapiens; identical to SEQ ID NO: 11251

SEQ ID NO: 11374 - DNA, 201 bp, Homo sapiens; identical to SEQ ID NO: 11252

SEQ ID NO: 11375 - DNA, 201 bp, Homo sapiens; identical to SEQ ID NO: 11253

SEQ ID NO: 11376 - DNA, 201 bp, Homo sapiens; identical to SEQ ID NO: 11254

SEQ ID NO: 11377 - DNA, 201 bp, Homo sapiens; identical to SEQ ID NO: 11242

SEQ ID NO: 11378 - DNA, 201 bp, Homo sapiens; identical to SEQ ID NO: 11255

SEQ ID NO: 11379 - DNA, 201 bp, Homo sapiens; identical to SEQ ID NO: 11256

SEQ ID NO: 11380 - DNA, 201 bp, Homo sapiens; identical to SEQ ID NO: 11243

SEQ ID NO: 11381 - DNA, 201 bp, Homo sapiens; identical to SEQ ID NO: 11258

SEQ ID NO: 11382 - DNA, 201 bp, Homo sapiens; identical to SEQ ID NO: 11260

SEQ ID NO: 11383 - DNA, 201 bp, Homo sapiens; identical to SEQ ID NO: 11261

SEQ ID NO: 11384 - DNA, 201 bp, Homo sapiens; identical to SEQ ID NO: 11262

SEQ ID NO: 11385 - DNA, 201 bp, Homo sapiens; identical to SEQ ID NO: 11263

SEQ ID NO: 11386 - DNA, 201 bp, Homo sapiens; identical to SEQ ID NO: 11264

SEQ ID NO: 11387 - DNA, 191 bp, Homo sapiens; identical to SEQ ID NO: 11265

SEQ ID NO: 11388 - DNA, 201 bp, Homo sapiens; identical to SEQ ID NO: 11266

SEQ ID NO: 11389 - DNA, 201 bp, Homo sapiens; identical to SEQ ID NO: 11240

SEQ ID NO: 11390 - DNA, 201 bp, Homo sapiens; identical to SEQ ID NO: 11268

SEQ ID NO: 11391 - DNA, 201 bp, Homo sapiens; identical to SEQ ID NO: 11269

SEQ ID NO: 11392 - DNA, 201 bp, Homo sapiens; identical to SEQ ID NO: 11270

SEQ ID NO: 11393 - DNA, 201 bp, Homo sapiens; identical to SEQ ID NO: 11271

SEQ ID NO: 11394 - DNA, 201 bp, Homo sapiens; identical to SEQ ID NO: 11272

SEQ ID NO: 11395 - DNA, 201 bp, Homo sapiens; identical to SEQ ID NO: 11244

SEQ ID NO: 11396 - DNA, 201 bp, Homo sapiens; identical to SEQ ID NO: 11273

SEQ ID NO: 11397 - DNA, 201 bp, Homo sapiens; identical to SEQ ID NO: 11274

SEQ ID NO: 11398 - DNA, 201 bp, Homo sapiens; identical to SEQ ID NO: 11275

SEQ ID NO: 11399 - DNA, 201 bp, Homo sapiens; identical to SEQ ID NO: 11276

SEQ ID NO: 11400 - DNA, 201 bp, Homo sapiens; identical to SEQ ID NO: 11277

SEQ ID NO: 11401 - DNA, 201 bp, Homo sapiens; identical to SEQ ID NO: 11278
  misc_feature (1)...(201): n = A,T,C or G, or insertion/deletion polymorphism (see Tables 1-2)

SEQ ID NO: 11402 - DNA, 201 bp, Homo sapiens; identical to SEQ ID NO: 11246

SEQ ID NO: 11403 - DNA, 201 bp, Homo sapiens; identical to SEQ ID NO: 11280

SEQ ID NO: 11404 - DNA, 201 bp, Homo sapiens; identical to SEQ ID NO: 11281

SEQ ID NO: 11405 - DNA, 201 bp, Homo sapiens; identical to SEQ ID NO: 11241

SEQ ID NO: 11406 - DNA, 201 bp, Homo sapiens; identical to SEQ ID NO: 11283

SEQ ID NO: 11407 - DNA, 201 bp, Homo sapiens; identical to SEQ ID NO: 11284

SEQ ID NO: 11408 - DNA, 201 bp, Homo sapiens; identical to SEQ ID NO: 11285

SEQ ID NO: 11409 - DNA, 201 bp, Homo sapiens; identical to SEQ ID NO: 11286

SEQ ID NO: 11410 - DNA, 201 bp, Homo sapiens
agcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagata

SEQ ID NO: 11411 - DNA, 201 bp, Homo sapiens
aaaaacgcaaggcacaaggacggtcacccgcgcgactatgtttgctgatttttcgccttgccctctttaaaagcggcctcccattctccaaaagacacttyccctcctccctttgaagtgcattagttgtgatttctgcctccttttcttttttctttcttttttgttttgctttttccccccttttgaattatgtgctgc

SEQ ID NO: 11412 - DNA, 201 bp, Homo sapiens
aatgtatttgtggtttttattttgaacgcttgcttttagagagaaaacaatatagccccctacccttttcccaatcctttgccctcaaatcagtgacccargggagggggggatttaaagggaaggagtgggcaaaacacataaaatgaatttattatatctaagctctgtagcaggattcatgtcgttctttgacagttc

SEQ ID NO: 11413 - DNA, 201 bp, Homo sapiens
cgtcggaggagccctgccgtgacaagggcagccccgcggtcaaggctcaccttttcgctgctgagcggccccgggacagcgggcggctggacaaagcgtckcccgactcacgccatagccccgccaccatctcgtccagcactcgcggcctgggcgcggaggagcgcaggagcccggttcgcgagggcacagcgccggcca

SEQ ID NO: 11414 - DNA, 201 bp, Homo sapiens
tggtaaggccgaccccgaaatgccaaagaggatgtacattcacccggacagccccgctactggggaacagtggatgtccaaagtcgtcactttccacaaaytgaaactcaccaacaacatttcagacaaacatggatttactttggccttcccaagtgatcacgctacgtggcaggggaattatagttttggtactcagac

SEQ ID NO: 11415 - DNA, 201 bp, Homo sapiens
gaggtgttcaaagacatctccctcagtgcggatttatatatatatttttccttcactgtgtcaagtggaaacaaaaacaaaatctttcaaaaaaaaaatcsggacaagtgaacacattaacatgattctgtttgtgcagattaaaaactttatagggacttgcattatcggttctcaataaattactgagcagctttgttt

SEQ ID NO: 11416 - DNA, 182 bp, Homo sapiens
gcctgcctatagagatatattcacagttcaaaagtcaggtgctgagagatggtttaaagacaaattcatgaaggtatattttgtgttatagttgttgatgrgttctttggttttctgtatttttccccctctctttaaaacatcactgaaatttcaataaatttttattgaaatgtctttgg

SEQ ID NO: 11417 - DNA, 201 bp, Homo sapiens
acaaataccagccccggttccacattgtaagagccaatgacatcttgaaactcccttatagtacatttcggacatacttgttccccgaaactgaattcatygctgtgactgcataccagaatgataagataacccagttaaaaatagacaacaacccttttgcaaaaggtttccgggacactggaaatggccgaagagaaa

SEQ ID NO: 11418 - DNA, 201 bp, Homo sapiens
aagtgctatttcctattttcaccaaaattggggaaggagtgccactttccagctccacttcaaattccttaaaatataactgagattgctgtggggagggrggagggcagaggctgcggtttgactttttaatttttcttttgttatttgtatttgctagtctctgatttcctcaaaacgaagtggaatttactactgttg

SEQ ID NO: 11419 - DNA, 201 bp, Homo sapiens
cttcttctccagccgcctccactgtagggacatcgaacctcaaagatttatgtcccagcgagggtgagagcgacgccgaggccgagagcaaagaggagcayggccccgaggcctgcgacgcggccaagatctccaccaccacgtcggaggagccctgccgtgacaagggcagccccgcggtcaaggctcaccttttcgctg

SEQ ID NO: 11420 - DNA, 201 bp, Homo sapiens
aaaaaaataataaagaagtgagactattagacaaagtatttatgtaattatttgataactcttgtaaataggtggaatatgaatgcttggaaaattaaacyttaatttattgacattgtacatagctctgtgtaaatagaattgcaactgtcaggttttgtgttcttgttttcctttagttgggtttatttccaggtcaca

SEQ ID NO: 11421 - DNA, 201 bp, Homo sapiens
tgtggtttttattttgaacgcttgcttttagagagaaaacaatatagccccctacccttttcccaatcctttgccctcaaatcagtgacccaagggagggrgggatttaaagggaaggagtgggcaaaacacataaaatgaatttattatatctaagctctgtagcaggattcatgtcgttctttgacagttctttctctt

SEQ ID NO: 11422 - DNA, 201 bp, Homo sapiens
tttcacaagcggggcaccgagatggtcattaccaagtcgggaaggcgaatgtttcctccatttaaagtgagatgttctgggctggataaaaaagccaaatmcattttattgatggacattatagctgctgatgactgtcgttataaatttcacaattctcggtggatggtggctggtaaggccgaccccgaaatgccaaag

SEQ ID NO: 11423 - DNA, 201 bp, Homo sapiens
tttatagggacttgcattatcggttctcaataaattactgagcagctttgtttggggagggaagtccctaccatccttgtttagtctatattaagaaaatstgtgtctttttaatattcttgtgatgttttcagagccgctgtaggtctcttcttgcatgtccacagtaatgtatttgtggtttttattttgaacgcttgc

SEQ ID NO: 11424 - DNA, 201 bp, Homo sapiens
cgcccggtgaattctagaggcggcggagggtggcgaggagctctcgctttctctcgctccctccctctccgactccgtctctctctctctctctctctctytctcccctccctctctttccctctgttccattttttccccctctaaatcctccctgccctgcgcgcctggacacagatttaggaagcgaattcgctcacg

SEQ ID NO: 11425 - DNA, 201 bp, Homo sapiens
cgagaaagagggagaggaagacagatagggggcgggggaagaagaaaaagaaaggtaaaaagtcttctaggagaacctttcacatttgcaacaaaagacckaggggctggagagagattcctgggacgcagggctggagtgtctatttcgagctcagcggcagggctcgggcgcgagtcgagaccctgctcgctcctctcg

SEQ ID NO: 11426 - DNA, 201 bp, Homo sapiens
cccaaactctgcgcggagaaagaggcggccaccagcgaactgcagagcatccagcggttggttagcggcttggaagccaagccggacaggtcccgcagcgygtccccgtagacccgtcccagacacgtcttttcattccagtccagttcaggctgccgtgcactttgtcggatataaaataaaccacgggcccgccatggc

SEQ ID NO: 11427 - DNA, 201 bp, Homo sapiens
aggagcggctttttaaaaacgcaaggcacaaggacggtcacccgcgcgactatgtttgctgatttttcgccttgccctctttaaaagcggcctcccattcyccaaaagacacttcccctcctccctttgaagtgcattagttgtgatttctgcctccttttcttttttctttcttttttgttttgctttttcccccctttt

SEQ ID NO: 11428 - DNA, 201 bp, Homo sapiens
tcgggcgcgagtcgagaccctgctcgctcctctcgcttctgaaaccgacgttcaggagcggctttttaaaaacgcaaggcacaaggacggtcacccgcgcractatgtttgctgatttttcgccttgccctctttaaaagcggcctcccattctccaaaagacacttcccctcctccctttgaagtgcattagttgtgatt

SEQ ID NO: 11429 - DNA, 201 bp, Homo sapiens
catcttgaaactcccttatagtacatttcggacatacttgttccccgaaactgaattcatcgctgtgactgcataccagaatgataagataacccagttawaaatagacaacaacccttttgcaaaaggtttccgggacactggaaatggccgaagagaaaaaagaaaacagctcaccctgcagtccatgagggtgtttga

SEQ ID NO: 11430 - DNA, 201 bp, Homo sapiens
cggcctcggtggcagtggactcgggctctgaactcaacagccgctcctccacgctctcctccagctccatgtccttgtcgcccaaactctgcgcggagaargaggcggccaccagcgaactgcagagcatccagcggttggttagcggcttggaagccaagccggacaggtcccgcagcgcgtccccgtagacccgtccca

SEQ ID NO: 11431 - DNA, 201 bp, Homo sapiens; identical to SEQ ID NO: 11410

SEQ ID NO: 11432 - DNA, 201 bp, Homo sapiens; identical to SEQ ID NO: 11411

SEQ ID NO: 11433 - DNA, 201 bp, Homo sapiens; identical to SEQ ID NO: 11412

SEQ ID NO: 11434 - DNA, 201 bp, Homo sapiens; identical to SEQ ID NO: 11413

SEQ ID NO: 11435 - DNA, 201 bp, Homo sapiens
tggtaaggccgaccccgaaatgccaaagaggatgtacattcacccggacagccccgctactggggaacagtggatgtccaaagtcgtcactttccacaaaytgaaactcaccaacaacatttcagacaaacatggatttactatattgaactccatgcacaaataccagccccggttccacattgtaagagccaatgacat

SEQ ID NO: 11436 - DNA, 201 bp, Homo sapiens; identical to SEQ ID NO: 11415

SEQ ID NO: 11437 - DNA, 181 bp, Homo sapiens
gcctgcctatagagatatattcacagttcaaaagtcaggtgctgagagatggtttaaagacaaattcatgaaggtatattttgtgttatagttgttgatgrgttctttggttttctgtatttttccccctctctttaaaacatcactgaaatttcaataaatttttattgaaatgtctttg

SEQ ID NO: 11438 - DNA, 201 bp, Homo sapiens; identical to SEQ ID NO: 11417

SEQ ID NO: 11439 - DNA, 201 bp, Homo sapiens; identical to SEQ ID NO: 11418

SEQ ID NO: 11440 - DNA, 201 bp, Homo sapiens; identical to SEQ ID NO: 11419

SEQ ID NO: 11441 - DNA, 201 bp, Homo sapiens; identical to SEQ ID NO: 11420

SEQ ID NO: 11442 - DNA, 201 bp, Homo sapiens; identical to SEQ ID NO: 11421

SEQ ID NO: 11443 - DNA, 201 bp, Homo sapiens; identical to SEQ ID NO: 11422

SEQ ID NO: 11444 - DNA, 201 bp, Homo sapiens; identical to SEQ ID NO: 11423

SEQ ID NO: 11445 - DNA, 201 bp, Homo sapiens; identical to SEQ ID NO: 11424

SEQ ID NO: 11446 - DNA, 201 bp, Homo sapiens; identical to SEQ ID NO: 11425

SEQ ID NO: 11447 - DNA, 201 bp, Homo sapiens; identical to SEQ ID NO: 11426

SEQ ID NO: 11448 - DNA, 201 bp, Homo sapiens; identical to SEQ ID NO: 11427

SEQ ID NO: 11449 - DNA, 201 bp, Homo sapiens; identical to SEQ ID NO: 11428

SEQ ID NO: 11450 - DNA, 201 bp, Homo sapiens; identical to SEQ ID NO: 11430

SEQ ID NO: 11451 - DNA, 201 bp, Homo sapiens; identical to SEQ ID NO: 11429

SEQ ID NO: 11452 - DNA, 201 bp, Homo sapiens; identical to SEQ ID NO: 11419

SEQ ID NO: 11453 - DNA, 201 bp, Homo sapiens; identical to SEQ ID NO: 11422

SEQ ID NO: 11454 - DNA, 201 bp, Homo sapiens; identical to SEQ ID NO: 11410

SEQ ID NO: 11455 - DNA, 117 bp, Homo sapiens
aaaaatcgggacaagtgaacacattaacatgattctgtttgtgcactttgtttggggagggaagtccctaccatccttgtttagtctatattaagaaaatstgtgtctttttaatat

SEQ ID NO: 11456 - DNA, 201 bp, Homo sapiens; identical to SEQ ID NO: 11411

SEQ ID NO: 11457 - DNA, 201 bp, Homo sapiens; identical to SEQ ID NO: 11424

SEQ ID NO: 11458 - DNA, 201 bp, Homo sapiens; identical to SEQ ID NO: 11425

SEQ ID NO: 11459 - DNA, 201 bp, Homo sapiens; identical to SEQ ID NO: 11413

SEQ ID NO: 11460 - DNA, 201 bp, Homo sapiens; identical to SEQ ID NO: 11435

SEQ ID NO: 11461 - DNA, 201 bp, Homo sapiens; identical to SEQ ID NO: 11426

SEQ ID NO: 11462 - DNA, 201 bp, Homo sapiens
gaggtgttcaaagacatctccctcagtgcggatttatatatatatttttccttcactgtgtcaagtggaaacaaaaacaaaatctttcaaaaaaaaaatcsggacaagtgaacacattaacatgattctgtttgtgcactttgtttggggagggaagtccctaccatccttgtttagtctatattaagaaaatctgtgtct

SEQ ID NO: 11463 - DNA, 201 bp, Homo sapiens; identical to SEQ ID NO: 11417

SEQ ID NO: 11464 - DNA, 201 bp, Homo sapiens; identical to SEQ ID NO: 11427

SEQ ID NO: 11465 - DNA, 201 bp, Homo sapiens; identical to SEQ ID NO: 11428

SEQ ID NO: 11466 - DNA, 201 bp, Homo sapiens; identical to SEQ ID NO: 11430

SEQ ID NO: 11467 - DNA, 201 bp, Homo sapiens; identical to SEQ ID NO: 11429

SEQ ID NO: 11468 - DNA, 201 bp, Homo sapiens; identical to SEQ ID NO: 11410

SEQ ID NO: 11469 - DNA, 201 bp, Homo sapiens; identical to SEQ ID NO: 11411

SEQ ID NO: 11470 - DNA, 201 bp, Homo sapiens; identical to SEQ ID NO: 11412

SEQ ID NO: 11471 - DNA, 201 bp, Homo sapiens; identical to SEQ ID NO: 11413

SEQ ID NO: 11472 - DNA, 201 bp, Homo sapiens; identical to SEQ ID NO: 11414

SEQ ID NO: 11473 - DNA, 201 bp, Homo sapiens; identical to SEQ ID NO: 11415

SEQ ID NO: 11474 - DNA, 181 bp, Homo sapiens; identical to SEQ ID NO: 11437

SEQ ID NO: 11475 - DNA, 201 bp, Homo sapiens; identical to SEQ ID NO: 11417

SEQ ID NO: 11476 - DNA, 201 bp, Homo sapiens; identical to SEQ ID NO: 11418

SEQ ID NO: 11477 - DNA, 201 bp, Homo sapiens; identical to SEQ ID NO: 11419

SEQ ID NO: 11478 - DNA, 201 bp, Homo sapiens; identical to SEQ ID NO: 11420

SEQ ID NO: 11479 - DNA, 201 bp, Homo sapiens; identical to SEQ ID NO: 11421

SEQ ID NO: 11480 - DNA, 201 bp, Homo sapiens; identical to SEQ ID NO: 11422

SEQ ID NO: 11481 - DNA, 201 bp, Homo sapiens; identical to SEQ ID NO: 11423

SEQ ID NO: 11482 - DNA, 201 bp, Homo sapiens; identical to SEQ ID NO: 11424

SEQ ID NO: 11483 - DNA, 201 bp, Homo sapiens; identical to SEQ ID NO: 11425

SEQ ID NO: 11484 - DNA, 201 bp, Homo sapiens; identical to SEQ ID NO: 11426

SEQ ID NO: 11485 - DNA, 201 bp, Homo sapiens; identical to SEQ ID NO: 11427

SEQ ID NO: 11486 - DNA, 201 bp, Homo sapiens; identical to SEQ ID NO: 11428

SEQ ID NO: 11487 - DNA, 201 bp, Homo sapiens; identical to SEQ ID NO: 11429

SEQ ID NO: 11488 - DNA, 201 bp, Homo sapiens; identical to SEQ ID NO: 11430

SEQ ID NO: 11489 - DNA, 201 bp, Homo sapiens; identical to SEQ ID NO: 11419

SEQ ID NO: 11490 - DNA, 201 bp, Homo sapiens; identical to SEQ ID NO: 11422

SEQ ID NO: 11491 - DNA, 201 bp, Homo sapiens; identical to SEQ ID NO: 11410

SEQ ID NO: 11492 - DNA, 117 bp, Homo sapiens; identical to SEQ ID NO: 11455

SEQ ID NO: 11493 - DNA, 201 bp, Homo sapiens; identical to SEQ ID NO: 11411

SEQ ID NO: 11494 - DNA, 201 bp, Homo sapiens; identical to SEQ ID NO: 11424

SEQ ID NO: 11495 - DNA, 201 bp, Homo sapiens; identical to SEQ ID NO: 11425

SEQ ID NO: 11496 - DNA, 201 bp, Homo sapiens; identical to SEQ ID NO: 11413

SEQ ID NO: 11497 - DNA, 201 bp, Homo sapiens; identical to SEQ ID NO: 11414

SEQ ID NO: 11498 - DNA, 201 bp, Homo sapiens; identical to SEQ ID NO: 11426

SEQ ID NO: 11499 - DNA, 201 bp, Homo sapiens; identical to SEQ ID NO: 11462

SEQ ID NO: 11500 - DNA, 201 bp, Homo sapiens; identical to SEQ ID NO: 11417

SEQ ID NO: 11501 - DNA, 201 bp, Homo sapiens; identical to SEQ ID NO: 11427

SEQ ID NO: 11502 - DNA, 201 bp, Homo sapiens; identical to SEQ ID NO: 11428

SEQ ID NO: 11503 - DNA, 201 bp, Homo sapiens; identical to SEQ ID NO: 11430

SEQ ID NO: 11504 - DNA, 201 bp, Homo sapiens; identical to SEQ ID NO: 11429

SEQ ID NO: 11505 - DNA, 201 bp, Homo sapiens
aggcagcatccctctgacaggggggcagttgtgaggccacagagtgccttgacacaaagattacatttttcagacccccactcctctgctgctgtccatgwctgtccttttgaaccaggaaaagtcacagagtttaaagagaagcaaattaaacatcctgaatcgggaacaaagggttttatctaataaagtgtctcttcc

SEQ ID NO: 11506 - DNA, 201 bp, Homo sapiens
aacactgctggcttctattgtgaccggtgcaaagacggattttttggaaatcccctggctcccaatccagcagacaaatgcaaagcctgcaattgcaatcygtatgggaccatgaagcagcagagcagctgtaaccccgtgacggggcagtgtgaatgtttgcctcacgtgactggccaggactgtggtgcttgtgaccct

SEQ ID NO: 11507 - DNA, 201 bp, Homo sapiens
agggcagttttgtgagatgtgcctctcaggttacagaagagaaactcctaatcttggaccatacagtccatgtgtgctttgcgcctgcaatggacacagcragacctgtgatcctgagacaggtgtttgtaactgcagagacaatacggctggcccgcactgtgagaagtgcagtgatgggtactatggagattcaactgc

SEQ ID NO: 11508 - DNA, 201 bp, Homo sapiens
atctggataatgaggtgaacaatatgttgaagcaactgcaggaagcagaaaaagagctaaagagaaaacaagatgacgctgaccaggacatgatgatggcmgggatggcttcacaggctgctcaagaagccgagatcaatgccagaaaagccaaaaactctgttactagcctcctcagcattattaatgacctcttggagc

SEQ ID NO: 11509 - DNA, 201 bp, Homo sapiens
ggtgccgagagaacttcttccgccttggcaacaatgaagcctgctcttcatgccactgtagtcctgtgggctctctaagcacacagtgtgatagttacggmagatgcagctgtaagccaggagtgatgggggacaaatgtgaccgttgccagcctggattccattctctcactgaagcaggatgcaggccatgctcttgtg

SEQ ID NO: 11510 - DNA, 201 bp, Homo sapiens
gtctcaagttccacaccagccgcccggagagctttgccatttacaagcgcacacgggaagacgggccctggattccttaccagtactacagtggttcctgygagaacacctactccaaggcaaaccgcggcttcatcaggacaggaggggacgagcagcaggccttgtgtactgatgaattcagtgacatttctcccctca

SEQ ID NO: 11511 - DNA, 201 bp, Homo sapiens
actccaaggcaaaccgcggcttcatcaggacaggaggggacgagcagcaggccttgtgtactgatgaattcagtgacatttctcccctcactgggggcaaygtggccttttctaccctggaaggaaggcccagcgcctataactttgacaatagccctgtgctgcaggaatgggtaactgccactgacatcagagtaactc

SEQ ID NO: 11512 - DNA, 201 bp, Homo sapiens
tgggtagaaacggccctgtgagactttgccgcctgtgccagtgcagtgacaacatcgatcccaatgcagttggaaattgcaatcgcttgacgggagaatgyctgaagtgcatctataacactgctggcttctattgtgaccggtgcaaagacggattttttggaaatcccctggctcccaatccagcagacaaatgcaaag

SEQ ID NO: 11513 - DNA, 201 bp, Homo sapiens
acgccaggttgacaagctatggtaggattaggaaagtttgctgaagaggatctttgacgccacagtgggactagccaggaatgagggagaaatgccctttytggcaattgttggagctggataggtaagttttataagggagtacattttgactgagcacttagggcatcaggaacagtgctacttactgatgggtagact

SEQ ID NO: 11514 - DNA, 201 bp, Homo sapiens
atgaaaagaccagagaagcccagcaggccctgggcagtgctgcggcggatgccacagaggccaagaacaaggcccatgaggcggagaggatcgcgagcgcwgtccaaaagaatgccaccagcaccaaggcagaagctgaaagaacttttgcagaagttacagatctggataatgaggtgaacaatatgttgaagcaactgc

SEQ ID NO: 11515 - DNA, 201 bp, Homo sapiens
tcatttagaatgtcggtagccatccatcagtgcttttagctattatgagtgtaggacactgagccatccgtgggtcaggatgcaattatttataaaagtcyccaggtgaacatggctgaagatttttctagtatattaataattgactaggaagatgaactttttttcagatctttgggcagctgataatttaaatctgga

SEQ ID NO: 11516 - DNA, 201 bp, Homo sapiens
agaggtgccgagagaacttcttccgccttggcaacaatgaagcctgctcttcatgccactgtagtcctgtgggctctctaagcacacagtgtgatagttayggcagatgcagctgtaagccaggagtgatgggggacaaatgtgaccgttgccagcctggattccattctctcactgaagcaggatgcaggccatgctctt

SEQ ID NO: 11517 - DNA, 201 bp, Homo sapiens
gtgagctctgtgatgatggctactttggagaccccctgggtagaaacggccctgtgagactttgccgcctgtgccagtgcagtgacaacatcgatcccaaygcagttggaaattgcaatcgcttgacgggagaatgcctgaagtgcatctataacactgctggcttctattgtgaccggtgcaaagacggattttttggaa

SEQ ID NO: 11518 - DNA, 201 bp, Homo sapiens
atgctgccaaggccctcgctgaagaagctgcaaagaagggacgggataccttacaagaagctaatgacattctcaacaacctgaaagattttgataggcgygtgaacgataacaagacggccgcagaggaggcactaaggaagattcctgccatcaaccagaccatcactgaagccaatgaaaagaccagagaagcccagc

SEQ ID NO: 11519 - DNA, 201 bp, Homo sapiens
agaagcaggaggctgccatcatggactataaccgagatatcgaggagatcatgaaggacattcgcaatctggaggacatcaggaagaccttaccatctggytgcttcaacaccccgtccattgaaaagccctagtgtctttagggctggaaggcagcatccctctgacaggggggcagttgtgaggccacagagtgccttg

SEQ ID NO: 11520 - DNA, 201 bp, Homo sapiens
taataggaagtatgaacaagcgaagaacatctcacaggatctggaaaaacaagctgcccgagtacatgaggaggccaaaagggccggtgacaaagctgtgragatctatgccagcgtggctcagctgagccctttggactctgagacactggagaatgaagcaaataacataaagatggaagctgagaatctggaacaact

SEQ ID NO: 11521 - DNA, 201 bp, Homo sapiens
ttttgacgatatactcctgagctttcactctgctgcttctcccaggcctcttctactatggcaggagatgtggcgtgctgttgcaaagttttcacgtcatygtttcctggctagttcatttcattaagtggctacatcctaacatatgcatttggtcaaggttgcagaagaggactgaagattgactgccaagctagtttg

SEQ ID NO: 11522 - DNA, 201 bp, Homo sapiens
ggacaaatgtgaccgttgccagcctggattccattctctcactgaagcaggatgcaggccatgctcttgtgatccctctggcagcatagatgaatgtaatrttgaaacaggaagatgtgtttgcaaagacaatgtcgaaggcttcaattgtgaaagatgcaaacctggattttttaatctggaatcatctaatcctcgggg

SEQ ID NO: 11523 - DNA, 201 bp, Homo sapiens
aatgccctttctggcaattgttggagctggataggtaagttttataagggagtacattttgactgagcacttagggcatcaggaacagtgctacttactgrtgggtagactgggagaggtggtgtaacttagttcttgatgatcccacttcctgtttccatctgcttgggatataccagagtttaccacaagtgttttgac

SEQ ID NO: 11524 - DNA, 201 bp, Homo sapiens
ggatgggcagcttgcactcaccaatagaccaaaagacatcttttgatattcttataaatggaacttacacagaagaaatagggatatgataaccactaaarttttgttttcaaaatcaaactaattcttacagcttttttattagttagtcttggaactagtgttaagtatctggcagagaacagttaatccctaaggtct

SEQ ID NO: 11525 - DNA, 201 bp, Homo sapiens
tcattgctcctgcaaagttcttgggcaagcaggtgttgagttatggtcagaacctctccttctcctttcgagtggacaggcgagatactcgcctctctgcmgaagaccttgtgcttgagggagctggcttaagagtatctgtacccttgatcgctcagggcaattcctatccaagtgagaccactgtgaagtatgtcttca

SEQ ID NO: 11526 - DNA, 201 bp, Homo sapiens
aagccaatgaaaagaccagagaagcccagcaggccctgggcagtgctgcggcggatgccacagaggccaagaacaaggcccatgaggcggagaggatcgcragcgctgtccaaaagaatgccaccagcaccaaggcagaagctgaaagaacttttgcagaagttacagatctggataatgaggtgaacaatatgttgaagc

SEQ ID NO: 11527 - DNA, 201 bp, Homo sapiens
gaggcccaggatgtcaaagatgttgaccagaatttgatggatcgcctacagagagtgaataacactctgtccagccaaattagccgtttacagaatatccrgaataccattgaagagactggaaacttggctgaacaagcgcgtgcccatgtagagaacacagagcggttgattgaaatcgcatccagagaacttgagaaa

SEQ ID NO: 11528 - DNA, 201 bp, Homo sapiens
gggatataccagagtttaccacaagtgttttgacgatatactcctgagctttcactctgctgcttctcccaggcctcttctactatggcaggagatgtggygtgctgttgcaaagttttcacgtcattgtttcctggctagttcatttcattaagtggctacatcctaacatatgcatttggtcaaggttgcagaagagga

SEQ ID NO: 11529 - DNA, 201 bp, Homo sapiens
atctcctgcccctcttccttctaagcaaaaggaaataaacatcctgtgccaaaggtattggtcatttagaatgtcggtagccatccatcagtgcttttagytattatgagtgtaggacactgagccatccgtgggtcaggatgcaattatttataaaagtccccaggtgaacatggctgaagatttttctagtatattaat

SEQ ID NO: 11530 - DNA, 201 bp, Homo sapiens
ttgataagctggtgtgtaattgcaaacataacacatatggagtagactgtgaaaagtgtcttcctttcttcaatgaccggccgtggaggagggcaactgcrgaaagtgccagtgaatgcctgccctgtgattgcaatggtcgatcccaggaatgctacttcgaccctgaactctatcgttccactggccatgggggccact

SEQ ID NO: 11531 - DNA, 201 bp, Homo sapiens
tactcttgtttctatgaaggaaaagtttggctactaacagtagcattgtgatggccagtatatccagtccatggataaagaaaatgcatctgcatctcctrcccctcttccttctaagcaaaaggaaataaacatcctgtgccaaaggtattggtcatttagaatgtcggtagccatccatcagtgcttttagctattatg

SEQ ID NO: 11532 - DNA, 186 bp, Homo sapiens
gcgcactcgggcacgcgctcggaagtcgggggtcggcgcggagtgcaggctgctcccggggtaggtgagggaagcgcggaggcggsgcgcgggggcagtggtcggcgagcagcgcggtcctcgctaggggcgcccacccgtcagtctctccggcgcgagccgccgccaccgcccgcgccggagtca

SEQ ID NO: 11533 - DNA, 201 bp, Homo sapiens
gctggcggcaggccgccgcggcgggctgtgcccaggcagccatggacgagtgcacggacgagggcgggcggccgcagcgctgcatgcccgagttcgtcaamgccgccttcaacgtgactgtggtggccaccaacacgtgtgggactccgcccgaggaatactgtgtgcagaccggggtgaccggggtcaccaagtcctgtc

SEQ ID NO: 11534 - DNA, 201 bp, Homo sapiens
acgatcccaaagttctcaagtcctattattatgccatctctgattttgctgtaggtggcagatgtaaatgtaatggacacgcaagcgagtgtatgaagaaygaatttgataagctggtgtgtaattgcaaacataacacatatggagtagactgtgaaaagtgtcttcctttcttcaatgaccggccgtggaggagggcaa

SEQ ID NO: 11535 - DNA, 201 bp, Homo sapiens
ccatgtatgctggggtagagcaagtagccctcccctgtctcatcgataccagcagaacctcctcagtctcagtactcttgtttctatgaaggaaaagtttkgctactaacagtagcattgtgatggccagtatatccagtccatggataaagaaaatgcatctgcatctcctgcccctcttccttctaagcaaaaggaaat

SEQ ID NO: 11536 - DNA, 201 bp, Homo sapiens
aaggcagcatccctctgacaggggggcagttgtgaggccacagagtgccttgacacaaagattacatttttcagacccccactcctctgctgctgtccatsactgtccttttgaaccaggaaaagtcacagagtttaaagagaagcaaattaaacatcctgaatcgggaacaaagggttttatctaataaagtgtctcttc

SEQ ID NO: 11537 - DNA, 201 bp, Homo sapiens
ggcaggccgccgcggcgggctgtgcccaggcagccatggacgagtgcacggacgagggcgggcggccgcagcgctgcatgcccgagttcgtcaacgccgcyttcaacgtgactgtggtggccaccaacacgtgtgggactccgcccgaggaatactgtgtgcagaccggggtgaccggggtcaccaagtcctgtcacctgt

SEQ ID NO: 11538 - DNA, 201 bp, Homo sapiens
atgaagtgtttaacgatcccaaagttctcaagtcctattattatgccatctctgattttgctgtaggtggcagatgtaaatgtaatggacacgcaagcgartgtatgaagaacgaatttgataagctggtgtgtaattgcaaacataacacatatggagtagactgtgaaaagtgtcttcctttcttcaatgaccggccgt

SEQ ID NO: 11539 - DNA, 194 bp, Homo sapiens
tatttttccctgaatttttttcctttgaattccaactgtggaccttttatatgtgccttcactttagctgtttgccttaatctctacagccttgctctccrgggtggttaataaaatgcaacacttggcatttttatgttttaagaaaaacagtattttatttataataaaatctgaatatttgtaacccttta

SEQ ID NO: 11540 - DNA, 201 bp, Homo sapiens; identical to SEQ ID NO: 11506

SEQ ID NO: 11541 - DNA, 201 bp, Homo sapiens; identical to SEQ ID NO: 11507

SEQ ID NO: 11542 - DNA, 157 bp, Homo sapiens
aggcagcatccctctgacaggggggcagttgtgaggccacagagtgccttgacacaaagattacatttttcagacccccactcctctgctgctgtccatgwctgtccttttgaaccaggaaaaggttttatctaataaagtgtctcttccattcacg

SEQ ID NO: 11543 - DNA, 201 bp, Homo sapiens; identical to SEQ ID NO: 11508

SEQ ID NO: 11544 - DNA, 201 bp, Homo sapiens; identical to SEQ ID NO: 11510

SEQ ID NO: 11545 - DNA, 201 bp, Homo sapiens; identical to SEQ ID NO: 11509

SEQ ID NO: 11546 - DNA, 201 bp, Homo sapiens; identical to SEQ ID NO: 11511

SEQ ID NO: 11547 - DNA, 201 bp, Homo sapiens; identical to SEQ ID NO: 11512

SEQ ID NO: 11548 - DNA, 201 bp, Homo sapiens; identical to SEQ ID NO: 11517

SEQ ID NO: 11549 - DNA, 201 bp, Homo sapiens; identical to SEQ ID NO: 11516

SEQ ID NO: 11550 - DNA, 201 bp, Homo sapiens; identical to SEQ ID NO: 11514

SEQ ID NO: 11551 - DNA, 201 bp, Homo sapiens; identical to SEQ ID NO: 11518

SEQ ID NO: 11552 - DNA, 201 bp, Homo sapiens; identical to SEQ ID NO: 11519

SEQ ID NO: 11553 - DNA, 201 bp, Homo sapiens; identical to SEQ ID NO: 11520

SEQ ID NO: 11554 - DNA, 201 bp, Homo sapiens; identical to SEQ ID NO: 11522

SEQ ID NO: 11555 - DNA, 201 bp, Homo sapiens; identical to SEQ ID NO: 11526

SEQ ID NO: 11556 - DNA, 201 bp, Homo sapiens; identical to SEQ ID NO: 11525

SEQ ID NO: 11557 - DNA, 201 bp, Homo sapiens; identical to SEQ ID NO: 11527

SEQ ID NO: 11558 - DNA, 201 bp, Homo sapiens; identical to SEQ ID NO: 11530

SEQ ID NO: 11559 - DNA, 201 bp, Homo sapiens; identical to SEQ ID NO: 11534

SEQ ID NO: 11560 - DNA, 201 bp, Homo sapiens; identical to SEQ ID NO: 11533

SEQ ID NO: 11561 - DNA, 186 bp, Homo sapiens; identical to SEQ ID NO: 11532

SEQ ID NO: 11562 - DNA, 201 bp, Homo sapiens; identical to SEQ ID NO: 11537

SEQ ID NO: 11563 - DNA, 201 bp, Homo sapiens; identical to SEQ ID NO: 11538

SEQ ID NO: 11564 - DNA, 158 bp, Homo sapiens
aaggcagcatccctctgacaggggggcagttgtgaggccacagagtgccttgacacaaagattacatttttcagacccccactcctctgctgctgtccatsactgtccttttgaaccaggaaaaggttttatctaataaagtgtctcttccattcacg

SEQ ID NO: 11565 - DNA, 201 bp, Homo sapiens
ccttacattcccacagctccctggccgggacccagccccagccgctgtcgctcgtcaccaagtctttagaatagctttagcgtcgtgaaccccgctgcttygtttatggttttgtttcacttttcttaatttgccccccacccccaccttgaaaggttttgttttgtactctcttaattttgtgccatgtggctacattag

SEQ ID NO: 11566 - DNA, 201 bp, Homo sapiens
gtacagaaacaaagggtaaaaatgtgttaatataccttgttccatggtgttgttcttttggggggaggggacgctactcaacacttaatagaatcacaacsctgttgggccagtagtatttattgctttagagattgcttgtcgtacctgtatgtcgtccctttttaaatatgttttcctttttcttgaaactgtataaag

SEQ ID NO: 11567 - DNA, 201 bp, Homo sapiens
atttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgt

SEQ ID NO: 11568 - DNA, 201 bp, Homo sapiens
agcagtgggaaccatcttcgtttcccctttgaactcccagtgggatgccctaccctgcgcccttaggacccggactgaccgtgtacaaaactttacgtgcsaaaattctcagtgaatttagctttctccctctttttgatgctgtaatttttgttcatcatgttttgctgtgatgttacataggtagatttgtatgtagtt

SEQ ID NO: 11569 - DNA, 201 bp, Homo sapiens
tctctggtttattaaaatgctaactataacattttttgtgaatactttgaatgtttcctaacagttgtgatgttactgttccgttttatgctcttattccragttcatttttaatggtttggaagccatttttgtaatgaataaatgttcatgctgtacagtatctgtagcatgccgttctggattaataaaagcaactta

SEQ ID NO: 11570 - DNA, 201 bp, Homo sapiens
agacaagccctcaaggatgcccggtccccatcaccggcacacattgtctctaacaaagtgccagtggtgcagcaccctcaccatgtccaccccctcacgcmtcttatcacgtacagcaatgaacacttcacgccgggaaacccacctccacacttaccagccgacgtagaccccaaaacaggaatcccacggcctccgcac

SEQ ID NO: 11571 - DNA, 201 bp, Homo sapiens
ccatagtcacaccaacagtcaaacaggaatcgtcccagagtgatgtcggctcactccatagttcaaagcatcaggactccaaaaaggaagaagaaaagaakaagccccacataaagaaacctcttaatgcattcatgttgtatatgaaggaaatgagagcaaaggtcgtagctgagtgcacgttgaaagaaagcgcggcca

SEQ ID NO: 11572 - DNA, 201 bp, Homo sapiens; identical to SEQ ID NO: 11565

SEQ ID NO: 11573 - DNA, 201 bp, Homo sapiens; identical to SEQ ID NO: 11566

SEQ ID NO: 11574 - DNA, 201 bp, Homo sapiens; identical to SEQ ID NO: 11567

SEQ ID NO: 11575 - DNA, 201 bp, Homo sapiens; identical to SEQ ID NO: 11568

SEQ ID NO: 11576 - DNA, 201 bp, Homo sapiens; identical to SEQ ID NO: 11569

SEQ ID NO: 11577 - DNA, 201 bp, Homo sapiens; identical to SEQ ID NO: 11570

SEQ ID NO: 11578 - DNA, 201 bp, Homo sapiens; identical to SEQ ID NO: 11571

SEQ ID NO: 11579 - DNA, 201 bp, Homo sapiens
aaaaggagccactccttacaaaaagttggggagccctggtgtattgagtctaacaaagtgccagtggtgcagcaccctcaccatgtccaccccctcacgcmtcttatcacgtacagcaatgaacacttcacgccgggaaacccacctccacacttaccagccgacgtagaccccaaaacaggaatcccacggcctccgcac

SEQ ID NO: 11580 - DNA, 201 bp, Homo sapiens; identical to SEQ ID NO: 11571

SEQ ID NO: 11581 - DNA, 201 bp, Homo sapiens; identical to SEQ ID NO: 11565

SEQ ID NO: 11582 - DNA, 201 bp, Homo sapiens; identical to SEQ ID NO: 11566

SEQ ID NO: 11583 - DNA, 201 bp, Homo sapiens; identical to SEQ ID NO: 11567

SEQ ID NO: 11584 - DNA, 201 bp, Homo sapiens; identical to SEQ ID NO: 11568

SEQ ID NO: 11585 - DNA, 201 bp, Homo sapiens; identical to SEQ ID NO: 11569

SEQ ID NO: 11586 - DNA, 201 bp, Homo sapiens; identical to SEQ ID NO: 11570

SEQ ID NO: 11587 - DNA, 201 bp, Homo sapiens; identical to SEQ ID NO: 11571

SEQ ID NO: 11588 - DNA, 201 bp, Homo sapiens; identical to SEQ ID NO: 11570

SEQ ID NO: 11589 - DNA, 201 bp, Homo sapiens; identical to SEQ ID NO: 11571

SEQ ID NO: 11590 - DNA, 201 bp, Homo sapiens; identical to SEQ ID NO: 11565

SEQ ID NO: 11591 - DNA, 201 bp, Homo sapiens; identical to SEQ ID NO: 11566

SEQ ID NO: 11592 - DNA, 201 bp, Homo sapiens; identical to SEQ ID NO: 11567

SEQ ID NO: 11593 - DNA, 201 bp, Homo sapiens; identical to SEQ ID NO: 11568

SEQ ID NO: 11594 - DNA, 201 bp, Homo sapiens; identical to SEQ ID NO: 11569

SEQ ID NO: 11595 - DNA, 201 bp, Homo sapiens; identical to SEQ ID NO: 11570

SEQ ID NO: 11596 - DNA, 201 bp, Homo sapiens; identical to SEQ ID NO: 11571

SEQ ID NO: 11597 - DNA, 201 bp, Homo sapiens; identical to SEQ ID NO: 11565

SEQ ID NO: 11598 - DNA, 201 bp, Homo sapiens; identical to SEQ ID NO: 11566

SEQ ID NO: 11599 - DNA, 201 bp, Homo sapiens; identical to SEQ ID NO: 11567

SEQ ID NO: 11600 - DNA, 201 bp, Homo sapiens; identical to SEQ ID NO: 11568

SEQ ID NO: 11601 - DNA, 201 bp, Homo sapiens; identical to SEQ ID NO: 11569

SEQ ID NO: 11602 - DNA, 201 bp, Homo sapiens; identical to SEQ ID NO: 11570

SEQ ID NO: 11603 - DNA, 201 bp, Homo sapiens; identical to SEQ ID NO: 11571

SEQ ID NO: 11604 - DNA, 201 bp, Homo sapiens; identical to SEQ ID NO: 11565

SEQ ID NO: 11605 - DNA, 201 bp, Homo sapiens; identical to SEQ ID NO: 11566

SEQ ID NO: 11606 - DNA, 201 bp, Homo sapiens; identical to SEQ ID NO: 11567

SEQ ID NO: 11607 - DNA, 201 bp, Homo sapiens; identical to SEQ ID NO: 11568

SEQ ID NO: 11608 - DNA, 201 bp, Homo sapiens; identical to SEQ ID NO: 11569

SEQ ID NO: 11609 - DNA, 201 bp, Homo sapiens; identical to SEQ ID NO: 11570

SEQ ID NO: 11610 - DNA, 201 bp, Homo sapiens; identical to SEQ ID NO: 11571

SEQ ID NO: 11611 - DNA, 201 bp, Homo sapiens; identical to SEQ ID NO: 11565

SEQ ID NO: 11612 - DNA, 201 bp, Homo sapiens; identical to SEQ ID NO: 11566

SEQ ID NO: 11613 - DNA, 201 bp, Homo sapiens; identical to SEQ ID NO: 11567

SEQ ID NO: 11614 - DNA, 201 bp, Homo sapiens; identical to SEQ ID NO: 11568

SEQ ID NO: 11615 - DNA, 201 bp, Homo sapiens; identical to SEQ ID NO: 11569

SEQ ID NO: 11616 - DNA, 201 bp, Homo sapiens; identical to SEQ ID NO: 11579

SEQ ID NO: 11617 - DNA, 201 bp, Homo sapiens; identical to SEQ ID NO: 11571

SEQ ID NO: 11618 - DNA, 201 bp, Homo sapiens; identical to SEQ ID NO: 11565

SEQ ID NO: 11619 - DNA, 201 bp, Homo sapiens; identical to SEQ ID NO: 11566

SEQ ID NO: 11620 - DNA, 201 bp, Homo sapiens; identical to SEQ ID NO: 11567

SEQ ID NO: 11621 - DNA, 201 bp, Homo sapiens; identical to SEQ ID NO: 11568

SEQ ID NO: 11622 - DNA, 201 bp, Homo sapiens; identical to SEQ ID NO: 11569

SEQ ID NO: 11623 - DNA, 201 bp, Homo sapiens; identical to SEQ ID NO: 11570

SEQ ID NO: 11624 - DNA, 201 bp, Homo sapiens; identical to SEQ ID NO: 11571

SEQ ID NO: 11625 - DNA, 201 bp, Homo sapiens
tgggtcggagcccatctgatgaatacaaagacaacctgcaccaggtcagcaaaaggttgaggggtgaggtgggtctcctgttcaccaaccgcacaaaggargaggtgaatgagtggttcacgaaatacacagaaatggactacgcccgagctggtaacaaagcagctttcactgtgagcctggatccagggcccctggagc

SEQ ID NO: 11626 - DNA, 201 bp, Homo sapiens
cgcgaggccctcggtcggacgggacgctcgggattcagggactgcctcggcacacgggaagttgccctacaggcgcgggagaaagcgcaggcggcggcttrgcagggagaggcaggctgcagtgcacattgggtcaggcacacgcgaggggcagcccccgagggccgtcccagagtcccccgcgccgccggggtcctaacg

SEQ ID NO: 11627 - DNA, 198 bp, Homo sapiens
atgatgcgagcgcatgcaccacccaccgccgtcccggcatgcaccgcgccgcgggctccgcctccgcgggaccacagagctgggatagcgcgcgaggscctcggtcggacgggacgctcgggattcagggactgcctcggcacacgggaagttgccctacaggcgcgggagaaagcgcaggcggcggcttggcaggga

SEQ ID NO: 11628 - DNA, 126 bp, Homo sapiens
atgatgcgagcgcatgcaccacccaycgccgtcccggcatgcaccgcgccgcgggctccgcctccgcgggaccacagagctgggatagcgcgcgaggccctcggtcggacgggacgctcgggattc

SEQ ID NO: 11629 - DNA, 201 bp, Homo sapiens
ctctgctgtctgactacgaggtgtgcaaggagggcgatgtgctgaccccagagcaggctcgcgtcctgaagctttttgggtatgagatggctgaattcaargtgaccatcaaatacatgtgggattcacagtcgggaaggttccagcagatgggagacgacttgccagagagcgcatctgagtccacagaagagtcagact

SEQ ID NO: 11630 - DNA, 152 bp, Homo sapiens
atgatgcgagcgcatgcaccacccaccgccgtcccggcatgcaccgcgccgsgggctccgcctccgcgggaccacagagctgggatagcgcgcgaggccctcggtcggacgggacgctcgggattcagggactgcctcggcacacgggaagt

SEQ ID NO: 11631 - DNA, 201 bp, Homo sapiens
tcctaacggggtgcaccgtcttccgccgcacgtggattcagcgcgatgcccaaatccaagcgcgacaagaaaggtgggcgaagggggagtcgggaccctgsggggagctccgtgggctggctacccagcctgcggtgagggcttcggggcggcgggggcgcagattggaacgccaggacatcctcgaggtgttccgctgcc

SEQ ID NO: 11632 - DNA, 201 bp, Homo sapiens
ggaacgcctggaagcacagccggatgttctttggcaaaaacaaggtgatgatggtggccttgggtcggagcccatctgatgaatacaaagacaacctgcaycaggtcagcaaaaggttgaggggtgaggtgggtctcctgttcaccaaccgcacaaaggaggaggtgaatgagtggttcacgaaatacacagaaatggact

SEQ ID NO: 11633 - DNA, 161 bp, Homo sapiens
atgatgcgagcgcatgcaccacccaccgccgtcccggcatgcaccgcgccgcgggctccgyctccgcgggaccacagagctgggatagcgcgcgaggccctcggtcggacgggacgctcgggattcagggactgcctcggcacacgggaagttgccctaca

SEQ ID NO: 11634 - DNA, 201 bp, Homo sapiens
tggagtccacttgtttggttgtggcctatggtttggacatttaccaaactcgagtctacccatccaagcagtttgacgttctgaaggatgactatgactaygtgttaatcagcagcgtcctctttggcctggtttttgccaccatgatcactaagagactggcacaggtgaagctcctgaatcgggcctggcgataaagaa

SEQ ID NO: 11635 - DNA, 201 bp, Homo sapiens
ttgtcaagtttaatgtggaagatggagagattgttcagcaggttagggtttcaactccgtggctgcagcacctgtctggagcctgtggtgtggtggatgargctgtcctggtgtgtcctgacccgagctcacgttccctccaaactttggctctggagacggaatgggagttgagacagatcccactgcagtctctcgact

SEQ ID NO: 11636 - DNA, 201 bp, Homo sapiens
gcacggcagaaggggctgtggatgccatgctgctgcacggacaggatgtgatcactgtgtccaatggaggccgaatcatgcgttcctgggagactaacatygggggcctgaactgggagataaccctggacagtggcagtttccaggcacttgggctggttggcctgcaggagtctgtaaggtacatcgcagtcctgaaga

SEQ ID NO: 11637 - DNA, 201 bp, Homo sapiens
atgtacagatacacgcagagcgattcatcaactataaccagacagtttctcgaatgcgaggtatctacacagctccctcgggtctggagtccacttgtttrgttgtggcctatggtttggacatttaccaaactcgagtctacccatccaagcagtttgacgttctgaaggatgactatgactacgtgttaatcagcagcg

SEQ ID NO: 11638 - DNA, 201 bp, Homo sapiens
aaaaacttcccacagactgccctagtgagctttgccaccactggggagaagacggtggctgcagtcatggcctgtcggaatgaagtgcagaaaagtagcarttctgaagatgggtcaatggggagcttttcggagaagtctagttcaaaggactctctggcttgcttcaatcagacctacaccattaacctatacctcgtg

SEQ ID NO: 11639 - DNA, 201 bp, Homo sapiens
ccgcagtgtgctctacaagagcctgaaccccaacctgctggccgtggtgacagagagcacagacgcgcaccatgagcgcacctttattggcatcttcctcrttgatggcgtcactgggcgtatcattcactcctctgtgcagaagaaagccaaaggccctgtccatatcgtgcattcagagaactgggtggtgtaccagta

SEQ ID NO: 11640 - DNA, 201 bp, Homo sapiens
ttgcttaaaaacttcccacagactgccctagtgagctttgccaccactggggagaagacggtggctgcagtcatggcctgtcggaatgaagtgcagaaaastagcagttctgaagatgggtcaatggggagcttttcggagaagtctagttcaaaggactctctggcttgcttcaatcagacctacaccattaacctatac

SEQ ID NO: 11641 - DNA, 201 bp, Homo sapiens
cagtctctcgacttagaatttggaagtggattccaaccccgggtcctgcctacccagcccaacccagtggacgcttcccgggcccagttcttcctgcactygtccccaagccactatgctctgctgcagtaccattatggaacgctgagtttgcttaaaaacttcccacagactgccctagtgagctttgccaccactggg

SEQ ID NO: 11642 - DNA, 105 bp, Homo sapiens
ggcgrtgggtggtgcatgcgctcgcatcatggcggctgagtgggcttctcgtttctggctttgggctacgctgctgattcctgcggccgcggtctacgaagacca

SEQ ID NO: 11643 - DNA, 201 bp, Homo sapiens
cgccaaggtgttgctgttgatagatgatgaatacaaggtcacagcttttccagccactcggaatgtcttgcgacagctacatgagcttgccccttccatcytcttctatttggtggatgcagagcagggacggctgtgtggatatcggcttcgaaaggatctcaccactgagctgagttgggagctgaccattcccccaga

SEQ ID NO: 11644 - DNA, 201 bp, Homo sapiens
gtcctgcctacccagcccaacccagtggacgcttcccgggcccagttcttcctgcacttgtccccaagccactatgctctgctgcagtaccattatggaaygctgagtttgcttaaaaacttcccacagactgccctagtgagctttgccaccactggggagaagacggtggctgcagtcatggcctgtcggaatgaagtg

SEQ ID NO: 11645 - DNA, 201 bp, Homo sapiens
aattttattgatctaacctttgaagctttaaaaaaggagaaagagggtaggggtgggaaactggcatactgtgtgtatagcactgccgattggctaggccmctgtgtctctgctacaaattaaagaaatcctaaaagttttccttggtcatagagttggggaatgacagaatttttctttgttgtgaaatgtatgtacaga

SEQ ID NO: 11646 - DNA, 201 bp, Homo sapiens
tgggggaccgcagtgtgctctacaagagcctgaaccccaacctgctggccgtggtgacagagagcacagacgcgcaccatgagcgcacctttattggcatyttcctcattgatggcgtcactgggcgtatcattcactcctctgtgcagaagaaagccaaaggccctgtccatatcgtgcattcagagaactgggtggtgt

SEQ ID NO: 11647 - DNA, 201 bp, Homo sapiens
tgaaggggaaacgcagcagtgagcacgttcattcccagggccgtgtgatgggggaccgcagtgtgctctacaagagcctgaaccccaacctgctggccgtrgtgacagagagcacagacgcgcaccatgagcgcacctttattggcatcttcctcattgatggcgtcactgggcgtatcattcactcctctgtgcagaaga

SEQ ID NO: 11648 - DNA, 201 bp, Homo sapiens; identical to SEQ ID NO: 11634

SEQ ID NO: 11649 - DNA, 201 bp, Homo sapiens; identical to SEQ ID NO: 11636

SEQ ID NO: 11650 - DNA, 201 bp, Homo sapiens; identical to SEQ ID NO: 11637

SEQ ID NO: 11651 - DNA, 201 bp, Homo sapiens
attgagaacaacagtcagcacttgggattttccttcctggtctccactaggaaccctgaaaatcagaagtctgggcacattgacctgcagaaaagtagcarttctgaagatgggtcaatggggagcttttcggagaagtctagttcaaaggactctctggcttgcttcaatcagacctacaccattaacctatacctcgtg

SEQ ID NO: 11652 - DNA, 201 bp, Homo sapiens; identical to SEQ ID NO: 11639

SEQ ID NO: 11653 - DNA, 201 bp, Homo sapiens
gtgagtattgagaacaacagtcagcacttgggattttccttcctggtctccactaggaaccctgaaaatcagaagtctgggcacattgacctgcagaaaastagcagttctgaagatgggtcaatggggagcttttcggagaagtctagttcaaaggactctctggcttgcttcaatcagacctacaccattaacctatac

SEQ ID NO: 11654 - DNA, 201 bp, Homo sapiens; identical to SEQ ID NO: 11641

SEQ ID NO: 11655 - DNA, 105 bp, Homo sapiens; identical to SEQ ID NO: 11642

SEQ ID NO: 11656 - DNA, 201 bp, Homo sapiens; identical to SEQ ID NO: 11643

SEQ ID NO: 11657 - DNA, 201 bp, Homo sapiens; identical to SEQ ID NO: 11644

SEQ ID NO: 11658 - DNA, 201 bp, Homo sapiens; identical to SEQ ID NO: 11645

SEQ ID NO: 11659 - DNA, 201 bp, Homo sapiens; identical to SEQ ID NO: 11646

SEQ ID NO: 11660 - DNA, 201 bp, Homo sapiens; identical to SEQ ID NO: 11647

SEQ ID NO: 11661 - DNA, 201 bp, Homo sapiens
ggaccccatcccgcgctggtggagggtcgcaggagcagcgtgaaagtggaggctgaggccagccggcagtgagggttggactggtgtcttcagacccaggmcctcagacttctggctcacacagacccccacgctctccatccccggaatctagtcacaaccctggatccttcctctgcccttctcctgcctccccacctg

SEQ ID NO: 11662 - DNA, 201 bp, Homo sapiens
gtggagggtcgcaggagcagcgtgaaagtggaggctgaggccagccggcagtgagggttggactggtgtcttcagacccaggacctcagacttctggctcmcacagacccccacgctctccatccccggaatctagtcacaaccctggatccttcctctgcccttctcctgcctccccacctgctccatgggcataagact

SEQ ID NO: 11663 - DNA, 201 bp, Homo sapiens
catgttctatgtggtcatgcaactaaggtgccagctatatatttaacatatcctaggtacatacacgttcacacagctatacacgaagaatctcagccctygtacttttgcatagtctcatacacgtatcagaagcctccacctggctaacaggaatttggggctttgggagattttttaatcagggcaaaacctgtacta

SEQ ID NO: 11664 - DNA, 201 bp, Homo sapiens
ggagggtcgcaggagcagcgtgaaagtggaggctgaggccagccggcagtgagggttggactggtgtcttcagacccaggacctcagacttctggctcacmcagacccccacgctctccatccccggaatctagtcacaaccctggatccttcctctgcccttctcctgcctccccacctgctccatgggcataagactgt

SEQ ID NO: 11665 - DNA, 201 bp, Homo sapiens
atacacgtatcagaagcctccacctggctaacaggaatttggggctttgggagattttttaatcagggcaaaacctgtactagtaaccacatgtccagacycctcctatgctcccacccagggtcccttgagctgcttcccattcccctagggctgagacccaatatcctctatccctggcctctagtgtaaatgtgtctg

SEQ ID NO: 11666 - DNA, 201 bp, Homo sapiens
ccagccggcagtgagggttggactggtgtcttcagacccaggacctcagacttctggctcacacagacccccacgctctccatccccggaatctagtcacmaccctggatccttcctctgcccttctcctgcctccccacctgctccatgggcataagactgtggggcttcaagcaataacaagcagaggcctggagagag

SEQ ID NO: 11667 - DNA, 201 bp, Homo sapiens
cagccggcagtgagggttggactggtgtcttcagacccaggacctcagacttctggctcacacagacccccacgctctccatccccggaatctagtcacamccctggatccttcctctgcccttctcctgcctccccacctgctccatgggcataagactgtggggcttcaagcaataacaagcagaggcctggagagagg

SEQ ID NO: 11668 - DNA, 201 bp, Homo sapiens
ttctgtgcagtgtctcaccctcccaaatttgtgttgtcacgtaggcaaaagcagatagacacatgttctatgtggtcatgcaactaaggtgccagctatayatttaacatatcctaggtacatacacgttcacacagctatacacgaagaatctcagcccttgtacttttgcatagtctcatacacgtatcagaagcctcc

SEQ ID NO: 11669 - DNA, 201 bp, Homo sapiens
cataggggcggtgggtgtgggatcccttcactggccccctcgggaggcctgggttggactcagggtctcctccagctgggggctggaccgcagcacctatytgagcagttagagcgtctttcttttcagattgtgtacagtagattatttattttgttattttggaataaaatttattttatggcttaggatctatgaccc

SEQ ID NO: 11670 - DNA, 201 bp, Homo sapiens
ctcttacccagcccccctcctgctcagccccatcaccctcagagagctctgtatgtgtgtgtgcgtgcgtgtgcgcgctgcaggtgcaggcatgttggggygtgtctcagagcctgaacttcccttccagtcagtgctggaaggaggtgggcaggggaatgatagaaaggaaggagtggattggctccacccactgtgcat

SEQ ID NO: 11671 - DNA, 201 bp, Homo sapiens
atgtcacagccacttggacccacttgggcacagtcagactccaaattcagagtatttgggggttagcatatgtcagagaggccagcacacttgctgctgtmttctgtgcagtgtctcaccctcccaaatttgtgttgtcacgtaggcaaaagcagatagacacatgttctatgtggtcatgcaactaaggtgccagctata

SEQ ID NO: 11672 - DNA, 201 bp, Homo sapiens
ctgcctgggggacctggggcaggggacccccggatctggccaggccggagcactccagagtcggacgttggggcaggaggagaagaggaggctggctcgcsgtgggactgggggtggtccagaccgactggagccagagatggtacgcatgcctgtctggggagagtctggatggacatttgcaggctgtggggtcatgtc

SEQ ID NO: 11673 - DNA, 201 bp, Homo sapiens
tggatggggcaacagaaaagatgcagcaggcagggccctctcatacactggagggccacatggccaggcctggacccagactctcaccctggctcccaggyagcattggaggtgtggagccatacgtagatgtcacagccacttggacccacttgggcacagtcagactccaaattcagagtatttgggggttagcatatg

SEQ ID NO: 11674 - DNA, 201 bp, Homo sapiens
tctgcccttctcctgcctccccacctgctccatgggcataagactgtggggcttcaagcaataacaagcagaggcctggagagaggacacaaggagggtgygtggtgccctcacccctgcccagagcgagggggcaaggactctgcctccagggcatctggggttttcccctccctcacacaacacactcccattctcttt

SEQ ID NO: 11675 - DNA, 201 bp, Homo sapiens
gacacaaggagggtgcgtggtgccctcacccctgcccagagcgagggggcaaggactctgcctccagggcatctggggttttcccctccctcacacaacasactcccattctctttaggtttgcaccagtggtgtgagcagttggactcagtttggacaagggggaaagggggacttccctgggaaggtccagctaaaagt

SEQ ID NO: 11676 - DNA, 201 bp, Homo sapiens
ttccctgccctacataggggcggtgggtgtgggatcccttcactggccccctcgggaggcctgggttggactcagggtctcctccagctgggggctggacygcagcacctatctgagcagttagagcgtctttcttttcagattgtgtacagtagattatttattttgttattttggaataaaatttattttatggcttag

SEQ ID NO: 11677 - DNA, 201 bp, Homo sapiens; identical to SEQ ID NO: 11661

SEQ ID NO: 11678 - DNA, 201 bp, Homo sapiens; identical to SEQ ID NO: 11662

SEQ ID NO: 11679 - DNA, 201 bp, Homo sapiens; identical to SEQ ID NO: 11663

SEQ ID NO: 11680 - DNA, 201 bp, Homo sapiens; identical to SEQ ID NO: 11664

SEQ ID NO: 11681 - DNA, 201 bp, Homo sapiens; identical to SEQ ID NO: 11665

SEQ ID NO: 11682 - DNA, 201 bp, Homo sapiens; identical to SEQ ID NO: 11666

SEQ ID NO: 11683 - DNA, 201 bp, Homo sapiens; identical to SEQ ID NO: 11667

SEQ ID NO: 11684 - DNA, 201 bp, Homo sapiens; identical to SEQ ID NO: 11668

SEQ ID NO: 11685 - DNA, 201 bp, Homo sapiens; identical to SEQ ID NO: 11669

SEQ ID NO: 11686 - DNA, 201 bp, Homo sapiens; identical to SEQ ID NO: 11670

SEQ ID NO: 11687 - DNA, 201 bp, Homo sapiens; identical to SEQ ID NO: 11671

SEQ ID NO: 11688 - DNA, 201 bp, Homo sapiens
tgcctgggggacctggggcaggggacccccggatctggccaggccggagcactccagagtcggacgttggggcaggaggagaagaggaggctggctcgccscccttctccccccctgcagggggaggagtccctgaggggactggggctggggggctggcagcaggtgggactgggggtggtccagaccgactggagccag

SEQ ID NO: 11689 - DNA, 201 bp, Homo sapiens; identical to SEQ ID NO: 11673

SEQ ID NO: 11690 - DNA, 201 bp, Homo sapiens
atggccgtttcgactctaagcggcgggagggcaagcagctcagcctgcacgagctcaccatcaacgaggctgctgcccagttctgcatgagggacaacacrctcttattacggagagtggagctcttctctttgtcccgccaagtagcccgagagagcacctacttgtcctccttgaagggctccaggcttcaccctgaag

SEQ ID NO: 11691 - DNA, 201 bp, Homo sapiens
tggggcaggggacccccggatctggccaggccggagcactccagagtcggacgttggggcaggaggagaagaggaggctggctcgccccccttctcccccyctgcagggggaggagtccctgaggggactggggctggggggctggcagcaggtgggactgggggtggtccagaccgactggagccagagatggtacgcat

SEQ ID NO: 11692 - DNA, 201 bp, Homo sapiens; identical to SEQ ID NO: 11674

SEQ ID NO: 11693 - DNA, 201 bp, Homo sapiens; identical to SEQ ID NO: 11675

SEQ ID NO: 11694 - DNA, 201 bp, Homo sapiens; identical to SEQ ID NO: 11676

SEQ ID NO: 11695 - DNA, 201 bp, Homo sapiens; identical to SEQ ID NO: 11688

SEQ ID NO: 11696 - DNA, 201 bp, Homo sapiens; identical to SEQ ID NO: 11690

SEQ ID NO: 11697 - DNA, 201 bp, Homo sapiens; identical to SEQ ID NO: 11691

SEQ ID NO: 11698 - DNA, 201 bp, Homo sapiens; identical to SEQ ID NO: 11661

SEQ ID NO: 11699 - DNA, 201 bp, Homo sapiens; identical to SEQ ID NO: 11662

SEQ ID NO: 11700 - DNA, 201 bp, Homo sapiens; identical to SEQ ID NO: 11663

SEQ ID NO: 11701 - DNA, 201 bp, Homo sapiens; identical to SEQ ID NO: 11664

SEQ ID NO: 11702 - DNA, 201 bp, Homo sapiens; identical to SEQ ID NO: 11665

SEQ ID NO: 11703 - DNA, 201 bp, Homo sapiens; identical to SEQ ID NO: 11666

SEQ ID NO: 11704 - DNA, 201 bp, Homo sapiens; identical to SEQ ID NO: 11667

SEQ ID NO: 11705 - DNA, 201 bp, Homo sapiens; identical to SEQ ID NO: 11668

SEQ ID NO: 11706 - DNA, 201 bp, Homo sapiens; identical to SEQ ID NO: 11669

SEQ ID NO: 11707 - DNA, 201 bp, Homo sapiens; identical to SEQ ID NO: 11670

SEQ ID NO: 11708 - DNA, 201 bp, Homo sapiens; identical to SEQ ID NO: 11671

SEQ ID NO: 11709 - DNA, 201 bp, Homo sapiens; identical to SEQ ID NO: 11688

SEQ ID NO: 11710 - DNA, 201 bp, Homo sapiens; identical to SEQ ID NO: 11673

SEQ ID NO: 11711 - DNA, 201 bp, Homo sapiens; identical to SEQ ID NO: 11690

SEQ ID NO: 11712 - DNA, 201 bp, Homo sapiens; identical to SEQ ID NO: 11691

SEQ ID NO: 11713 - DNA, 201 bp, Homo sapiens; identical to SEQ ID NO: 11674

SEQ ID NO: 11714 - DNA, 201 bp, Homo sapiens; identical to SEQ ID NO: 11675

SEQ ID NO: 11715 - DNA, 201 bp, Homo sapiens; identical to SEQ ID NO: 11676

SEQ ID NO: 11716 - DNA, 201 bp, Homo sapiens
caatgggctctgtttgtgagcctgcctgcacgtgtgtgtgtgtgtgtgtgtgtgtgtgtgtgtagtcttgtgtgtgtgtgtgtgtgtgtgtgtgtgtgtgtatgtatgtgtgtgctttatcttatttttctttttggtggtggtggtggaaggggggaggtgctagcagggccagccttgaactcgctggacagagctaca

SEQ ID NO: 11717 - DNA, 201 bp, Homo sapiens
gcaatgggctctgtttgtgagcctgcctgcacgtgtgtgtgtgtgtgtgtgtgtgtgtgtgtgtagtcttgtgtgtgtgtgtgtgtgtgtgtgtgtgtgtgtatgtatgtgtgtgctttatcttatttttctttttggtggtggtggtggaaggggggaggtgctagcagggccagccttgaactcgctggacagagctac

SEQ ID NO: 11718 - DNA, 201 bp, Homo sapiens
tgcaatgggctctgtttgtgagcctgcctgcacgtgtgtgtgtgtgtgtgtgtgtgtgtgtgtgtagtcttgtgtgtgtgtgtgtgtgtgtgtgtgtgtgtgtatgtatgtgtgtgctttatcttatttttctttttggtggtggtggtggaaggggggaggtgctagcagggccagccttgaactcgctggacagagcta

SEQ ID NO: 11719 - DNA, 201 bp, Homo sapiens
ttgcaatgggctctgtttgtgagcctgcctgcacgtgtgtgtgtgtgtgtgtgtgtgtgtgtgtgtagtcttgtgtgtgtgtgtgtgtgtgtgtgtgtgtgtgtatgtatgtgtgtgctttatcttatttttctttttggtggtggtggtggaaggggggaggtgctagcagggccagccttgaactcgctggacagagct

SEQ ID NO: 11720 - DNA, 144 bp, Homo sapiens
ctgtgtgtgtgtgtgtgtgtgtgtgtgtgtgtgtgtgtgtgtgtgtgtgtgtggtgttgtgattgcaatgggctctgtttgtgagcctgcctgcacgtgtgtgtgtgtgtgtgtgtgtgtgtgtgtgtagtcttgtgtgtgtgt

SEQ ID NO: 11721 - DNA, 201 bp, Homo sapiens
caggtggggaggcaggagaagggcagaggaaggatccagggttgtgactagattccggggatggagagcgtgggggtctgtgtgagccagaagtctgaggkcctgggtctgaagacaccagtccaaccctcactgctgcgagaggtggcttcgcaggcacacaggggctgaggcggcccacgcggtcgtgggagacgaggc

SEQ ID NO: 11722 - DNA, 201 bp, Homo sapiens
agtcttatgcccatggagcaggtggggaggcaggagaagggcagaggaaggatccagggttgtgactagattccggggatggagagcgtgggggtctgtgkgagccagaagtctgaggtcctgggtctgaagacaccagtccaaccctcactgctgcgagaggtggcttcgcaggcacacaggggctgaggcggcccacgc

SEQ ID NO: 11723 - DNA, 201 bp, Homo sapiens
tagtacaggttttgccctgattaaaaaatctcccaaagccccaaattcctgttagccaggtggaggcttctgatacgtgtatgagactatgcaaaagtacragggctgagattcttcgtgtatagctgtgtgaacgtgtatgtacctaggatatgttaaatatatagctggcaccttagttgcatgaccacatagaacatg

SEQ ID NO: 11724 - DNA, 201 bp, Homo sapiens
ccacttgccaatgcctttccactggaagcaggaagaactcaagtttaagacaggcttgcggaggctgcagcaccgagtaggggagatccaccttctccgasaagccctgcagaagggggctgaggctggccaagtgtctctgcacagcttgatagaaactcctgctaatgggactgggccaagtgaggccctggccatgct

SEQ ID NO: 11725 - DNA, 201 bp, Homo sapiens
acagtcttatgcccatggagcaggtggggaggcaggagaagggcagaggaaggatccagggttgtgactagattccggggatggagagcgtgggggtctgkgtgagccagaagtctgaggtcctgggtctgaagacaccagtccaaccctcactgctgcgagaggtggcttcgcaggcacacaggggctgaggcggcccac

SEQ ID NO: 11726 - DNA, 201 bp, Homo sapiens
cagacacatttacactagaggccagggatagaggatattgggtctcagccctaggggaatgggaagcagctcaagggaccctgggtgggagcataggaggrgtctggacatgtggttactagtacaggttttgccctgattaaaaaatctcccaaagccccaaattcctgttagccaggtggaggcttctgatacgtgtat

SEQ ID NO: 11727 - DNA, 201 bp, Homo sapiens
tgagcatgcagcttggcccagatatggtgccccaggtgtacccaccacactctcactccatccccccgtatcaaggcctctccccagaagaatcagtcaaygtgttgtcagccttccaggagcctcacctgcagatgccccccagcctgggccagatgagcctgccctttgaccagcctcacccccagggcctgctgccgt

SEQ ID NO: 11728 - DNA, 201 bp, Homo sapiens
ctctctccaggcctctgcttgttattgcttgaagccccacagtcttatgcccatggagcaggtggggaggcaggagaagggcagaggaaggatccagggtkgtgactagattccggggatggagagcgtgggggtctgtgtgagccagaagtctgaggtcctgggtctgaagacaccagtccaaccctcactgctgcgaga

SEQ ID NO: 11729 - DNA, 201 bp, Homo sapiens
gctactggtctgaccggctgatcattggcttcatcagcaaacagtacgttactagccttcttctcaatgagcccgacggaacctttctcctccgcttcagygactcagagattgggggcatcaccattgcccatgtcatccggggccaggatggctctccacagatagagaacatccagccattctctgccaaagacctgt

SEQ ID NO: 11730 - DNA, 201 bp, Homo sapiens
cctctctccaggcctctgcttgttattgcttgaagccccacagtcttatgcccatggagcaggtggggaggcaggagaagggcagaggaaggatccagggktgtgactagattccggggatggagagcgtgggggtctgtgtgagccagaagtctgaggtcctgggtctgaagacaccagtccaaccctcactgctgcgag

SEQ ID NO: 11731 - DNA, 201 bp, Homo sapiens
ggaggcttctgatacgtgtatgagactatgcaaaagtacaagggctgagattcttcgtgtatagctgtgtgaacgtgtatgtacctaggatatgttaaatrtatagctggcaccttagttgcatgaccacatagaacatgtgtctatctgcttttgcctacgtgacaacacaaatttgggagggtgagacactgcacagaa

SEQ ID NO: 11732 - DNA, 201 bp, Homo sapiens
gggtcatagatcctaagccataaaataaattttattccaaaataacaaaataaataatctactgtacacaatctgaaaagaaagacgctctaactgctcarataggtgctgcggtccagcccccagctggaggagaccctgagtccaacccaggcctcccgagggggccagtgaagggatcccacacccaccgcccctatg

SEQ ID NO: 11733 - DNA, 201 bp, Homo sapiens
atgcacagtgggtggagccaatccactccttcctttctatcattcccctgcccacctccttccagcactgactggaagggaagttcaggctctgagacacrccccaacatgcctgcacctgcagcgcgcacacgcacgcacacacacatacagagctctctgagggtgatggggctgagcaggaggggggctgggtaagag

SEQ ID NO: 11734 - DNA, 201 bp, Homo sapiens
tatagctggcaccttagttgcatgaccacatagaacatgtgtctatctgcttttgcctacgtgacaacacaaatttgggagggtgagacactgcacagaakacagcagcaagtgtgctggcctctctgacatatgctaacccccaaatactctgaatttggagtctgactgtgcccaagtgggtccaagtggctgtgacat

SEQ ID NO: 11735 - DNA, 201 bp, Homo sapiens
catatgctaacccccaaatactctgaatttggagtctgactgtgcccaagtgggtccaagtggctgtgacatctacgtatggctccacacctccaatgctrcctgggagccagggtgagagtctgggtccaggcctggccatgtggccctccagtgtatgagagggccctgcctgctgcatcttttctgttgccccatcca

SEQ ID NO: 11736 - DNA, 201 bp, Homo sapiens
cgagaagccctgcagaagggggctgaggctggccaagtgtctctgcacagcttgatagaaactcctgctaatgggactgggccaagtgaggccctggccakgctactgcaggagaccactggagagctagaggcagccaaagccctagtgctgaagaggatccagatttggaaacggcagcagcagctggcagggaatggc

SEQ ID NO: 11737 - DNA, 201 bp, Homo sapiens
aaagagaatgggagtgtgttgtgtgagggaggggaaaaccccagatgccctggaggcagagtccttgccccctcgctctgggcaggggtgagggcaccacrcaccctccttgtgtcctctctccaggcctctgcttgttattgcttgaagccccacagtcttatgcccatggagcaggtggggaggcaggagaagggcaga

SEQ ID NO: 11738 - DNA, 201 bp, Homo sapiens
acttttagctggaccttcccagggaagtccccctttcccccttgtccaaactgagtccaactgctcacaccactggtgcaaacctaaagagaatgggagtstgttgtgtgagggaggggaaaaccccagatgccctggaggcagagtccttgccccctcgctctgggcaggggtgagggcaccacgcaccctccttgtgtc

SEQ ID NO: 11739 - DNA, 201 bp, Homo sapiens
ctaagccataaaataaattttattccaaaataacaaaataaataatctactgtacacaatctgaaaagaaagacgctctaactgctcagataggtgctgcrgtccagcccccagctggaggagaccctgagtccaacccaggcctcccgagggggccagtgaagggatcccacacccaccgcccctatgtagggcagggaa

SEQ ID NO: 11740 - DNA, 201 bp, Homo sapiens
gaaggggggaggtgctagcagggccagccttgaactcgctggacagagctacagacctatggggcctggaagtgcccgctgagaaagggagaagacagcasaggggttgccgaggcaacctccaagtcccagatcatgtctctgtggggtctggtctccaagatgcccccagaaaaagtgcagcggctctatgtcgacttt

SEQ ID NO: 11741 - DNA, 201 bp, Homo sapiens
ggaggggcaaggggagtcggggggagggtccttgggggcacagcccctcctgcagccctcccactatgggcaatctgggatctcaatgtcccacatggacytaagggccaaccccagttggtgatcccagctggagggagaacccaaagagacagctcttctactacccccacagacctgctctggacacttgctcatgcc

SEQ ID NO: 11742 - DNA, 201 bp, Homo sapiens
gtgtgtgtgtgtgtgtgtagtcttgtgtgtgtgtgtgtgtgtgtgtgtgtgtgtgtatgtatgtgtgtgctttatcttatttttctttttggtggtggtgktggaaggggggaggtgctagcagggccagccttgaactcgctggacagagctacagacctatggggcctggaagtgcccgctgagaaagggagaagacag

SEQ ID NO: 11743 - DNA, 201 bp, Homo sapiens; identical to SEQ ID NO: 11716

SEQ ID NO: 11744 - DNA, 201 bp, Homo sapiens; identical to SEQ ID NO: 11717

SEQ ID NO: 11745 - DNA, 201 bp, Homo sapiens; identical to SEQ ID NO: 11718

SEQ ID NO: 11746 - DNA, 201 bp, Homo sapiens; identical to SEQ ID NO: 11719

SEQ ID NO: 11747 - DNA, 144 bp, Homo sapiens; identical to SEQ ID NO: 11720

SEQ ID NO: 11748 - DNA, 135 bp, Homo sapiens
caggtggggaggcaggagaagggcagaggaaggatccagggttgtgactagattccggggatggagagcgtgggggtctgtgtgagccagaagtctgaggkcctgggtctgaagacaccagtccaaccctcactg

SEQ ID NO: 11749 - DNA, 153 bp, Homo sapiens
agtcttatgcccatggagcaggtggggaggcaggagaagggcagaggaaggatccagggttgtgactagattccggggatggagagcgtgggggtctgtgkgagccagaagtctgaggtcctgggtctgaagacaccagtccaaccctcactg

SEQ ID NO: 11750 - DNA, 201 bp, Homo sapiens; identical to SEQ ID NO: 11723

SEQ ID NO: 11751 - DNA, 201 bp, Homo sapiens; identical to SEQ ID NO: 11724

SEQ ID NO: 11752 - DNA, 155 bp, Homo sapiens
acagtcttatgcccatggagcaggtggggaggcaggagaagggcagaggaaggatccagggttgtgactagattccggggatggagagcgtgggggtctgkgtgagccagaagtctgaggtcctgggtctgaagacaccagtccaaccctcactg

SEQ ID NO: 11753 - DNA, 201 bp, Homo sapiens; identical to SEQ ID NO: 11726

SEQ ID NO: 11754 - DNA, 201 bp, Homo sapiens; identical to SEQ ID NO: 11727

SEQ ID NO: 11755 - DNA, 193 bp, Homo sapiens
ctctctccaggcctctgcttgttattgcttgaagccccacagtcttatgcccatggagcaggtggggaggcaggagaagggcagaggaaggatccagggtkgtgactagattccggggatggagagcgtgggggtctgtgtgagccagaagtctgaggtcctgggtctgaagacaccagtccaaccctcactg

SEQ ID NO: 11756 - DNA, 201 bp, Homo sapiens; identical to SEQ ID NO: 11729

SEQ ID NO: 11757 - DNA, 194 bp, Homo sapiens
cctctctccaggcctctgcttgttattgcttgaagccccacagtcttatgcccatggagcaggtggggaggcaggagaagggcagaggaaggatccagggktgtgactagattccggggatggagagcgtgggggtctgtgtgagccagaagtctgaggtcctgggtctgaagacaccagtccaaccctcactg

SEQ ID NO: 11758 - DNA, 201 bp, Homo sapiens; identical to SEQ ID NO: 11731

SEQ ID NO: 11759 - DNA, 201 bp, Homo sapiens; identical to SEQ ID NO: 11732

SEQ ID NO: 11760 - DNA, 201 bp, Homo sapiens; identical to SEQ ID NO: 11733

SEQ ID NO: 11761 - DNA, 201 bp, Homo sapiens; identical to SEQ ID NO: 11734

SEQ ID NO: 11762 - DNA, 201 bp, Homo sapiens; identical to SEQ ID NO: 11735

SEQ ID NO: 11763 - DNA, 201 bp, Homo sapiens; identical to SEQ ID NO: 11736

SEQ ID NO: 11764 - DNA, 201 bp, Homo sapiens; identical to SEQ ID NO: 11737

SEQ ID NO: 11765 - DNA, 201 bp, Homo sapiens; identical to SEQ ID NO: 11738

SEQ ID NO: 11766 - DNA, 201 bp, Homo sapiens; identical to SEQ ID NO: 11739

SEQ ID NO: 11767 - DNA, 201 bp, Homo sapiens; identical to SEQ ID NO: 11740

SEQ ID NO: 11768 - DNA, 201 bp, Homo sapiens; identical to SEQ ID NO: 11741

SEQ ID NO: 11769 - DNA, 201 bp, Homo sapiens; identical to SEQ ID NO: 11742

SEQ ID NO: 11770 - DNA, 201 bp, Homo sapiens
tagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctaca

SEQ ID NO: 11771 - DNA, 201 bp, Homo sapiens
gtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctac

SEQ ID NO: 11772 - DNA, 201 bp, Homo sapiens
ggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagcta

SEQ ID NO: 11773 - DNA, 201 bp, Homo sapiens
gggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagct

SEQ ID NO: 11774 - DNA, 201 bp, Homo sapiens; identical to SEQ ID NO: 11721

SEQ ID NO: 11775 - DNA, 201 bp, Homo sapiens; identical to SEQ ID NO: 11722

SEQ ID NO: 11776 - DNA, 201 bp, Homo sapiens; identical to SEQ ID NO: 11723

SEQ ID NO: 11777 - DNA, 201 bp, Homo sapiens; identical to SEQ ID NO: 11724

SEQ ID NO: 11778 - DNA, 201 bp, Homo sapiens; identical to SEQ ID NO: 11725

SEQ ID NO: 11779 - DNA, 201 bp, Homo sapiens; identical to SEQ ID NO: 11726

SEQ ID NO: 11780 - DNA, 201 bp, Homo sapiens; identical to SEQ ID NO: 11727

SEQ ID NO: 11781 - DNA, 201 bp, Homo sapiens; identical to SEQ ID NO: 11728

SEQ ID NO: 11782 - DNA, 201 bp, Homo sapiens; identical to SEQ ID NO: 11729

SEQ ID NO: 11783 - DNA, 201 bp, Homo sapiens; identical to SEQ ID NO: 11730

SEQ ID NO: 11784 - DNA, 201 bp, Homo sapiens; identical to SEQ ID NO: 11731

SEQ ID NO: 11785 - DNA, 201 bp, Homo sapiens; identical to SEQ ID NO: 11732

SEQ ID NO: 11786 - DNA, 201 bp, Homo sapiens; identical to SEQ ID NO: 11733

SEQ ID NO: 11787 - DNA, 201 bp, Homo sapiens; identical to SEQ ID NO: 11734

SEQ ID NO: 11788 - DNA, 201 bp, Homo sapiens; identical to SEQ ID NO: 11735

SEQ ID NO: 11789 - DNA, 201 bp, Homo sapiens; identical to SEQ ID NO: 11736

SEQ ID NO: 11790 - DNA, 201 bp, Homo sapiens; identical to SEQ ID NO: 11737

SEQ ID NO: 11791 - DNA, 201 bp, Homo sapiens; identical to SEQ ID NO: 11738

SEQ ID NO: 11792 - DNA, 201 bp, Homo sapiens; identical to SEQ ID NO: 11739

SEQ ID NO: 11793 - DNA, 201 bp, Homo sapiens; identical to SEQ ID NO: 11740

SEQ ID NO: 11794 - DNA, 201 bp, Homo sapiens; identical to SEQ ID NO: 11741

SEQ ID NO: 11795 - DNA, 201 bp, Homo sapiens
cactgaagagggaggacgggagaggagtgtgtgtgtgtgtgtgtgtgtgtgtgtgtatgtatgtgtgtgctttatcttatttttctttttggtggtggtgktggaaggggggaggtgctagcagggccagccttgaactcgctggacagagctacagacctatggggcctggaagtgcccgctgagaaagggagaagacag

SEQ ID NO: 11796 - DNA, 129 bp, Homo sapiens
tgtgtgtgtgtgtgtgtgtgtgtgtgtgtatgtatgtgtgtgctttatcttatttttctttttggtggtggtggtggaaggggggaggtgctagcagggccagccttgaactcgctggacagagctaca

SEQ ID NO: 11797 - DNA, 128 bp, Homo sapiens
tgtgtgtgtgtgtgtgtgtgtgtgtgtgtatgtatgtgtgtgctttatcttatttttctttttggtggtggtggtggaaggggggaggtgctagcagggccagccttgaactcgctggacagagctac

SEQ ID NO: 11798 - DNA, 127 bp, Homo sapiens
tgtgtgtgtgtgtgtgtgtgtgtgtgtgtatgtatgtgtgtgctttatcttatttttctttttggtggtggtggtggaaggggggaggtgctagcagggccagccttgaactcgctggacagagcta

SEQ ID NO: 11799 - DNA, 126 bp, Homo sapiens
tgtgtgtgtgtgtgtgtgtgtgtgtgtgtatgtatgtgtgtgctttatcttatttttctttttggtggtggtggtggaaggggggaggtgctagcagggccagccttgaactcgctggacagagct

SEQ ID NO: 11800 - DNA, 135 bp, Homo sapiens; identical to SEQ ID NO: 11748

SEQ ID NO: 11801 - DNA, 153 bp, Homo sapiens; identical to SEQ ID NO: 11749

SEQ ID NO: 11802 - DNA, 201 bp, Homo sapiens; identical to SEQ ID NO: 11723

SEQ ID NO: 11803 - DNA, 201 bp, Homo sapiens; identical to SEQ ID NO: 11724

SEQ ID NO: 11804 - DNA, 155 bp, Homo sapiens; identical to SEQ ID NO: 11752

SEQ ID NO: 11805 - DNA, 201 bp, Homo sapiens; identical to SEQ ID NO: 11726

SEQ ID NO: 11806 - DNA, 201 bp, Homo sapiens; identical to SEQ ID NO: 11727

SEQ ID NO: 11807 - DNA, 193 bp, Homo sapiens; identical to SEQ ID NO: 11755

SEQ ID NO: 11808 - DNA, 201 bp, Homo sapiens; identical to SEQ ID NO: 11729

SEQ ID NO: 11809 - DNA, 194 bp, Homo sapiens; identical to SEQ ID NO: 11757

SEQ ID NO: 11810 - DNA, 201 bp, Homo sapiens; identical to SEQ ID NO: 11731

SEQ ID NO: 11811 - DNA, 201 bp, Homo sapiens; identical to SEQ ID NO: 11732

SEQ ID NO: 11812 - DNA, 201 bp, Homo sapiens; identical to SEQ ID NO: 11733

SEQ ID NO: 11813 - DNA, 201 bp, Homo sapiens; identical to SEQ ID NO: 11734

SEQ ID NO: 11814 - DNA, 201 bp, Homo sapiens; identical to SEQ ID NO: 11735

SEQ ID NO: 11815 - DNA, 201 bp, Homo sapiens; identical to SEQ ID NO: 11736

SEQ ID NO: 11816 - DNA, 201 bp, Homo sapiens; identical to SEQ ID NO: 11737

SEQ ID NO: 11817 - DNA, 201 bp, Homo sapiens; identical to SEQ ID NO: 11738

SEQ ID NO: 11818 - DNA, 201 bp, Homo sapiens; identical to SEQ ID NO: 11739

SEQ ID NO: 11819 - DNA, 201 bp, Homo sapiens; identical to SEQ ID NO: 11740

SEQ ID NO: 11820 - DNA, 201 bp, Homo sapiens; identical to SEQ ID NO: 11741

SEQ ID NO: 11821 - DNA, 174 bp, Homo sapiens
tgtgtgtgtgtgtgtgtgtgtgtgtgtgtatgtatgtgtgtgctttatcttatttttctttttggtggtggtgktggaaggggggaggtgctagcagggccagccttgaactcgctggacagagctacagacctatggggcctggaagtgcccgctgagaaagggagaagacag

SEQ ID NO: 11822 - DNA, 201 bp, Homo sapiens
tataagtacaagaatccctatggattccacctccccaaagatgatgtgaaagggatccaggcattatacggacctcggaaagtattcctggggaagcccamtctgccccatgccccccatcacaagccatccatccctgacctctgtgactccagctcatcctttgacgctgtgacaatgctggggaaggagctcctgctc

SEQ ID NO: 11823 - DNA, 166 bp, Homo sapiens
ctactgtgaggggatgaaggtgctccctgcatctggccttgctgtcttcctcatcatggctttgamgttttccactgcagccccctccctagttgcagcctcccccaggacctggaggaacaactaccgcctcgcacaggcgtatcttgacaaatattacacaaat

SEQ ID NO: 11824 - DNA, 201 bp, Homo sapiens
acctccccaaagatgatgtgaaagggatccaggcattatacggacctcggaaagtattcctggggaagcccactctgccccatgccccccatcacaagccwtccatccctgacctctgtgactccagctcatcctttgacgctgtgacaatgctggggaaggagctcctgctcttcaaggaccggattttctggagacggc

SEQ ID NO: 11825 - DNA, 201 bp, Homo sapiens
gcactgatgtacccaacttataagtacaagaatccctatggattccacctccccaaagatgatgtgaaagggatccaggcattatacggacctcggaaagyattcctggggaagcccactctgccccatgccccccatcacaagccatccatccctgacctctgtgactccagctcatcctttgacgctgtgacaatgctg

SEQ ID NO: 11826 - DNA, 201 bp, Homo sapiens
tgtgaggggatgaaggtgctccctgcatctggccttgctgtcttcctcatcatggctttgacgttttccactgcagccccctccctagttgcagcctcccycaggacctggaggaacaactaccgcctcgcacaggcgtatcttgacaaatattacacaaataaagaaggacaccagattggtgagatggttgcaagagga

SEQ ID NO: 11827 - DNA, 201 bp, Homo sapiens
ccccccatcacaagccatccatccctgacctctgtgactccagctcatcctttgacgctgtgacaatgctggggaaggagctcctgctcttcaaggaccgwattttctggagacggcaggttcacttgcggacaggaattcggcccagcactattaccagctccttcccccagctcatgtccaatgtggatgcagcttacg

SEQ ID NO: 11828 - DNA, 201 bp, Homo sapiens
tgagatggttgcaagaggaagcaattccatgataaggaagattaaggagctacaagcgttctttggcctccaagtcaccgggaagttagaccagaccacartgaacgtgatcaagaagcctcgctgtggagttcctgatgtggccaattatcgcctcttccctggtgaacccaaatggaaaaaaaatactttgacatacag

SEQ ID NO: 11829 - DNA, 201 bp, Homo sapiens
ggactatgggaacgaatggttttaatttgtttaccgttgctgctcatgaatttggccatgccctgggcctggcccattccacagacccatcagcactgatrtacccaacttataagtacaagaatccctatggattccacctccccaaagatgatgtgaaagggatccaggcattatacggacctcggaaagtattcctgg

SEQ ID NO: 11830 - DNA, 201 bp, Homo sapiens
aagcctcgctgtggagttcctgatgtggccaattatcgcctcttccctggtgaacccaaatggaaaaaaaatactttgacatacagaatatctaaatacayaccttccatgagttctgtcgaggtggacaaagcagtggagatggccttgcaggcctggagtagcgccgtccctctgagctttgtcagaataaactcagga

SEQ ID NO: 11831 - DNA, 201 bp, Homo sapiens
ccacagacccatcagcactgatgtacccaacttataagtacaagaatccctatggattccacctccccaaagatgatgtgaaagggatccaggcattatayggacctcggaaagtattcctggggaagcccactctgccccatgccccccatcacaagccatccatccctgacctctgtgactccagctcatcctttgacg

SEQ ID NO: 11832 - DNA, 168 bp, Homo sapiens
tagtggtggattccatgacatatattgtaattcttttcataggaaatgtcattacagtatgaattataattatttacaagcaatggcttttgtggccatcwtttggccatcatttgttataataaatataaatttcccaatttttacttaaaagacatcacaacaaaa

SEQ ID NO: 11833 - DNA, 201 bp, Homo sapiens
actttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccag

SEQ ID NO: 11834 - DNA, 201 bp, Homo sapiens
aagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatg

SEQ ID NO: 11835 - DNA, 201 bp, Homo sapiens
cgtctgctgtgactgggatcaccaccagcatcgtggagcactcatacacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatcc

SEQ ID NO: 11836 - DNA, 201 bp, Homo sapiens
agaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagc

SEQ ID NO: 11837 - DNA, 201 bp, Homo sapiens
ttacagcagggacgagtctggcccttactgcagctggggtagggctgggagcagcgtctgctgtgactgggatcaccaccagcatcgtggagcactcatayacatcatcagcagaagctgaagccagcaggctgactgcaaccagcattgaccgattgaaggtatttaaggaagttatgcgtgacatcacacccaacttac

SEQ ID NO: 11838 - DNA, 201 bp, Homo sapiens
tggcatcatgtcccttgctggtcttgttttggcaccatttacagcagggacgagtctggcccttactgcagctggggtagggctgggagcagcgtctgctrtgactgggatcaccaccagcatcgtggagcactcatacacatcatcagcagaagctgaagccagcaggctgactgcaaccagcattgaccgattgaaggt

SEQ ID NO: 11839 - DNA, 201 bp, Homo sapiens
aaataccagctggctggggcccaggagattaaaaaacaccgggctagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 11840 - DNA, 201 bp, Homo sapiens
ggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacacagctcagaacagctggatcttgctcacactctttcaagagaagct

SEQ ID NO: 11841 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctgga

SEQ ID NO: 11842 - DNA, 201 bp, Homo sapiens
agtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcag

SEQ ID NO: 11843 - DNA, 201 bp, Homo sapiens; identical to SEQ ID NO: 11833

SEQ ID NO: 11844 - DNA, 201 bp, Homo sapiens; identical to SEQ ID NO: 11834

SEQ ID NO: 11845 - DNA, 201 bp, Homo sapiens; identical to SEQ ID NO: 11835

SEQ ID NO: 11846 - DNA, 201 bp, Homo sapiens; identical to SEQ ID NO: 11836

SEQ ID NO: 11847 - DNA, 201 bp, Homo sapiens; identical to SEQ ID NO: 11837

SEQ ID NO: 11848 - DNA, 201 bp, Homo sapiens; identical to SEQ ID NO: 11838

SEQ ID NO: 11849 - DNA, 201 bp, Homo sapiens
cagaacagctggatcttgctcacactctttcaagagaagcttccttgggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 11850 - DNA, 201 bp, Homo sapiens; identical to SEQ ID NO: 11840

SEQ ID NO: 11851 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttgggttaagaaaaaaaacgaacccttccagtcaggtcagtgactggagagc

SEQ ID NO: 11852 - DNA, 201 bp, Homo sapiens; identical to SEQ ID NO: 11842

SEQ ID NO: 11853 - DNA, 201 bp, Homo sapiens; identical to SEQ ID NO: 11833

SEQ ID NO: 11854 - DNA, 201 bp, Homo sapiens; identical to SEQ ID NO: 11834

SEQ ID NO: 11855 - DNA, 201 bp, Homo sapiens; identical to SEQ ID NO: 11835

SEQ ID NO: 11856 - DNA, 201 bp, Homo sapiens; identical to SEQ ID NO: 11836

SEQ ID NO: 11857 - DNA, 201 bp, Homo sapiens; identical to SEQ ID NO: 11837

SEQ ID NO: 11858 - DNA, 201 bp, Homo sapiens; identical to SEQ ID NO: 11840

SEQ ID NO: 11859 - DNA, 201 bp, Homo sapiens; identical to SEQ ID NO: 11838

SEQ ID NO: 11860 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttgaaaagaaacgctttactgaagaggccaccaaatacttccgggagagagt

SEQ ID NO: 11861 - DNA, 201 bp, Homo sapiens; identical to SEQ ID NO: 11842

SEQ ID NO: 11862 - DNA, 201 bp, Homo sapiens; identical to SEQ ID NO: 11833

SEQ ID NO: 11863 - DNA, 201 bp, Homo sapiens; identical to SEQ ID NO: 11834

SEQ ID NO: 11864 - DNA, 201 bp, Homo sapiens; identical to SEQ ID NO: 11835

SEQ ID NO: 11865 - DNA, 201 bp, Homo sapiens; identical to SEQ ID NO: 11836

SEQ ID NO: 11866 - DNA, 201 bp, Homo sapiens; identical to SEQ ID NO: 11837

SEQ ID NO: 11867 - DNA, 201 bp, Homo sapiens; identical to SEQ ID NO: 11838

SEQ ID NO: 11868 - DNA, 201 bp, Homo sapiens
acaggtggctcacattcagtcccacaatttgctttctcctcctcaagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 11869 - DNA, 201 bp, Homo sapiens; identical to SEQ ID NO: 11840

SEQ ID NO: 11870 - DNA, 201 bp, Homo sapiens; identical to SEQ ID NO: 11841

SEQ ID NO: 11871 - DNA, 201 bp, Homo sapiens; identical to SEQ ID NO: 11842

SEQ ID NO: 11872 - DNA, 201 bp, Homo sapiens
cccagagacagttagttatttgacctaacaacggaaaacggtcaccccaggaagagtttggtgcctctgtccaggccggttccagacctgtcttgagacthtctccgtatttaagtcaacattcattcggttacacagaagttactttttaatttttaaggaggaaccagtgatgattggtgacaaatctctcacaattaa

SEQ ID NO: 11873 - DNA, 201 bp, Homo sapiens
ccacgcgccgtcctccgaggaactgggcgcttgcagtgcgttgcacaccctcacctcccacccactgattattaataaagtcttttcttttacctgccaaygcttagtttctttgcccaaagggagtttcggctggacaggtgctagcgtggggagctgctgtagggtcccagagacagttagttatttgacctaacaacg

SEQ ID NO: 11874 - DNA, 111 bp, Homo sapiens
ctttcgtttaagaagctataacttaaaccatcttcagaaacaagatctgtcacccgtagagcttagagtccaaatagacacctatgaggcgagcacaaggrgcggtgtgag

SEQ ID NO: 11875 - DNA, 201 bp, Homo sapiens
tgggtgggctgggggccctgactggacctggcctggccagcttactggggagcagtgggcctccagggagcagctcctcctccagctcccggagccagtckgcagcggtcaccccgtcatccaccacctcttccacccgtgccaccccagccccttctgctccagcagctgcctcagcaactagcccgagccccgcgccca

SEQ ID NO: 11876 - DNA, 201 bp, Homo sapiens
gaggctgtggaggccgccaacaagggcgatgtggaagcgtttgccaaagccatgcagaacaacgccaagcccgagcagaaagagggcgacacgaaggacamgaaggacgaagaggaggacatgagcctggactgagccacgcgccgtcctccgaggaactgggcgcttgcagtgcgttgcacaccctcacctcccacccac

SEQ ID NO: 11877 - DNA, 201 bp, Homo sapiens
gccacgaactctctgcgctaggcggtgagggtggcctgcagagcctgctgggaaacatgagccacagccagctcatgcagctcatcggaccagccggcctyggaggactgggtgggctgggggccctgactggacctggcctggccagcttactggggagcagtgggcctccagggagcagctcctcctccagctcccgga

SEQ ID NO: 11878 - DNA, 201 bp, Homo sapiens
agaacaacgccaagcccgagcagaaagagggcgacacgaaggacaagaaggacgaagaggaggacatgagcctggactgagccacgcgccgtcctccgagsaactgggcgcttgcagtgcgttgcacaccctcacctcccacccactgattattaataaagtcttttcttttacctgccaacgcttagtttctttgcccaa

SEQ ID NO: 11879 - DNA, 201 bp, Homo sapiens
agcggcttttcttctggatgcaggaacccaagacagaccaggatgaggagcattgccggaaagtcaacgagtatctgaacaaccccccgatgcctggggcrctgggggccagcggaagcagcggccacgaactctctgcgctaggcggtgagggtggcctgcagagcctgctgggaaacatgagccacagccagctcatgc

SEQ ID NO: 11880 - DNA, 201 bp, Homo sapiens
ccacccgtgccaccccagccccttctgctccagcagctgcctcagcaactagcccgagccccgcgcccagttccgggaatggagccagcacagcagccagmccgacccagcccatccagctgagcgacctccagagcatcctggccacgatgaacgtaccagccgggccagcaggcggccagcaagtggacctggccagtg

SEQ ID NO: 11881 - DNA, 201 bp, Homo sapiens
agctgctgtagggtcccagagacagttagttatttgacctaacaacggaaaacggtcaccccaggaagagtttggtgcctctgtccaggccggttccagayctgtcttgagactctctccgtatttaagtcaacattcattcggttacacagaagttactttttaatttttaaggaggaaccagtgatgattggtgacaaa

SEQ ID NO: 11882 - DNA, 201 bp, Homo sapiens; identical to SEQ ID NO: 11872

SEQ ID NO: 11883 - DNA, 201 bp, Homo sapiens; identical to SEQ ID NO: 11873

SEQ ID NO: 11884 - DNA, 111 bp, Homo sapiens; identical to SEQ ID NO: 11874

SEQ ID NO: 11885 - DNA, 201 bp, Homo sapiens; identical to SEQ ID NO: 11875

SEQ ID NO: 11886 - DNA, 201 bp, Homo sapiens; identical to SEQ ID NO: 11876

SEQ ID NO: 11887 - DNA, 201 bp, Homo sapiens; identical to SEQ ID NO: 11877

SEQ ID NO: 11888 - DNA, 201 bp, Homo sapiens; identical to SEQ ID NO: 11878

SEQ ID NO: 11889 - DNA, 201 bp, Homo sapiens; identical to SEQ ID NO: 11879

SEQ ID NO: 11890 - DNA, 201 bp, Homo sapiens; identical to SEQ ID NO: 11880

SEQ ID NO: 11891 - DNA, 201 bp, Homo sapiens; identical to SEQ ID NO: 11881

SEQ ID NO: 11892 - DNA, 201 bp, Homo sapiens
gggccccacctgcagcgagcctgcgagggaccactacctcccggacctgcaccacctgcgcctggagctggaggaggctgccacacctgagggtcacgccrtgcgctttggcttcaaccccctcgagttcgagaacttcagctggaggggctacgcgcagatggcacctgtccagcccaggatcgtggccaggctgaacct

SEQ ID NO: 11893 - DNA, 201 bp, Homo sapiens
ggagcgcctcgccgccagcctggacggggctcggaccccactgctgcagaggatgcagaccttctccccggcgggcagcaagctgcgtctagtggaggccrccgaggcccacgcacagcagctgggccagctggcactcaatctgtccagcatcatcctggacgtcaaccaggaccgcctcacccagagggccatcgaggc

SEQ ID NO: 11894 - DNA, 201 bp, Homo sapiens
tgccgtggctgcctgcgccacaccactgggccccgctgcgagatctgtgcccccggcttctacggcaacgccctgctgcccggcaactgcacccgtaggcrtcgggctgggagggatgcaccctggggagggttgcgcggggaggagggaggcctgctgggcgtaccccggtgcgactgtaccccatgtgggacagaggcc

SEQ ID NO: 11895 - DNA, 201 bp, Homo sapiens
cggagctcgtcctacacccgccaggagttcgtggatatggagggatgggtgctgctgagcactgaccggcaggtggtgccccacgagcggcagccagggayggagatgctccgtgcagacctgcggcacgtgcctgaggctgtgcccgaggctttccccgagctgtactggcaggccccaccctcctacctgggggaccgg

SEQ ID NO: 11896 - DNA, 201 bp, Homo sapiens
gggagcggtgtgacgtgtgtgccgagggcttcacgggcttcccaagctgctacccgacgccctcgtcctccaatgacaccagggagcaggtgctgccagcyggccagattgtgaattgtgactgcagcgcggcagggacccagggcaacgcctgccggaaggacccaagggtgggacgctgtctgtgcaaacccaacttcc

SEQ ID NO: 11897 - DNA, 201 bp, Homo sapiens
cagtgttccagccctggagtggccgatgaccgctgtgaccctgacacaggccagtgcaggtgccgagtgggcttcgagggggccacatgtgatcgctgtgyccccggctactttcacttccctctctgccagttgtgtggctgcagccctgcaggaaccttgcccgagggctgcgatgaggccggccgctgcctatgccag

SEQ ID NO: 11898 - DNA, 201 bp, Homo sapiens
gccgctgccgccccggctacacaggcactgcctgccaggaatgcagccccggctttcacggcttccccagctgtgtcccctgccactgctctgctgaaggstccctgcacgcagcctgtgacccccggagtgggcagtgcagctgccggccccgtgtgacggggctgcggtgtgacacgtgtgtgcccggtgcctacaact

SEQ ID NO: 11899 - DNA, 201 bp, Homo sapiens
ctggttatgcaggtgcctcctgcgagcggtgtgcgcccggattctttgggaacccactggtgctgggcagctcctgccagccatgcgactgcagcggcaayggtgaccccaacttgctcttcagcgactgcgaccccctgacgggcgcctgccgtggctgcctgcgccacaccactgggccccgctgcgagatctgtgccc

SEQ ID NO: 11900 - DNA, 201 bp, Homo sapiens
tgcacccgctgcttctgctttggggccacggagcgctgccggagctcgtcctacacccgccaggagttcgtggatatggagggatgggtgctgctgagcaytgaccggcaggtggtgccccacgagcggcagccagggacggagatgctccgtgcagacctgcggcacgtgcctgaggctgtgcccgaggctttccccgag

SEQ ID NO: 11901 - DNA, 201 bp, Homo sapiens
cctgccactgctctgctgaaggctccctgcacgcagcctgtgacccccggagtgggcagtgcagctgccggccccgtgtgacggggctgcggtgtgacacrtgtgtgcccggtgcctacaacttcccctactgcgaaggtgactcctgtgagtcacaggcacaggttccctgtatgtgccgggctcacgtggaggggccga

SEQ ID NO: 11902 - DNA, 201 bp, Homo sapiens
gcctgtacagcaccctgtgccggggcactgcccgggatacccaggaccacctggctgtcttccacctggactcggaggccagcgtgaggctcacagccgarcaggcacgcttcttcctgcacggggtcactctggtgcccattgaggagttcagcccggagttcgtggagccccgggtcagctgcatcagcagccacggcg

SEQ ID NO: 11903 - DNA, 201 bp, Homo sapiens
caggtactgagcgtcctggccttccctccccaacccgggccagtgcaggccttcaccttccgcctcccacagagccagctccggagccccctgggcccccrccatgagacggcacagcagctggaggccgtggggacccgagaccaggcgagccaattgctggccggcaccgaggccacactgggccatgcgaagacgctg

SEQ ID NO: 11904 - DNA, 201 bp, Homo sapiens
cccaacccgggccagtgcaggccttcaccttccgcctcccacagagccagctccggagccccctgggcccccaccatgagacggcacagcagctggaggcygtggggacccgagaccaggcgagccaattgctggccggcaccgaggccacactgggccatgcgaagacgctgttggcggccatccgggctgtggaccgca

SEQ ID NO: 11905 - DNA, 201 bp, Homo sapiens
caattgctggccggcaccgaggccacactgggccatgcgaagacgctgttggcggccatccgggctgtggaccgcaccctgagcgagctcatgtcccagaygggccacctggggctggccaatgcctcggctccatcaggtgagcagctgctccggacactggccgaggtggagcggctgctctgggagatgcgggcccgg

SEQ ID NO: 11906 - DNA, 201 bp, Homo sapiens
acagtcagatcagcaccaccaagcgcttcgagcaggagctgcggctcgtgtcctacagcggggtgctcttcttcctgaagcagcagagccagttcctgtgyttggccgtgcaagaaggcagcctcgtgctgttgtatgactttggggctggcctgaaaaaggccgtcccactgcagcccccaccgcccctgacctcggcca

SEQ ID NO: 11907 - DNA, 201 bp, Homo sapiens
ggacaatgatctggagctggccgacgcctactacctggggggcgtgccgcccgaccagctgcccccgagcctgcgacggctcttccccaccggaggctcastccgtggctgcgtcaaaggcatcaaggccctgggcaagtatgtggacctcaagcggctgaacacgacaggcgtgagcgccggctgcaccgccgacctgct

SEQ ID NO: 11908 - DNA, 201 bp, Homo sapiens
ccctgccactgctctgctgaaggctccctgcacgcagcctgtgacccccggagtgggcagtgcagctgccggccccgtgtgacggggctgcggtgtgacaygtgtgtgcccggtgcctacaacttcccctactgcgaaggtgactcctgtgagtcacaggcacaggttccctgtatgtgccgggctcacgtggaggggccg

SEQ ID NO: 11909 - DNA, 201 bp, Homo sapiens
ccgccgacctgctggtggggcgcgccatgactttccatggccacggcttccttcgcctggcgctctcgaacgtggcaccgctcactggcaacgtctactcyggcttcggcttccacagcgcccaggacagtgccctgctctactaccgggcgtccccggatgggctatgccaggtgtccctgcagcagggccgtgtgagcc

SEQ ID NO: 11910 - DNA, 201 bp, Homo sapiens
accccgagggctgtacccgtgagtgtgccctggagtattggggctgcagctgcgacctcaggggcacactgggtggagttgctgagtgccagccgggcacyggccagtgcttctgcaagccccacgtgtgcggccaggcctgcgcgtcctgcaaggatggcttctttggactggatcaggctgactattttggctgccgca

SEQ ID NO: 11911 - DNA, 201 bp, Homo sapiens
gacctcaggggcacactgggtggagttgctgagtgccagccgggcaccggccagtgcttctgcaagccccacgtgtgcggccaggcctgcgcgtcctgcamggatggcttctttggactggatcaggctgactattttggctgccgcagctgccggtgtgacattggcggtgcactgggccagagctgtgaaccgaggacg

SEQ ID NO: 11912 - DNA, 201 bp, Homo sapiens
tttgtcaccaatcatcactggttcctccttaaaaattaaaaagtaacttctgtgtaaccgaatgaatgttgacttaaatacggagagagtctcaagacagrtctggaaccggcctggacagaggcaccaaactcttcctggggtgaccgttttccgttgttaggtcaaataactaactgtctctgggaccctacagcagct

SEQ ID NO: 11913 - DNA, 201 bp, Homo sapiens
gtaccccggtgcgactgtaccccatgtgggacagaggcctgcgacccccacagcgggcactgcctgtgcaaggcgggcgtgactgggcggcgctgtgaccrctgccaggagggacattttggtttcgatggctgcgggggctgccgcccgtgtgcttgtggaccggccgccgagggctccgagtgccacccccagagcgga

SEQ ID NO: 11914 - DNA, 201 bp, Homo sapiens
gtacagcaccctgtgccggggcactgcccgggatacccaggaccacctggctgtcttccacctggactcggaggccagcgtgaggctcacagccgagcagkcacgcttcttcctgcacggggtcactctggtgcccattgaggagttcagcccggagttcgtggagccccgggtcagctgcatcagcagccacggcgcctt

SEQ ID NO: 11915 - DNA, 201 bp, Homo sapiens
ccatccggggccagtactgtgacatctgcacggctgccaacagcaacaaggcacaccccgcgagcaatgccatcgatggcacggagcgctggtggcagagyccaccgctgtcccgcggcctggagtacaacgaggtcaacgtcaccctggacctgggccaggtcttccacgtggcctacgtcctcatcaagtttgccaact

SEQ ID NO: 11916 - DNA, 201 bp, Homo sapiens
ggccacggtgtacagcgtggagcaggacaatgatctggagctggccgacgcctactacctggggggcgtgccgcccgaccagctgcccccgagcctgcgayggctcttccccaccggaggctcagtccgtggctgcgtcaaaggcatcaaggccctgggcaagtatgtggacctcaagcggctgaacacgacaggcgtgag

SEQ ID NO: 11917 - DNA, 201 bp, Homo sapiens
ccggaggctcagtccgtggctgcgtcaaaggcatcaaggccctgggcaagtatgtggacctcaagcggctgaacacgacaggcgtgagcgccggctgcacygccgacctgctggtggggcgcgccatgactttccatggccacggcttccttcgcctggcgctctcgaacgtggcaccgctcactggcaacgtctactccg

SEQ ID NO: 11918 - DNA, 201 bp, Homo sapiens
cgggcctggggcctagaggactgcaggccaccgcccggaaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggcccagtctctcca

SEQ ID NO: 11919 - DNA, 201 bp, Homo sapiens
cagcagaacctgggcagcgtcaatgtgagcacgggctgtgcacccgccctgcaagcccagaccccgggcctggggcctagaggactgcaggccaccgcccrgaaggcctcccgccgcagccgtcagcccgcccggcatcctgcctgcatgctgcccccacacctcaggaccacccgagactcctaccagtttgggggttcc

SEQ ID NO: 11920 - DNA, 201 bp, Homo sapiens
gggcccgtctgcacaggctgaacgcctccatcgctgacctgcaggtactgagcgtcctggccttccctccccaacccgggccagtgcaggccttcaccttycgcctcccacagagccagctccggagccccctgggcccccaccatgagacggcacagcagctggaggccgtggggacccgagaccaggcgagccaattgc

SEQ ID NO: 11921 - DNA, 201 bp, Homo sapiens
gccgcacctaccagccctggcagttctttgcctcctccaagagggactgtctggagcggttcgggccacagacgctggagcgcatcacacgggacgacgcrgccatctgcaccaccgagtactcacgcatcggccacactggcgtcaccgcatactgcccacagatcgtggtgtccctggtgaacggacgtccgggcgcca

SEQ ID NO: 11922 - DNA, 201 bp, Homo sapiens
cacggagcgctgccggagctcgtcctacacccgccaggagttcgtggatatggagggatgggtgctgctgagcactgaccggcaggtggtgccccacgagyggcagccagggacggagatgctccgtgcagacctgcggcacgtgcctgaggctgtgcccgaggctttccccgagctgtactggcaggccccaccctccta

SEQ ID NO: 11923 - DNA, 201 bp, Homo sapiens
ccatggacactcagaccgctgcctccctggctctggcgtctgtgtggactgccagcacaacaccgaaggggcccactgtgagcgctgccaggctggcttcrtgagcagcagggacgaccccagcaccccctgtgtcagctgcccctgccccctctcagtgccttccaacaacttcgccgagggctgtgtcctgcgaggcgg

SEQ ID NO: 11924 - DNA, 201 bp, Homo sapiens
aatgccaccctgcaggccactctgcatgcggctagggacaccctggccagcgtcttcagattgctgcacagcctggaccaggctaaggaggagctggagcrcctcgccgccagcctggacggggctcggaccccactgctgcagaggatgcagaccttctccccggcgggcagcaagctgcgtctagtggaggccgccgag

SEQ ID NO: 11925 - DNA, 201 bp, Homo sapiens
ctctgcatgcggctagggacaccctggccagcgtcttcagattgctgcacagcctggaccaggctaaggaggagctggagcgcctcgccgccagcctggayggggctcggaccccactgctgcagaggatgcagaccttctccccggcgggcagcaagctgcgtctagtggaggccgccgaggcccacgcacagcagctgg

SEQ ID NO: 11926 - DNA, 201 bp, Homo sapiens
gtggaggtccacggggcagtgggggccagtggctgcccagccgcctaggacacagccaaccccggcccctggtcaggcccctgcagctgcctcacaccgcyccttgtgctcgcctcataggtgtctatttggactctaagctctacgggtgacagatcttgtttctgaagatggtttaagttatagcttcttaaacgaaag

SEQ ID NO: 11927 - DNA, 201 bp, Homo sapiens
ttcccaaagccgccccagcccatcatcctcagggactgccaggtgatcccgctgccgcccggcctcccgctgacccacgcgcaggatctcactccagccaygtccccagctggaccccgacctcggccccccaccgctgtggaccctgatgcagagcccaccctgctgcgtgagccccaggccaccgtggtcttcaccacc

SEQ ID NO: 11928 - DNA, 201 bp, Homo sapiens
gtgggacagaggcctgcgacccccacagcgggcactgcctgtgcaaggcgggcgtgactgggcggcgctgtgaccgctgccaggagggacattttggtttygatggctgcgggggctgccgcccgtgtgcttgtggaccggccgccgagggctccgagtgccacccccagagcggacagtgccactgccgaccagggacca

SEQ ID NO: 11929 - DNA, 201 bp, Homo sapiens
ctgtccacatggctacggctgccgcaccctggtggtgtgtgagggccaggccctgctggacgtgacccacagcgagctcactgtgaccgtgcgtgtgcccragggccggtggctctggctggattatgtactcgtggtccctgagaacgtctacagctttggctacctccgggaggagcccctggataaatcctatgactt

SEQ ID NO: 11930 - DNA, 201 bp, Homo sapiens
gcccgccacgcaccatcccgcccgactgcctactgtgccagccccagacctttggctgccaccccctggtcggctgtgaggagtgtaactgctcagggccyggcatccaggagctcacagaccctacctgtgacacagacagcggccagtgcaagtgcagacccaacgtgactgggcgccgctgtgatacctgctctccgg

SEQ ID NO: 11931 - DNA, 201 bp, Homo sapiens
ttaattgtgagagatttgtcaccaatcatcactggttcctccttaaaaattaaaaagtaacttctgtgtaaccgaatgaatgttgacttaaatacggagadagtctcaagacaggtctggaaccggcctggacagaggcaccaaactcttcctggggtgaccgttttccgttgttaggtcaaataactaactgtctctggg

SEQ ID NO: 11932 - DNA, 201 bp, Homo sapiens
cactggatgctgccaaccccaaaggttgcacccgctgcttctgctttggggccacggagcgctgccggagctcgtcctacacccgccaggagttcgtggayatggagggatgggtgctgctgagcactgaccggcaggtggtgccccacgagcggcagccagggacggagatgctccgtgcagacctgcggcacgtgcctg

SEQ ID NO: 11933 - DNA, 201 bp, Homo sapiens
agacccaacgtgactgggcgccgctgtgatacctgctctccgggcttccatggctacccccgctgccgcccctgtgactgtcacgaggcgggcactgcgcytggcgtgtgtgaccccctcacagggcagtgctactgtaaggagaacgtgcagggccccaaatgtgaccagtgcagccttgggaccttctcactggatgct

SEQ ID NO: 11934 - DNA, 201 bp, Homo sapiens
gagtgtaactgctcagggcccggcatccaggagctcacagaccctacctgtgacacagacagcggccagtgcaagtgcagacccaacgtgactgggcgccrctgtgatacctgctctccgggcttccatggctacccccgctgccgcccctgtgactgtcacgaggcgggcactgcgcctggcgtgtgtgaccccctcaca

SEQ ID NO: 11935 - DNA, 201 bp, Homo sapiens
accggcaggtggtgccccacgagcggcagccagggacggagatgctccgtgcagacctgcggcacgtgcctgaggctgtgcccgaggctttccccgagctrtactggcaggccccaccctcctacctgggggaccgggtgtcatcctacggtgggaccctccgttatgaactgcactcagagacccagcggggagatgtct

SEQ ID NO: 11936 - DNA, 201 bp, Homo sapiens
agggatgcaccctggggagggttgcgcggggaggagggaggcctgctgggcgtaccccggtgcgactgtaccccatgtgggacagaggcctgcgacccccrcagcgggcactgcctgtgcaaggcgggcgtgactgggcggcgctgtgaccgctgccaggagggacattttggtttcgatggctgcgggggctgccgcccg

SEQ ID NO: 11937 - DNA, 201 bp, Homo sapiens
tcatcaagtttgccaactcaccccggccggacctctgggtgctggagcggtccatggacttcggccgcacctaccagccctggcagttctttgcctcctcyaagagggactgtctggagcggttcgggccacagacgctggagcgcatcacacgggacgacgcggccatctgcaccaccgagtactcacgcatcggccaca

SEQ ID NO: 11938 - DNA, 201 bp, Homo sapiens
tgcagacccaacgtgactgggcgccgctgtgatacctgctctccgggcttccatggctacccccgctgccgcccctgtgactgtcacgaggcgggcactgygcctggcgtgtgtgaccccctcacagggcagtgctactgtaaggagaacgtgcagggccccaaatgtgaccagtgcagccttgggaccttctcactggat

SEQ ID NO: 11939 - DNA, 201 bp, Homo sapiens
aggcgggcgtgactgggcggcgctgtgaccgctgccaggagggacattttggtttcgatggctgcgggggctgccgcccgtgtgcttgtggaccggccgcygagggctccgagtgccacccccagagcggacagtgccactgccgaccagggaccatgggaccccagtgccgcgagtgtgcccctggctactgggggctcc

SEQ ID NO: 11940 - DNA, 201 bp, Homo sapiens
tgggacagaggcctgcgacccccacagcgggcactgcctgtgcaaggcgggcgtgactgggcggcgctgtgaccgctgccaggagggacattttggtttcratggctgcgggggctgccgcccgtgtgcttgtggaccggccgccgagggctccgagtgccacccccagagcggacagtgccactgccgaccagggaccat

SEQ ID NO: 11941 - DNA, 201 bp, Homo sapiens
ctgttactacgaccctgaggtggaccggcgccgcgccagccagagcctggatggcacctatcagggtgggggtgtctgtatcgactgccagcaccacaccrccggcgtcaactgtgagcgctgcctgcccggcttctaccgctctcccaaccaccctctcgactcgccccacgtctgccgccgctgcaactgcgagtccga

SEQ ID NO: 11942 - DNA, 201 bp, Homo sapiens
ccctgcagcagggccgtgtgagcctacagctcctgaggactgaagtgaaaactcaagcgggcttcgccgatggtgccccccattacgtcgccttctacagyaatgccacgggagtctggctgtatgtcgatgaccagctccagcagatgaagccccaccggggaccaccccccgagctccagccgcagcctgaggggcccc

SEQ ID NO: 11943 - DNA, 106 bp, Homo sapiens
cgttgttaggtcaaataactaactgtctctgggaccctacagcagctccccacgctagcacctgtccagccgaaactccctttgggcaaagaaactaagcrttggc

SEQ ID NO: 11944 - DNA, 201 bp, Homo sapiens
cctgcgcctggagctggaggaggctgccacacctgagggtcacgccgtgcgctttggcttcaaccccctcgagttcgagaacttcagctggaggggctacrcgcagatggcacctgtccagcccaggatcgtggccaggctgaacctgacctcccccgaccttttctggctcgtcttccgatacgtcaaccggggggccat

SEQ ID NO: 11945 - DNA, 201 bp, Homo sapiens
ggaagcctgcgactgccaacagtgccaacgagtgccagtcctgtaactgctacggccatgccaccgactgttactacgaccctgaggtggaccggcgccgygccagccagagcctggatggcacctatcagggtgggggtgtctgtatcgactgccagcaccacaccgccggcgtcaactgtgagcgctgcctgcccggct

SEQ ID NO: 11946 - DNA, 201 bp, Homo sapiens
ccgccggcgtcaactgtgagcgctgcctgcccggcttctaccgctctcccaaccaccctctcgactcgccccacgtctgccgccgctgcaactgcgagtcygacttcacggatggcacctgcgaggacctgacgggtcgatgctactgccggcccaacttctctggggagcggtgtgacgtgtgtgccgagggcttcacgg

SEQ ID NO: 11947 - DNA, 201 bp, Homo sapiens
agtgcctctgcaaacctggttatgcaggtgcctcctgcgagcggtgtgcgcccggattctttgggaacccactggtgctgggcagctcctgccagccatgygactgcagcggcaacggtgaccccaacttgctcttcagcgactgcgaccccctgacgggcgcctgccgtggctgcctgcgccacaccactgggccccgct

SEQ ID NO: 11948 - DNA, 201 bp, Homo sapiens
agatgtctttgtccccatggagagcaggccggatgtggtgctgcagggcaaccagatgagcatcacattcctggagccggcataccccacgcctggccacrttcaccgtgggcagctgcagctggtggaggggaacttccggcatacggagactcgcaacactgtgtcccgcgaggagctcatgatggtgctggccagcct

SEQ ID NO: 11949 - DNA, 201 bp, Homo sapiens
ggctgtgcccgaggctttccccgagctgtactggcaggccccaccctcctacctgggggaccgggtgtcatcctacggtgggaccctccgttatgaactgyactcagagacccagcggggagatgtctttgtccccatggagagcaggccggatgtggtgctgcagggcaaccagatgagcatcacattcctggagccggc

SEQ ID NO: 11950 - DNA, 201 bp, Homo sapiens
ggagttcgtggatatggagggatgggtgctgctgagcactgaccggcaggtggtgccccacgagcggcagccagggacggagatgctccgtgcagacctgyggcacgtgcctgaggctgtgcccgaggctttccccgagctgtactggcaggccccaccctcctacctgggggaccgggtgtcatcctacggtgggaccct

SEQ ID NO: 11951 - DNA, 201 bp, Homo sapiens
gcttccccaactgcaggccctgtgactgcggtgcccgcctctgtgacgagctcacgggccagtgcatctgcccgccacgcaccatcccgcccgactgcctrctgtgccagccccagacctttggctgccaccccctggtcggctgtgaggagtgtaactgctcagggcccggcatccaggagctcacagaccctacctgtg

SEQ ID NO: 11952 - DNA, 201 bp, Homo sapiens
agatgagcatcacattcctggagccggcataccccacgcctggccacgttcaccgtgggcagctgcagctggtggaggggaacttccggcatacggagackcgcaacactgtgtcccgcgaggagctcatgatggtgctggccagcctggagcagctgcagatccgtgccctcttctcacagatctcctcggctgtctccc

SEQ ID NO: 11953 - DNA, 201 bp, Homo sapiens
actcgcaacactgtgtcccgcgaggagctcatgatggtgctggccagcctggagcagctgcagatccgtgccctcttctcacagatctcctcggctgtctycctgcgcagggtggcactggaggtggccagcccagcaggccagggggccctggccagcaatgtggagctgtgcctgtgccccgccagctaccggggggac

SEQ ID NO: 11954 - DNA, 201 bp, Homo sapiens
cgccctgctgcccggcaactgcacccgtaggcgtcgggctgggagggatgcaccctggggagggttgcgcggggaggagggaggcctgctgggcgtacccrggtgcgactgtaccccatgtgggacagaggcctgcgacccccacagcgggcactgcctgtgcaaggcgggcgtgactgggcggcgctgtgaccgctgcca

SEQ ID NO: 11955 - DNA, 201 bp, Homo sapiens
ttcacttccctctctgccagttgtgtggctgcagccctgcaggaaccttgcccgagggctgcgatgaggccggccgctgcctatgccagcctgagtttgcyggacctcattgtgaccggtgccgccctggctaccatggtttccccaactgccaagcatgcacctgcgaccctcggggagccctggaccagctctgtgggg

SEQ ID NO: 11956 - DNA, 201 bp, Homo sapiens
tgccttccaacaacttcgccgagggctgtgtcctgcgaggcggccgcacccagtgcctctgcaaacctggttatgcaggtgcctcctgcgagcggtgtgcrcccggattctttgggaacccactggtgctgggcagctcctgccagccatgcgactgcagcggcaacggtgaccccaacttgctcttcagcgactgcgacc

SEQ ID NO: 11957 - DNA, 201 bp, Homo sapiens
gcaaacctggttatgcaggtgcctcctgcgagcggtgtgcgcccggattctttgggaacccactggtgctgggcagctcctgccagccatgcgactgcagyggcaacggtgaccccaacttgctcttcagcgactgcgaccccctgacgggcgcctgccgtggctgcctgcgccacaccactgggccccgctgcgagatct

SEQ ID NO: 11958 - DNA, 201 bp, Homo sapiens
cgcgcggctccccgcgccccaccgaggacctttactgcaagctggtagggggccccgtggccggcggcgaccccaaccagaccatccggggccagtactgygacatctgcacggctgccaacagcaacaaggcacaccccgcgagcaatgccatcgatggcacggagcgctggtggcagagtccaccgctgtcccgcggcc

SEQ ID NO: 11959 - DNA, 201 bp, Homo sapiens; identical to SEQ ID NO: 11924

SEQ ID NO: 11960 - DNA, 201 bp, Homo sapiens; identical to SEQ ID NO: 11925

SEQ ID NO: 11961 - DNA, 201 bp, Homo sapiens; identical to SEQ ID NO: 11926

SEQ ID NO: 11962 - DNA, 201 bp, Homo sapiens; identical to SEQ ID NO: 11892

SEQ ID NO: 11963 - DNA, 201 bp, Homo sapiens; identical to SEQ ID NO: 11893

SEQ ID NO: 11964 - DNA, 201 bp, Homo sapiens; identical to SEQ ID NO: 11895

SEQ ID NO: 11965 - DNA, 201 bp, Homo sapiens; identical to SEQ ID NO: 11896

SEQ ID NO: 11966 - DNA, 201 bp, Homo sapiens; identical to SEQ ID NO: 11897

SEQ ID NO: 11967 - DNA, 201 bp, Homo sapiens; identical to SEQ ID NO: 11927

SEQ ID NO: 11968 - DNA, 201 bp, Homo sapiens; identical to SEQ ID NO: 11898

SEQ ID NO: 11969 - DNA, 201 bp, Homo sapiens; identical to SEQ ID NO: 11899

SEQ ID NO: 11970 - DNA, 201 bp, Homo sapiens; identical to SEQ ID NO: 11928

SEQ ID NO: 11971 - DNA, 201 bp, Homo sapiens; identical to SEQ ID NO: 11900

SEQ ID NO: 11972 - DNA, 201 bp, Homo sapiens; identical to SEQ ID NO: 11929

SEQ ID NO: 11973 - DNA, 201 bp, Homo sapiens
cctgccactgctctgctgaaggctccctgcacgcagcctgtgacccccggagtgggcagtgcagctgccggccccgtgtgacggggctgcggtgtgacacrtgtgtgcccggtgcctacaacttcccctactgcgaagctggctcttgccaccctgccggtctggccccagtggatcctgcccttcctgaggcacaggttc

SEQ ID NO: 11974 - DNA, 201 bp, Homo sapiens; identical to SEQ ID NO: 11930

SEQ ID NO: 11975 - DNA, 201 bp, Homo sapiens; identical to SEQ ID NO: 11902

SEQ ID NO: 11976 - DNA, 201 bp, Homo sapiens; identical to SEQ ID NO: 11931

SEQ ID NO: 11977 - DNA, 201 bp, Homo sapiens; identical to SEQ ID NO: 11932

SEQ ID NO: 11978 - DNA, 201 bp, Homo sapiens
gccccctgggcccccaccatgagacggcacagcagctggaggtgctggagcagcagagcacaagcctcgggcaggacgcacggcggctaggcggccaggcygtggggacccgagaccaggcgagccaattgctggccggcaccgaggccacactgggccatgcgaagacgctgttggcggccatccgggctgtggaccgca

SEQ ID NO: 11979 - DNA, 201 bp, Homo sapiens
cgtggcatcaatgccagctccatggcctgggcccgtctgcacaggctgaacgcctccatcgctgacctgcagagccagctccggagccccctgggcccccrccatgagacggcacagcagctggaggtgctggagcagcagagcacaagcctcgggcaggacgcacggcggctaggcggccaggccgtggggacccgagac

SEQ ID NO: 11980 - DNA, 201 bp, Homo sapiens; identical to SEQ ID NO: 11933

SEQ ID NO: 11981 - DNA, 201 bp, Homo sapiens; identical to SEQ ID NO: 11934

SEQ ID NO: 11982 - DNA, 201 bp, Homo sapiens; identical to SEQ ID NO: 11905

SEQ ID NO: 11983 - DNA, 201 bp, Homo sapiens; identical to SEQ ID NO: 11935

SEQ ID NO: 11984 - DNA, 201 bp, Homo sapiens
tgcgagatctgtgcccccggcttctacggcaacgccctgctgcccggcaactgcacccggtgcgactgtaccccatgtgggacagaggcctgcgacccccrcagcgggcactgcctgtgcaaggcgggcgtgactgggcggcgctgtgaccgctgccaggagggacattttggtttcgatggctgcgggggctgccgcccg

SEQ ID NO: 11985 - DNA, 201 bp, Homo sapiens; identical to SEQ ID NO: 11906

SEQ ID NO: 11986 - DNA, 201 bp, Homo sapiens; identical to SEQ ID NO: 11907

SEQ ID NO: 11987 - DNA, 201 bp, Homo sapiens
tcatcaagtttgccaactcaccccggccggacctctgggtgctggagcggtccatggacttcggccgcacctaccagccctggcagttctttgcctcctcyaagagggactgtctggagcggttcgggccacagacgctggagcgcatcacacgggacgacgcggccatctgcaccaccgagtactcacgcatcgtgcccc

SEQ ID NO: 11988 - DNA, 201 bp, Homo sapiens; identical to SEQ ID NO: 11938

SEQ ID NO: 11989 - DNA, 201 bp, Homo sapiens; identical to SEQ ID NO: 11939

SEQ ID NO: 11990 - DNA, 201 bp, Homo sapiens; identical to SEQ ID NO: 11940

SEQ ID NO: 11991 - DNA, 201 bp, Homo sapiens; identical to SEQ ID NO: 11941

SEQ ID NO: 11992 - DNA, 201 bp, Homo sapiens; identical to SEQ ID NO: 11942

SEQ ID NO: 11993 - DNA, 106 bp, Homo sapiens; identical to SEQ ID NO: 11943

SEQ ID NO: 11994 - DNA, 201 bp, Homo sapiens; identical to SEQ ID NO: 11944

SEQ ID NO: 11995 - DNA, 201 bp, Homo sapiens; identical to SEQ ID NO: 11945

SEQ ID NO: 11996 - DNA, 201 bp, Homo sapiens
ccctgccactgctctgctgaaggctccctgcacgcagcctgtgacccccggagtgggcagtgcagctgccggccccgtgtgacggggctgcggtgtgacaygtgtgtgcccggtgcctacaacttcccctactgcgaagctggctcttgccaccctgccggtctggccccagtggatcctgcccttcctgaggcacaggtt

SEQ ID NO: 11997 - DNA, 201 bp, Homo sapiens; identical to SEQ ID NO: 11946

SEQ ID NO: 11998 - DNA, 201 bp, Homo sapiens; identical to SEQ ID NO: 11909

SEQ ID NO: 11999 - DNA, 201 bp, Homo sapiens
ggttctggggactgagccccagcaaccccgagggctgtacccgctgcagctgcgacctcaggggcacactgggtggagttgctgagtgccagccgggcacyggccagtgcttctgcaagccccacgtgtgcggccaggcctgcgcgtcctgcaaggatggcttctttggactggatcaggctgactattttggctgccgca

SEQ ID NO: 12000 - DNA, 201 bp, Homo sapiens; identical to SEQ ID NO: 11911

SEQ ID NO: 12001 - DNA, 201 bp, Homo sapiens; identical to SEQ ID NO: 11947

SEQ ID NO: 12002 - DNA, 201 bp, Homo sapiens
tgcacccggtgcgactgtaccccatgtgggacagaggcctgcgacccccacagcgggcactgcctgtgcaaggcgggcgtgactgggcggcgctgtgaccrctgccaggagggacattttggtttcgatggctgcgggggctgccgcccgtgtgcttgtggaccggccgccgagggctccgagtgccacccccagagcgga

SEQ ID NO: 12003 - DNA, 201 bp, Homo sapiens; identical to SEQ ID NO: 11912

SEQ ID NO: 12004 - DNA, 201 bp, Homo sapiens; identical to SEQ ID NO: 11948

SEQ ID NO: 12005 - DNA, 201 bp, Homo sapiens; identical to SEQ ID NO: 11949

SEQ ID NO: 12006 - DNA, 201 bp, Homo sapiens; identical to SEQ ID NO: 11950

SEQ ID NO: 12007 - DNA, 201 bp, Homo sapiens; identical to SEQ ID NO: 11914

SEQ ID NO: 12008 - DNA, 201 bp, Homo sapiens; identical to SEQ ID NO: 11951

SEQ ID NO: 12009 - DNA, 201 bp, Homo sapiens; identical to SEQ ID NO: 11952

SEQ ID NO: 12010 - DNA, 201 bp, Homo sapiens; identical to SEQ ID NO: 11915

SEQ ID NO: 12011 - DNA, 201 bp, Homo sapiens; identical to SEQ ID NO: 11953

SEQ ID NO: 12012 - DNA, 201 bp, Homo sapiens; identical to SEQ ID NO: 11916

SEQ ID NO: 12013 - DNA, 201 bp, Homo sapiens; identical to SEQ ID NO: 11917

SEQ ID NO: 12014 - DNA, 201 bp, Homo sapiens; identical to SEQ ID NO: 11955

SEQ ID NO: 12015 - DNA, 201 bp, Homo sapiens; identical to SEQ ID NO: 11956

SEQ ID NO: 12016 - DNA, 201 bp, Homo sapiens; identical to SEQ ID NO: 11957

SEQ ID NO: 12017 - DNA, 201 bp, Homo sapiens
tgcaagcccagaccccgggcctggggcctagaggactgcaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggcccagtctctcca

SEQ ID NO: 12018 - DNA, 201 bp, Homo sapiens; identical to SEQ ID NO: 11958

SEQ ID NO: 12019 - DNA, 201 bp, Homo sapiens; identical to SEQ ID NO: 11922

SEQ ID NO: 12020 - DNA, 201 bp, Homo sapiens
gccgcacctaccagccctggcagttctttgcctcctccaagagggactgtctggagcggttcgggccacagacgctggagcgcatcacacgggacgacgcrgccatctgcaccaccgagtactcacgcatcgtgcccctggagaacggagagatcgtggtgtccctggtgaacggacgtccgggcgccatgaatttctcct

SEQ ID NO: 12021 - DNA, 201 bp, Homo sapiens; identical to SEQ ID NO: 11923

SEQ ID NO: 12022 - DNA, 201 bp, Homo sapiens
tcaagcaggcagcaggctcaggccacctccttgctcttgggacaccagagaacccatcttggctcagtctccacctccaagatcaaaaggtggtgttgtcytctgggtcggggccagggctggatctgcccctggtcttgggactccctcttcagctgaagctgagtatgtccagggtggtcttgagccaagggtcgaaga

SEQ ID NO: 12023 - DNA, 201 bp, Homo sapiens
cgcctgagacaggtctctgggcccctgaccagcaaacgccatcccatcatgaggattgcgcttggggggctgctcttccccgcttccaaccttcggttgcygctggttcctgccctggatggctgcctgcgccgggattcctggctggacaaacaggccgagatctcagcatctgcccccactagcctcagaagctgtgat

SEQ ID NO: 12024 - DNA, 201 bp, Homo sapiens
ggctcactcacccgcccagaccctggtatggagagcagaggcccactggctacctcgcgcctgctgctgttgctgctgttgctactactgcgtcacacccrccagggatgggccctgagacctgttctccccacccagagtgcccacgaccctccggctgtccacctcagcaatggcccaggacaagagcctatcgctgtc

SEQ ID NO: 12025 - DNA, 101 bp, Homo sapiens
gccctgaacagaagccatgagatctggactcacagctgcccccagagcccaggcaatggcactgacgcttcccattaaagctccacctaagaacccccttt

SEQ ID NO: 12026 - DNA, 201 bp, Homo sapiens
tccaagatcaaaaggtggtgttgtcttctgggtcggggccagggctggatctgcccctggtcttgggactccctcttcagctgaagctgagtatgtccagrgtggtcttgagccaagggtcgaagatgaaggcccttgccctgcctcccttaggcctggctcccctccttaacctctgggccaagcctcaagggcgtctct

SEQ ID NO: 12027 - DNA, 201 bp, Homo sapiens
gatgaaggcccttgccctgcctcccttaggcctggctcccctccttaacctctgggccaagcctcaagggcgtctcttcctgggggctttaccaggagaaractcttccacctctttttgcctgaatggcctttgggcacaaggtcagaggctggatgtggaccaggccctgaacagaagccatgagatctggactcacag

SEQ ID NO: 12028 - DNA, 201 bp, Homo sapiens; identical to SEQ ID NO: 12022

SEQ ID NO: 12029 - DNA, 201 bp, Homo sapiens; identical to SEQ ID NO: 12023

SEQ ID NO: 12030 - DNA, 101 bp, Homo sapiens; identical to SEQ ID NO: 12025

SEQ ID NO: 12031 - DNA, 201 bp, Homo sapiens; identical to SEQ ID NO: 12026

SEQ ID NO: 12032 - DNA, 201 bp, Homo sapiens; identical to SEQ ID NO: 12027

SEQ ID NO: 12033 - DNA, 201 bp, Homo sapiens; identical to SEQ ID NO: 12022

SEQ ID NO: 12034 - DNA, 201 bp, Homo sapiens; identical to SEQ ID NO: 12023

SEQ ID NO: 12035 - DNA, 175 bp, Homo sapiens
tatggagagcagaggcccactggctacctcgcgcctgctgctgttgctgctgttgctactactgcgtcacacccrccagggatgggccctgagacctgttctccccacccagagtgcccacgaccctccggctgtccacctcagcaatggcccaggacaagagcctatcgctgtc

SEQ ID NO: 12036 - DNA, 101 bp, Homo sapiens; identical to SEQ ID NO: 12025

SEQ ID NO: 12037 - DNA, 201 bp, Homo sapiens; identical to SEQ ID NO: 12026

SEQ ID NO: 12038 - DNA, 201 bp, Homo sapiens; identical to SEQ ID NO: 12027

SEQ ID NO: 12039 - DNA, 201 bp, Homo sapiens
ggtggaacagatgtgcccttttcagaggttgtgaagttagctccaaatcccagactagctgctaccccaagcccgggagcttctcaggtgagagaccatcrgaatttgtttgtagcatttgcattatgaaagcccgctagggttttttcccccaccaaaaggtcacctacattgaacgtgatgtgctcaactaaaggagaa

SEQ ID NO: 12040 - DNA, 201 bp, Homo sapiens
cttcagcacgcagcaggtaaaggttgttgctgttgatgcagagttgaatgtcttctatgaggaaagtgtgcattttgacagagatcttccagaatttgggyatgtacttgatgtgcatgtggcggtgttcatgtgcacaaggatgggctgacggtcacttctccagtactaatgtgggtccaggcactggatatcatcttg

SEQ ID NO: 12041 - DNA, 201 bp, Homo sapiens
ctctcagctgcctcacggggtcccgtgcctatgagcgttttacagggaaccaaattgcaaaaatttaccagcagaaccccgaggcctactcacatacagayagaatttctttggtcagtagctttgctgcttccctgttccttggctcttactcccctattgactacagtgatggttctggaatgaatttgttgcagatac

SEQ ID NO: 12042 - DNA, 201 bp, Homo sapiens
ggactgtttctccatcagcgactgcccggtgtggatggactccagcaccacagcccagtgccgccagctggaggctgctgtgggtggtgctcaggctctcmgctgcctcacggggtcccgtgcctatgagcgttttacagggaaccaaattgcaaaaatttaccagcagaaccccgaggcctactcacatacagagagaat

SEQ ID NO: 12043 - DNA, 201 bp, Homo sapiens
cggaagtatatactggaaggctggagcccagcaggcactgacaagcttatcaccagacctccggctacaccagcagcttcaggactgtttctccatcagcractgcccggtgtggatggactccagcaccacagcccagtgccgccagctggaggctgctgtgggtggtgctcaggctctcagctgcctcacggggtcccg

SEQ ID NO: 12044 - DNA, 201 bp, Homo sapiens
ttcatgtgcacaaggatgggctgacggtcacttctccagtactaatgtgggtccaggcactggatatcatcttggagaagatgaaggcttcgggcttcgamttctctcaagtcctagccttgtccggggcgggccagcaacacggaagtatatactggaaggctggagcccagcaggcactgacaagcttatcaccagacc

SEQ ID NO: 12045 - DNA, 201 bp, Homo sapiens
tgtccggggcgggccagcaacacggaagtatatactggaaggctggagcccagcaggcactgacaagcttatcaccagacctccggctacaccagcagctkcaggactgtttctccatcagcgactgcccggtgtggatggactccagcaccacagcccagtgccgccagctggaggctgctgtgggtggtgctcaggctc

SEQ ID NO: 12046 - DNA, 201 bp, Homo sapiens
gttgttgctgttgatgcagagttgaatgtcttctatgaggaaagtgtgcattttgacagagatcttccagaatttgggtatgtacttgatgtgcatgtggyggtgttcatgtgcacaaggatgggctgacggtcacttctccagtactaatgtgggtccaggcactggatatcatcttggagaagatgaaggcttcgggct

SEQ ID NO: 12047 - DNA, 201 bp, Homo sapiens
ctggtcccaggcttgccttggtgcctgtgcacctcatttagaggagaagcttagcccaccagtaccatcatgctcagttgtgggagccatttcttcctacwacgtccagcgctacggatttcctccaggatgcaaagtggtggccttcactggggacaacccagcgtcgctggcaggcatgagactggaggaaggtgacat

SEQ ID NO: 12048 - DNA, 201 bp, Homo sapiens
aagattttggccacaggaggagcatctcacaatagagaaatcttacaggtgcttgcagatgtgtttgatgccccggtgtatgttatagacactgccaactyggcctgtgtgggttctgcataccgagcttttcatggtcttgcaggtggaacagatgtgcccttttcagaggttgtgaagttagctccaaatcccagacta

SEQ ID NO: 12049 - DNA, 201 bp, Homo sapiens
aggctctcagctgcctcacggggtcccgtgcctatgagcgttttacagggaaccaaattgcaaaaatttaccagcagaaccccgaggcctactcacatacrgagagaatttctttggtcagtagctttgctgcttccctgttccttggctcttactcccctattgactacagtgatggttctggaatgaatttgttgcaga

SEQ ID NO: 12050 - DNA, 201 bp, Homo sapiens
agattttggccacaggaggagcatctcacaatagagaaatcttacaggtgcttgcagatgtgtttgatgccccggtgtatgttatagacactgccaactcsgcctgtgtgggttctgcataccgagcttttcatggtcttgcaggtggaacagatgtgcccttttcagaggttgtgaagttagctccaaatcccagactag

SEQ ID NO: 12051 - DNA, 201 bp, Homo sapiens
gcccttttcagaggttgtgaagttagctccaaatcccagactagctgctaccccaagcccgggagcttctcaggtgagagaccatcagaatttgtttgtarcatttgcattatgaaagcccgctagggttttttcccccaccaaaaggtcacctacattgaacgtgatgtgctcaactaaaggagaaattctgctttattg

SEQ ID NO: 12052 - DNA, 201 bp, Homo sapiens
tgccctggaaggccacatcttctgcaacccggttgactcccagcactacatggcactcctgtgctttaaaaatggctccctcatgagagagaagatccgcracgagtctgtatcccgttcctggagcgatttctctaaggcactgcagtccacagagatgggcaacggtggaaacctgggtttttattttgatgtaatgga

SEQ ID NO: 12053 - DNA, 201 bp, Homo sapiens
agatgtgtttgatgccccggtgtatgttatagacactgccaactcggcctgtgtgggttctgcataccgagcttttcatggtcttgcaggtggaacagatrtgcccttttcagaggttgtgaagttagctccaaatcccagactagctgctaccccaagcccgggagcttctcaggtgagagaccatcagaatttgtttgt

SEQ ID NO: 12054 - DNA, 201 bp, Homo sapiens
ctggagcccagcaggcactgacaagcttatcaccagacctccggctacaccagcagcttcaggactgtttctccatcagcgactgcccggtgtggatggamtccagcaccacagcccagtgccgccagctggaggctgctgtgggtggtgctcaggctctcagctgcctcacggggtcccgtgcctatgagcgttttacag

SEQ ID NO: 12055 - DNA, 201 bp, Homo sapiens
tccacttgctgaagaagttgtgtcatttctctggaagaatttccaaaattctggatttcttttttattttggagtatttcatcagctgaaaagtgattctyactttgagttttcttcctatatttgtatagtgagttcctttttccttcctctttatccctcctgttttactttatacctctctattccttgctcaaatta

SEQ ID NO: 12056 - DNA, 201 bp, Homo sapiens
gacttcagcacgcagcaggtaaaggttgttgctgttgatgcagagttgaatgtcttctatgaggaaagtgtgcattttgacagagatcttccagaatttgygactcagggcggtgttcatgtgcacaaggatgggctgacggtcacttctccagtactaatgtgggtccaggcactggatatcatcttggagaagatgaag

SEQ ID NO: 12057 - DNA, 201 bp, Homo sapiens
ctctatagaaagtcctctgtgatctgactcctgcagactcttccagatttttctgcccaaggcctttactgagctcaggactccagctaaatcaaaatackcatgttctcacccagagtgacaaaatcctgcagataggtttaagacctagtggatcagagcagtagctactgggaagttaaaaggaaggggcttagaaaa

SEQ ID NO: 12058 - DNA, 201 bp, Homo sapiens; identical to SEQ ID NO: 12041

SEQ ID NO: 12059 - DNA, 201 bp, Homo sapiens; identical to SEQ ID NO: 12042

SEQ ID NO: 12060 - DNA, 201 bp, Homo sapiens; identical to SEQ ID NO: 12043

SEQ ID NO: 12061 - DNA, 201 bp, Homo sapiens; identical to SEQ ID NO: 12044

SEQ ID NO: 12062 - DNA, 201 bp, Homo sapiens; identical to SEQ ID NO: 12045

SEQ ID NO: 12063 - DNA, 201 bp, Homo sapiens
cgcagcaggtaaaggttgttgctgttgatgcagagttgaatgtcttctatgaggaaagtgtgcattttgacagagatcttccagaatttgggactcagggyggtgttcatgtgcacaaggatgggctgacggtcacttctccagtactaatgtgggtccaggcactggatatcatcttggagaagatgaaggcttcgggct

SEQ ID NO: 12064 - DNA, 201 bp, Homo sapiens; identical to SEQ ID NO: 12047

SEQ ID NO: 12065 - DNA, 201 bp, Homo sapiens; identical to SEQ ID NO: 12048

SEQ ID NO: 12066 - DNA, 201 bp, Homo sapiens; identical to SEQ ID NO: 12049

SEQ ID NO: 12067 - DNA, 201 bp, Homo sapiens
gcccaaggcctttactgagctcaggactccagctaaatcaaaatactcatgttctcacccagagtgacaaaatcctgcagataggtttaagacctagtggmtcagagcagtagctactgggaagttaaaaggaaggggcttagaaaatgaatgggaccaaaggcatcacttctgatggagatgaagccatcttgaaagtga

SEQ ID NO: 12068 - DNA, 201 bp, Homo sapiens
gtgagtggtgtcctttggaggcatggtggatgaaaggcgcaaaggaagcaagaggttaaagataatggcccattagatacaacagcaagcccaagattccraagaagacagacaactccccctagtaccacctagacattactttttaaagacattttacattattgtccagcagaaaaaggctgtcttggaccatgaaac

SEQ ID NO: 12069 - DNA, 201 bp, Homo sapiens; identical to SEQ ID NO: 12050

SEQ ID NO: 12070 - DNA, 201 bp, Homo sapiens; identical to SEQ ID NO: 12052

SEQ ID NO: 12071 - DNA, 201 bp, Homo sapiens
agatgtgtttgatgccccggtgtatgttatagacactgccaactcggcctgtgtgggttctgcataccgagcttttcatggtcttgcaggtggaacagatrtgcccttttcagaggttgtgaagttagctccaaatcccagactagctgctaccccaagcccgggagcttctcaggtctacgaggcccttctcccccagta

SEQ ID NO: 12072 - DNA, 201 bp, Homo sapiens
aatctagggactcaaatcagcagaatgggggagacaaagcccggtctcaccccctaacctcatcctatctctttctccaaccctgactgcccactcctccrcaaaccgtgacccatagccgcccccaccccataccttgatctaccatccatcctcttccccaatccaaaccccacagtctcttctctcccacaccctgcc

SEQ ID NO: 12073 - DNA, 201 bp, Homo sapiens; identical to SEQ ID NO: 12054

SEQ ID NO: 12074 - DNA, 201 bp, Homo sapiens
cttcagcacgcagcaggtaaaggttgttgctgttgatgcagagttgaatgtcttctatgaggaaagtgtgcattttgacagagatcttccagaatttgggyatgtacttgatgtgcatgtgactcagggcggtgttcatgtgcacaaggatgggctgacggtcacttctccagtactaatgtgggtccaggcactggatat

SEQ ID NO: 12075 - DNA, 201 bp, Homo sapiens; identical to SEQ ID NO: 12039

SEQ ID NO: 12076 - DNA, 201 bp, Homo sapiens; identical to SEQ ID NO: 12041

SEQ ID NO: 12077 - DNA, 201 bp, Homo sapiens; identical to SEQ ID NO: 12042

SEQ ID NO: 12078 - DNA, 201 bp, Homo sapiens; identical to SEQ ID NO: 12043

SEQ ID NO: 12079 - DNA, 201 bp, Homo sapiens; identical to SEQ ID NO: 12044

SEQ ID NO: 12080 - DNA, 201 bp, Homo sapiens; identical to SEQ ID NO: 12045

SEQ ID NO: 12081 - DNA, 201 bp, Homo sapiens
ctgttgatgcagagttgaatgtcttctatgaggaaagtgtgcattttgacagagatcttccagaatttgggtatgtacttgatgtgcatgtgactcagggyggtgttcatgtgcacaaggatgggctgacggtcacttctccagtactaatgtgggtccaggcactggatatcatcttggagaagatgaaggcttcgggct

SEQ ID NO: 12082 - DNA, 201 bp, Homo sapiens; identical to SEQ ID NO: 12047

SEQ ID NO: 12083 - DNA, 201 bp, Homo sapiens; identical to SEQ ID NO: 12048

SEQ ID NO: 12084 - DNA, 201 bp, Homo sapiens; identical to SEQ ID NO: 12049

SEQ ID NO: 12085 - DNA, 201 bp, Homo sapiens; identical to SEQ ID NO: 12050

SEQ ID NO: 12086 - DNA, 201 bp, Homo sapiens; identical to SEQ ID NO: 12051

SEQ ID NO: 12087 - DNA, 201 bp, Homo sapiens; identical to SEQ ID NO: 12052

SEQ ID NO: 12088 - DNA, 201 bp, Homo sapiens; identical to SEQ ID NO: 12053

SEQ ID NO: 12089 - DNA, 201 bp, Homo sapiens; identical to SEQ ID NO: 12054

SEQ ID NO: 12090 - DNA, 201 bp, Homo sapiens
gggcccctttccaggacatctggtggacgtgagtggcaccgggaccctgtcccagagctaccactatgaggtgtgtgtgactggaggctccaggtcaaatragttcaaatttctgaaaccaattatccccaacttcctaccccagagcacaggtagtgaagtcgaagaaaatcccccatttcagaataatttgggtttctg

SEQ ID NO: 12091 - DNA, 201 bp, Homo sapiens
tgctcctggtggacggcttctcccagccctacctgcctctcccggaggcggccccggcccaggcccaggccgactcgctcactgtctacctggtggtggcrttggcctcagtgtcgtcgctcttcctcttctcggtgctcctgttcgtggcggtgcggctgtgcaggaggagcagggcggccccggtcggtcgctgctcgg

SEQ ID NO: 12092 - DNA, 201 bp, Homo sapiens
agcagggcggccccggtcggtcgctgctcggtgcctgagggcccctttccaggacatctggtggacgtgagtggcaccgggaccctgtcccagagctaccrctatgaggtgtgtgtgactggaggctccaggtcaaataagttcaaatttctgaaaccaattatccccaacttcctaccccagagcacaggtagtgaagtc

SEQ ID NO: 12093 - DNA, 201 bp, Homo sapiens
gagtttgagcaggctttttatgaggtgaagattctggagaatagcatccttggctccctggttgtgaccgtctcagcctgggatttagactctggaacaarcagtgaactatcctataccttttcccatgcctcagaagatattcgcaagacatttgaaattaatcaaaagtctggtgacattactttaacagcacctttg

SEQ ID NO: 12094 - DNA, 201 bp, Homo sapiens
ctacagtcagaattcaggtgatggatgtaaacgacaacgctcctgaaatcactgtgtcatcaattaccagtccaatcccagaaaacactccagagactgtrgttatggttttcaggatacgagacagagactctggggacaacggaaagatggtttgttctatcccggaggacatcccattcgtgctaaaatcttcggtaa

SEQ ID NO: 12095 - DNA, 201 bp, Homo sapiens
tataccttttcccatgcctcagaagatattcgcaagacatttgaaattaatcaaaagtctggtgacattactttaacagcacctttggattttgaagcaaytgagtcatactcaataatcattcaagccacagatgggggaggactttttggaaaatctacagtcagaattcaggtgatggatgtaaacgacaacgctcct

SEQ ID NO: 12096 - DNA, 201 bp, Homo sapiens
ttgtagaccctgttatccagtacacgcggagaactgggaagacagaaagaacaatcctttaagggagaacctagaagccattcaacaaggttaaaatcttyaggcttccgaggatttggtagacagatcagaggcacgtttcccacaactgcgaagaggcgctgaggcaattctgcaagaagattttggggttttggaaaa

SEQ ID NO: 12097 - DNA, 201 bp, Homo sapiens
gctacctggtgaccaaggtggtggcggtggacggtgactcgggccagaacgcctggctgtcgtaccagctgctcaaggccacggagcccgggctattcggygtgtgggcgcacaatggcgaggtgcgcaccgccaggctgctgagcgagcgcgacgcggccaagcacaggctggtggtgctggtcaaggacaatggcgagc

SEQ ID NO: 12098 - DNA, 201 bp, Homo sapiens
gaggacatcccattcgtgctaaaatcttcggtaaataattactacactttggaaacagagagaccgctggacagagagagcagagccgagtacaacatcaycatcaccgtcaccgacttggggacccccaggctaaaaaccgagcacaacataaccgtgctggtctccgacgtcaatgacaacgcccccgccttcacccaa

SEQ ID NO: 12099 - DNA, 201 bp, Homo sapiens
tgctgtacccgctgcagaacggctccgcgccctgcaccgagctggtgccctgggcggccgagccgggctacctggtgaccaaggtggtggcggtggacggygactcgggccagaacgcctggctgtcgtaccagctgctcaaggccacggagcccgggctattcggcgtgtgggcgcacaatggcgaggtgcgcaccgcca

SEQ ID NO: 12100 - DNA, 201 bp, Homo sapiens
tcgagttccgcgtgggcgccacagaccgtggctccccggctttgagcagcgaggcgctggtgcgcgtgctggtgctggacgccaacgacaactcgcccttygtgctgtacccgctgcagaacggctccgcgccctgcaccgagctggtgccccgggcggctgagccgggctacctggtgaccaaggtggtggcggtggacg

SEQ ID NO: 12101 - DNA, 201 bp, Homo sapiens
gtgatttgctcctgaatgagaaattggaccgggaggagctatgcggccccacagaaccatgcatactacattttcagatattactgcaaaaccctttgcarttcgttacaaacgagctccgtatcatagatgtaaatgaccattctccggtattctttgaaaatgaaatgcatctgaaaatcctagaaagcactctgccag

SEQ ID NO: 12102 - DNA, 201 bp, Homo sapiens
cgcccttcgtgctgtacccgctgcagaacggctccgcgccctgcaccgagctggtgccccgggcggctgagccgggctacctggtgaccaaggtggtggcsgtggacggcgactcgggccagaacgcctggctgtcgtaccagctgctcaaggccacggagcccgggctgttcggcgtgtgggcgcacaatggcgaagtgc

SEQ ID NO: 12103 - DNA, 201 bp, Homo sapiens
atcactatcactgacctggggacacccaggctgaaaaccaagtacaacataaccgtgctggtctccgacgtcaatgacaacgcccccgccttcacccaaayctcctacaccctgttcgtccgcgagaacaacagccccgccctgcacatcggcagtgtcagcgccacagacagagactcaggcaccaacgcccaggtaacc

SEQ ID NO: 12104 - DNA, 201 bp, Homo sapiens
cgccacagacagagactcaggcaccaacgcccaggtaacctactcgctgctgccgccccaggacccgcacctgcccctctcttccctggtctccatcaacrcggacaacggccacctgtttgccctcaggtcgctggactacgaggccctgcaggcgttcgagttccgcgtgggcgccacagaccgtggctccccggcttt

SEQ ID NO: 12105 - DNA, 201 bp, Homo sapiens
tccgaattcccacttccacgtactcactcgcagtcgtagggacggaaggaagtacccggaactagtactggataaagcgctcgatcgggaggagcagccgraactcagcttaacgctcaccgcgctggacggcggctctccccctcggtctgggacagcccagataaacatccaggtcttagatataaacgacaatgcacc

SEQ ID NO: 12106 - DNA, 201 bp, Homo sapiens
ctagcaaaggatctgggactaagggtagaggaactggccgcgaggggggcccaagttgtgtccaaagggaacaaacagcattttcagctcagtcatcagayaggtgatttgctcctgaatgagaaattggaccgggaggagctatgcggccccacagaaccatgcatactacattttcagatattactgcaaaaccctttg

SEQ ID NO: 12107 - DNA, 201 bp, Homo sapiens
tgatgtgttccattgagaacaatctccccttcttcctgaaaccatctgtagagaatttttacaccctagtgtcagaaggcgcgctggacagagagaccagwtccgagtacaacattaccatcactatcactgacctggggacacccaggctgaaaaccaagtacaacataaccgtgctggtctccgacgtcaatgacaacg

SEQ ID NO: 12108 - DNA, 201 bp, Homo sapiens
tttcttagacaaaggcaagtcttgcttctctttgtttttctgggagggtctctggctgggtccgagtcaagacgctattctgtggctgaggaaaaagagargggctttttaatagccaacctagcaaaggatctgggactaagggtagaggaactggccgcgaggggggcccaagttgtgtccaaagggaacaaacagcat

SEQ ID NO: 12109 - DNA, 201 bp, Homo sapiens
gagcccaggcagatttttgagccagcaagtctgagcctctggaaaggcttattcactaggccgtctacaaaggttgtggggcaaaagactgtttcccagckctgtctgaggttcagcttggcgacattccctggaagagcgtgacggaaagtgcaatggaggcgggaggagagcgatttcttagacaaaggcaagtcttgc

SEQ ID NO: 12110 - DNA, 201 bp, Homo sapiens
tgctcctggtggacggcttctcccagccctacctgcctctcccggaggcggcaccggcccaggcccaggccgacttgctcaccgtctacctggtggtggcrttggcctcggtgtcttcgctcttcctcttttcggtgctcctgttcgtggcggtgcggctgtgcaggaggagcagggcggcctcggtgggtcgctgctcgg

SEQ ID NO: 12111 - DNA, 201 bp, Homo sapiens
tggtctccatcaacgcggacaacggccacctgtttgccctcaggtcgctggactacgaggccctgcaggcgttcgagttccgcgtgggcgccacagaccgyggctccccggctttgagcagcgaggcgctggtgcgcgtgctggtgctggacgccaacgacaactcgcccttcgtgctgtacccgctgcagaacggctccg

SEQ ID NO: 12112 - DNA, 201 bp, Homo sapiens
ctcttccctggtctccatcaacgcggacaacggccacctgtttgccctcaggtcgctggactacgaggccctgcaggcgttcgagttccgcgtgggcgccrcagaccgtggctccccggctttgagcagcgaggcgctggtgcgcgtgctggtgctggacgccaacgacaactcgcccttcgtgctgtacccgctgcagaa

SEQ ID NO: 12113 - DNA, 201 bp, Homo sapiens
ttatttaattcatataacatgagaaactcctccagtagcgtcaactagggttgataagaataatcgataaagcaaaataaaaacaccttctccaagattttgtaactgcaagcgaacgcatggtggcgctgttgactaagaaggcgaattaaaccacaggcattgtgcatgctcggtgacgcacggatccagtgtggtaaa

SEQ ID NO: 12114 - DNA, 201 bp, Homo sapiens
aaggcgaattaaaccacaggcattgtgcatgctcggtgacgcacggatccagtgtggtaaaccagcggttgagagcccaggcagatttttgagccagcaastctgagcctctggaaaggcttattcactaggccgtctacaaaggttgtggggcaaaagactgtttcccagctctgtctgaggttcagcttggcgacattc

SEQ ID NO: 12115 - DNA, 201 bp, Homo sapiens
tgactaagaaggcgaattaaaccacaggcattgtgcatgctcggtgacgcacggatccagtgtggtaaaccagcggttgagagcccaggcagatttttgasccagcaagtctgagcctctggaaaggcttattcactaggccgtctacaaaggttgtggggcaaaagactgtttcccagctctgtctgaggttcagcttgg

SEQ ID NO: 12116 - DNA, 201 bp, Homo sapiens
tgctgtacccgctgcagaacggctccgcgccctgcaccgagctggtgccccgggcggctgagccgggctacctggtgaccaaggtggtggcggtggacggygactcgggccagaacgcctggctgtcgtaccagctgctcaaggccacggagcccgggctgttcggcgtgtgggcgcacaatggcgaagtgcgcaccgcca

SEQ ID NO: 12117 - DNA, 130 bp, Homo sapiens
ttcaatattttatgtgcttatattggccaaaatatggacacaaatatagactaatatgggtaattaccctttggtttatctaaagtgtgttcatgatgacygaggaaaaaaattaaacctatgccattta

SEQ ID NO: 12118 - DNA, 201 bp, Homo sapiens
tggacggcgactcgggccagaacgcctggctgtcgtaccagctgctcaaggccacggagcccgggctgttcggcgtgtgggcgcacaatggcgaagtgcgyaccgccaggctgctgagcgagcgcgacgcggccaagcacaggctggtggtgctggtcaaggacaatggcgagcctccgcgctcggccaccgccacgctgc

SEQ ID NO: 12119 - DNA, 201 bp, Homo sapiens
ggtttcattaacagtactggaaagtagttgtgtggctctgaatgttttgtatttcaatcgagaatccttagtcgatagaacattttgtttatatattgatkctactttttctgtagttaatccttgcatattctcctttcatcctggcttgccaacgcagtcttaattccgccttttttttttctaatggggagcaaaaag

SEQ ID NO: 12120 - DNA, 201 bp, Homo sapiens
tctgacttagatacaggaagttttgggacaatatcatatgcattttttcatgcttctgaagaaattcgcaaaacttttcagctaaatccaattactggtgrtatgcaactggtcaaatatttgaattttgaagcgattaatagttatgaagtcgacatcgaggccaaggatggcggaggcctatccggaaagtctacagtc

SEQ ID NO: 12121 - DNA, 201 bp, Homo sapiens
tctacagtcatagtccaggtggttgatgtcaacgacaacccaccggaactgaccttgtcttcagtaaacagccctattcctgagaactcgggagagactgwactggctgttttcagtgtttctgatctagactctggagacaacggaagagtgatgtgttccattgagaacaatctccccttcttcctgaaaccatctgta

SEQ ID NO: 12122 - DNA, 201 bp, Homo sapiens
cagaccgtggctccccggctttgagcagcgaggcgctggtgcgcgtgctggtgctggacgccaacgacaactcgcccttcgtgctgtacccgctgcagaayggctccgcgccctgcaccgagctggtgccccgggcggctgagccgggctacctggtgaccaaggtggtggcggtggacggcgactcgggccagaacgcct

SEQ ID NO: 12123 - DNA, 201 bp, Homo sapiens
cagctctgtctgaggttcagcttggcgacattccctggaagagcgtgacggaaagtgcaatggaggcgggaggagagcgatttcttagacaaaggcaagtsttgcttctctttgtttttctgggagggtctctggctgggtccgagtcaagacgctattctgtggctgaggaaaaagagaagggctttttaatagccaacc

SEQ ID NO: 12124 - DNA, 201 bp, Homo sapiens
gcagggcggcctcggtgggtcgctgctcggtgcccgagggcccctttccagggcagatggtggacgtgagcggcaccgggaccctgtcccagagctaccartacgaggtgtgtctgactggaggctccgggacaaatgagttcaagttcctgaagccaattatccccaacttcgttgctcagggtgcagagagggttagcg

SEQ ID NO: 12125 - DNA, 201 bp, Homo sapiens
gcaccaacgcccaggtaacctactcgctgctgccgccccaggacccgcacctgcccctctcttccctggtctccatcaacgcggacaacggccacctgttygccctcaggtcgctggactacgaggccctgcaggcgttcgagttccgcgtgggcgccacagaccgtggctccccggctttgagcagcgaggcgctggtgc

SEQ ID NO: 12126 - DNA, 201 bp, Homo sapiens
acctgcctctcccggaggcggcaccggcccaggcccaggccgacttgctcaccgtctacctggtggtggcattggcctcggtgtcttcgctcttcctcttytcggtgctcctgttcgtggcggtgcggctgtgcaggaggagcagggcggcctcggtgggtcgctgctcggtgcccgagggcccctttccagggcagatgg

SEQ ID NO: 12127 - DNA, 201 bp, Homo sapiens
ttcgctcttcctcttttcggtgctcctgttcgtggcggtgcggctgtgcaggaggagcagggcggcctcggtgggtcgctgctcggtgcccgagggccccyttccagggcagatggtggacgtgagcggcaccgggaccctgtcccagagctaccaatacgaggtgtgtctgactggaggctccgggacaaatgagttcaa

SEQ ID NO: 12128 - DNA, 201 bp, Homo sapiens
ccgccaggctgctgagcgagcgcgacgcggccaagcacaggctggtggtgctggtcaaggacaatggcgagcctccgcgctcggccaccgccacgctgcaygtgctcctggtggacggcttctcccagccctacctgcctctcccggaggcggcaccggcccaggcccaggccgacttgctcaccgtctacctggtggtgg

SEQ ID NO: 12129 - DNA, 201 bp, Homo sapiens
agccaattatccccaacttcgttgctcagggtgcagagagggttagcgaggcaaatcccagtttcaggaagagctttgaattcagttaagtgttaataagsatctactgagcctcgtcttagttaatctgtggaaagtccttttttactgctttgtccattggagaggtcttttttggtctggttcaaggcaagtagcaag

SEQ ID NO: 12130 - DNA, 201 bp, Homo sapiens
tggcggtggacggcgactcgggccagaacgcctggctgtcgtaccagctgctcaaggccacggagcccgggctgttcggcgtgtgggcgcacaatggcgargtgcgcaccgccaggctgctgagcgagcgcgacgcggccaagcacaggctggtggtgctggtcaaggacaatggcgagcctccgcgctcggccaccgcca

SEQ ID NO: 12131 - DNA, 201 bp, Homo sapiens
cgtgctgtacccgctgcagaacggctccgcgccctgcaccgagctggtgccccgggcggctgagccgggctacctggtgaccaaggtggtggcggtggacrgcgactcgggccagaacgcctggctgtcgtaccagctgctcaaggccacggagcccgggctgttcggcgtgtgggcgcacaatggcgaagtgcgcaccgc

SEQ ID NO: 12132 - DNA, 201 bp, Homo sapiens
tcccagtttcaggaagagctttgaattcagttaagtgttaataaggatctactgagcctcgtcttagttaatctgtggaaagtccttttttactgctttgyccattggagaggtcttttttggtctggttcaaggcaagtagcaagaatagagcaaaatatcaaatccagggatggcttaggtttcattaacagtactgga

SEQ ID NO: 12133 - DNA, 201 bp, Homo sapiens
accgggatgtgatgctggagctctatagccatctcttcgcagtggggtatcacattcccaacccagaggtcatcttcagaatgctaaaagaaaaggagccrcgtgtggaggaggctgaagtctcacatcagaggtgtcaagaaagggagtttgggcttgaaatcccacaaaaggagatttctaagaaagcttcatttcaaa

SEQ ID NO: 12134 - DNA, 201 bp, Homo sapiens
gatttctaagaaagcttcatttcaaaaggatatggtaggtgagttcacaagagatggttcatggtgttccattttagaagaactgaggctggatgctgacygcacaaagaaagatgagcaaaatcaaattcaacccatgagtcacagtgctttcttcaacaagaaaacattgaacacagaaagcaattgtgaatataagga

SEQ ID NO: 12135 - DNA, 201 bp, Homo sapiens
ttgagtatcccttctccaaaatgcctgggatcagaagcattttggatttcagatacttacagattttggaatatttgcattatatttattggttgagcatycctaatctgaaaatccaagattaaatgctccaattagcatttcctttgagcgtcatgttagagttcaaaaagtttcagattttgggttttcagattagga

SEQ ID NO: 12136 - DNA, 201 bp, Homo sapiens
gtgcgtgataaagggatttctcggctgaagacgaggctgtgaggcttctgcagaacccccaggtcaggccacatcattgaggctgcaggatctctcttcayagcccagtacgactctccgccgtgtccctggttggaaaatccaaacacctatccagcttctggctcctgggaaaagtggagttgtcagcaagagagaccg

SEQ ID NO: 12137 - DNA, 153 bp, Homo sapiens
cctacggaaatcctaacgggaatgtaacccaaaccggaagtggcctagagcgrccatttagcttctgttgttaagtggatctaagcctatgtcgcttactggacgctgaagtgattgggaatattagcagtgggggttctgtagggtcaggaa

SEQ ID NO: 12138 - DNA, 201 bp, Homo sapiens
agggagtttgggcttgaaatcccacaaaaggagatttctaagaaagcttcatttcaaaaggatatggtaggtgagttcacaagagatggttcatggtgttscattttagaagaactgaggctggatgctgaccgcacaaagaaagatgagcaaaatcaaattcaacccatgagtcacagtgctttcttcaacaagaaaaca

SEQ ID NO: 12139 - DNA, 201 bp, Homo sapiens
ggctggatgctgaccgcacaaagaaagatgagcaaaatcaaattcaacccatgagtcacagtgctttcttcaacaagaaaacattgaacacagaaagcaaytgtgaatataaggaccctgggaaaatgattcgcacgaggccccaccttgcttcttcacagaaacaacctcagaaatgttgcttatttacagaaagtttga

SEQ ID NO: 12140 - DNA, 201 bp, Homo sapiens
gtgaatgcgggaaagccttcaaccagaagtcaatactcagcatgcatcagagaattcacaccggagagaagccttacaaatgcagtgaatgtgggaaagcyttcacttctaagtctcaattcaaagagcatcagcgaattcacacgggtgagaaaccctatgtgtgcactgaatgtgggaaggccttcaacggcaggtcaa

SEQ ID NO: 12141 - DNA, 201 bp, Homo sapiens
tacaggtgatataccctgtatatgcaaggaatgtgggaaggtctttattcagagatcagaattgcttacgcaccagaaaacacacactagaaagaagcccwataaatgccatgactgtggaaaagcctttttccagatgttatctctcttcagacatcagagaactcacagtagagaaaaactctatgaatgcagtgaatg

SEQ ID NO: 12142 - DNA, 201 bp, Homo sapiens
ctcggctgaagacgaggctgtgaggcttctgcagaacccccaggtcaggccacatcattgaggctgcaggatctctcttcatagcccagtacgactctccrccgtgtccctggttggaaaatccaaacacctatccagcttctggctcctgggaaaagtggagttgtcagcaagagagaccgagagtagaagcccagagtg

SEQ ID NO: 12143 - DNA, 201 bp, Homo sapiens
attctgtgaaaggctttaccaagcaatgaattcctagtgcatcagcatattcataaatgaaatatactccgagtttcttgaagaagagaaaatcttctcakaatcaggtctaattatatgttattgaattcatgcttcagaaaaactctagggatgcactgcatgtgtgaacacatgataaaaaagtcatgctttatttta

SEQ ID NO: 12144 - DNA, 201 bp, Homo sapiens
aaactctatgaatgcagtgaatgtggcaaaggcttctcccaaaactcaaccctcattatacatcagaaaattcatactggtgagagacagtatgcatgcastgaatgtgggaaagcctttacccagaagtcaacactcagcttgcaccagagaatccactcagggcagaagtcctatgtgtgtatcgaatgcgggcaggcc

SEQ ID NO: 12145 - DNA, 201 bp, Homo sapiens
cggctgaagacgaggctgtgaggcttctgcagaacccccaggtcaggccacatcattgaggctgcaggatctctcttcatagcccagtacgactctccgcmgtgtccctggttggaaaatccaaacacctatccagcttctggctcctgggaaaagtggagttgtcagcaagagagaccgagagtagaagcccagagtgga

SEQ ID NO: 12146 - DNA, 201 bp, Homo sapiens
taagtggatctaagcctatgtcgcttactggacgctgaagtgattgggaatattagcagtgggggttctgtagggtcaggaaggggcggctggctttgggkgagtgatgaggggcttgttgggggtgggggtgcgtgataaagggatttctcggctgaagacgaggctgtgaggcttctgcagaacccccaggtcaggcca

SEQ ID NO: 12147 - DNA, 187 bp, Homo sapiens
cctacggaaatcctaacgggaatgtaacccaaaccggaagtggcctagagcggccatttagcttctgttgttaagtggatctaagcytatgtcgcttactggacgctgaagtgattgggaatattagcagtgggggttctgtagggtcaggaaggggcggctggctttgggggagtgatgaggggct

SEQ ID NO: 12148 - DNA, 201 bp, Homo sapiens
tacccaacctgtatgtacgtatatttctgtatctatgtatgtatatatatgcatatgcagacatatgtatatggtctggtcagcatatgtgtatgtatgcdtatgtatgtatgtatgtatgccctcagtgcagtggggtttgctgcagaattcactgcatagcaggagatgtaagcagatgagttattttttaagagaatc

SEQ ID NO: 12149 - DNA, 201 bp, Homo sapiens
aaatgcagttattctgtgaaaggctttaccaagcaatgaattcctagtgcatcagcatattcataaatgaaatatactccgagtttcttgaagaagagaamatcttctcagaatcaggtctaattatatgttattgaattcatgcttcagaaaaactctagggatgcactgcatgtgtgaacacatgataaaaaagtcatg

SEQ ID NO: 12150 - DNA, 201 bp, Homo sapiens
tgactaacgcattgagaaaagcctttctgtaaagaatggtacaagacaggttgttactcgattatttatagtaaaatatgtgggaaattatatcaatgatraccctgtttattgtgggatatcaatatttttaaagtgccaacacagtcatgataggacaatattttatgtgtgtgtgtgcgccttatgtatataagcata

SEQ ID NO: 12151 - DNA, 201 bp, Homo sapiens
agaaaaaccttatcagtgccacaactgtgggaaatccttcatttccaagtcacagcttgatatacatcatcgaattcatacaggggagaaaccttatgaaygcagtgactgtggaaaaaccttcacccaaaagtcacacctgaatatacaccagaaaattcatactggagaaagacaccatgtatgcagtgaatgcgggaa

SEQ ID NO: 12152 - DNA, 201 bp, Homo sapiens
atgtgcatttttggtaaatgcataaatgagattctataatgtttactgatctttatattacagattttctcttcttttaggattagctcagcttgcccccsctttccatctccaccatctatagtgagcctctccataattagtgccaaccattagtctcgttcatatttttacaccaggagtcaacaaactgtggccatt

SEQ ID NO: 12153 - DNA, 201 bp, Homo sapiens; identical to SEQ ID NO: 12145

SEQ ID NO: 12154 - DNA, 201 bp, Homo sapiens; identical to SEQ ID NO: 12146

SEQ ID NO: 12155 - DNA, 187 bp, Homo sapiens; identical to SEQ ID NO: 12147

SEQ ID NO: 12156 - DNA, 201 bp, Homo sapiens
accgggatgtgatgctggagctctatagccatctcttcgcagtggggtatcacattcccaacccagaggtcatcttcagaatgctaaaagaaaaggagccrcgtgtggaggaggctgaagtctcacatcagaggtgtcaaggattagctcagcttgccccccctttccatctccaccatctatagtgagcctctccataat

SEQ ID NO: 12157 - DNA, 201 bp, Homo sapiens; identical to SEQ ID NO: 12136

SEQ ID NO: 12158 - DNA, 153 bp, Homo sapiens; identical to SEQ ID NO: 12137

SEQ ID NO: 12159 - DNA, 201 bp, Homo sapiens; identical to SEQ ID NO: 12142

SEQ ID NO: 12160 - DNA, 201 bp, Homo sapiens
cccagaggtcatcttcagaatgctaaaagaaaaggagccgcgtgtggaggaggctgaagtctcacatcagaggtgtcaaggattagctcagcttgcccccsctttccatctccaccatctatagtgagcctctccataattagtgccaaccattagtctcgttcatatttttacaccaggagtcaacaaactgtggccatt

SEQ ID NO: 12161 - DNA, 21179 bp, Homo sapiens
  misc_feature (1)...(21179): n = A,T,C or G, or insertion/deletion polymorphism (see Tables 1-2)
ttctgtcagacataattcctcagtttagccttcccacctctatacagtctgataacagaccagcctttattagtcaaatcagccaagcagattttcaggctcttagtattcagtgaaacctttatatcccttatggtcctccgtcttcaggaaaagtagaacggactaaaggtcttttaaaaacacacctcaccaagctcagctaccaacttaaaaaggactggacaatacttttacgactttcctttctcagaagtcagacctgtcctcagaatgctacaaggtacagcccatttgagctcctgtatagacgctcctttttattaggccccagtctcattccagacaccagaccaacttagactgtgccccaaaaaaacttatcatccctattatcttctgtctagtcatactcctattcaccgttctcaactactcatacacgccctgctcttatttacactgccggtttacgctgtttctccaagccatcacagctgatatctcctggtgctatccccaaactgccactcttaactcttgaagtaaataaataatctttgctggcaggactgtgctgaatctccttaggcactctctaatcagatgtcctgagttgtcccaattcttagaccttttatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacaccgcccctaatcccgctgaagcagccctgagaaacatcgcccattatctctccataccacccccaaaaattttcgctgtcccaaaactttaccactatttagttttatttttcttattaatataagaagacaggaatgtcagccctctgagcccaagcaaagccatcatatcccctgtgacctgcacgtacacatccagatcgccggttcctgccttaactgatgacattccaccacaaaagaagtgaaaatggcctgttcctgccttaactgatgacattttcttgtgaaattccttctcctggctcatcctggctcaaaagctcccccattgagtaccttgtgacccccactcctgcccgccagagaacaacccccctttttcctttaccttcccaaatcctataaaaccgccccacccctgtctcccttggctgactttcttttcagactcagcccacctgcacccaggtgattaaaagctttattgctcacacaaagcctgtttggtggtctcttcacacggacgcgcatgaaatgtataatgctttgtcagctccaaatcataccctcaactttccattttacatctccgaaatctggatgtatcttagagtcgatgatgcaattataattggtagcttcctttctttatgttagtacataaaaataagggtgcatcctacaaatgatggcttctgagattagataaaatacctttctattagctctgtggttctctgcctgtgtattgccaggaggaaggaagtggagcatttcaggtgaggcacagggttttggtatcaattcctaagattcctttcatggtccagcccctggtgtgcattatcctacagttcctccctctatcgcaccctcagccacttggtgtgtctccttatttctgctcctcttgcctaccagcatgtgcctgatgactgaatcctgcccacccaaatgtcaagagcctgccagagatggcttattctcctccactctcctcagtgcatgtgggtatgtgtgtttggagatgactggaaaagcacagtggctacccattaaactgacttaggggtcacactagagaggaagaccatgaagaaaactgagttccagcctgacagcagaagggcagagctttctgggctactggctctaagggcaatgcatatatctgctgatttaaaataataataacaataatggctttgggtttccttaggttatcctccaacccaaagaaaccagtgggcagacatgtatacatggagtggactgggtcagctctttggcttcctagcatgttctgccatctctttttttctgatgacagaacaagcccttgcccacagggtaaaaacctgatgccagcctggccccctggagtccttctaggaccctggaagagagctgttctctttctctttgttttgttaattttaagctgcttccttgccatgcaaagagagaaagcccaagcaaagaccagcataggcagagagccggtagagcggcctgggtccttgtatcctgtgaagcatcacggttatccttctctgcacatgggccagtgcattcctgttctgcttaaacaagcttaagttgttccttcgagtcaatacaakataagatattttaaacctctctctactttaaactatccctctagcttagctgttctttttgaaagttatttgcaacaaacaattcaagtttgagatttgggagggcagaatgcccatattctgtgttgattgaaaggagattcctgggccttaggtccctgctttggttgagaagttgtgatgataattaaagagcctgcgtagattctcactagaggcagggctctgccttgagttgggtcggggtgccaacaggctgctctggatttatccgaagtccttatcagggtaccggatggggcattcaatgaagtttgcaccataaagccctaagaactccaggcttgaagattctctgcaaaaagtgttaccatagccagtcattttggtttgccataacygataagggcttatctttctgacagcacttaccaacctasttcctctgatttttgagtcatgtcctagaaaaagagctgagcccaaggaactacagcttggaggatatatctgatctatctgcgatggcaggaaagcatgcatctagttgatctaaaaactagatggcattattgaggagttggacaggcggtcttaggaacaacctcgttttatactttttaaaaataggaatttacttaaaggcaacttccatctgctctcattctggcagaggtattgtgataaaggctttcaggaatgtcaacagctcaggattggcattagctcatagataattcccgtctactaaattaaagtctatgagagattgatgcatgcaccagagtcttgaattattaggcaaggatcttgctaaagctggacatgggaaggttgctatgaaactcatttcaaaggctgtgtaggccaactcacctctgggaaaccaacgcttattattaaaccaatgcaactgctcaaaaactaaaactccatcactatctaagttccccatcatggtgtgtgaaatcatttccagaaaactcttcaaaagataccgaataaaaggcatcacaggccgggcacggtggctcatgcctgtaatcccagcactttgggaggcccaggctggtggatcacctgaggtcaggagtttgagaccagcctggccagcatggtgaaaccccatctctactagaaaaatacaaaaattagccgggtgtggtggtgcgcacctgtaatcccagctacttgggaggctgagccaggagaacctggcaggcggaggttgcagtgagccgagatcacgccattgcactgcagcccaggtgacagagtgagactccatctcaaaaaaaataaataaataaaaataaaaataaaaaaagccatcacgaaaagacatttctttatcaggtcagcaaattgattgctggtttcaatctctcaagaagtcagattctcttcagacactcctttgtgtttctttacaatgtaatcagtcattccagggtcagctatgaggcacactcccctggcctccctcataagcaatttaattgcaaagggttagcatactatttcttctctgctattctcagaattctcaattatgaaaacaaaaacaataattaaaaagttcttccagctgattttttttttttttttttttttgagacagagtctcacttaaactctgctgcccaggctgtagtgcagtggtgcaatctctgctcactgcaacctctgcctcccacgttcaaccaattctgctgccttcccccctgatccccgagtagctgggattacaggtgtgcaccaccacgtccggctaacttttgtatttttagtagatggggtttcgccatgttggccaggctggtctcgaactcctgacctcaagtgatccgcccgcttaagcctcccaaagtgctgggattacaggcgtgagccactgcgcctagccccacgtgcatttttttttttaagggaggcaggaaagaaggcatttgggcctcttatctgcaattttcttccgtgtaaacttatgtgaaggatctggagtgggacttggtggcttcaagccctggctccacttcttgatggctgcgcgacctgggttaagtcacgcaacctctctgaaccctagtttattcatctgtaaacaggtcaataatagcacgagattcgcagcgcgagtggagctcaaagtgcagggttgtccctggtgaacctatcacttttatatttatcctttgatgaagccagtacaattcctacctggttaaccagatacatcccacctcttccctcgagttcgcccttccccccgcctcgtgaagtccttgttctcttagctgtcttgaaaatcctatgcatcagcatgtaggaaagggcgcgccaggcgggggaagccacccccgcccaagcgcctccggcttcccttataaagggagggcccccttcgcgaccgcaagcgcgcccaggaagaccacagagccgccggtgcgcassgaggtggcgatacgcgcccgggctcggcctgcgggtggtggcccaagcgtccgcctcgctggcctggcaggcgcgactgtgcgtgcgcagccgagggtggtggcggccggcaccccacgccaagggtggtggtggccggcaccccaccctcggccgccgcctccgcgtgtcaggtgccgtgagaagcgcgggaggagcggccgcaggcagcgcccagggatatgactggagccgactttccagaagcggcgcacgcaaagcccagctccgcacgcaaaggggaggcgacassagaaacttcaacccgataaagttcgccggagcgcggagattcgcctcctcctgccactctccgccccgctcgggtcccgccccgctagctcccccaggcccccccagtcgccccagcttggctccccgccctgcgccaacggcttccatcgcagcctgggcggccccgcgcccaccagcgggcggcgccacctggagtggcctctacgcgggaaatctcagggccagctgcgccccaggagcctttgtgtgcccaagcactgtcggggccccggggcgggggagcggctacttttagggattcctgatctcgccgcaagaactggaaaaaatttagcatgccaaagagcctccactgaggtggcaatttgtttgcgagaacctaagataaaatttaaacaaccaaccaggggcgctgtgaggcaaaccgctgccactacactggctttccgggaagcaagctcaagtcgcggagagggaagggaggtcgtgcgctcggggcgrggcgcgctcccaagtcgagcgcagcggccggggcaggttgtaccgagcgtggttctggggacaccgtgcggcctygattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgytcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcaggtcagtctgtctgccgaggcgctgcccggcgacctcttcagatggattattacaggtagcgggtggcgtggtaggtactttaaaggaaatcaagcgccaccgcctcgatgcccgcagcgttgtccccarattgcaggaaccgttacgcgccttgcggggaggggaagggtttggcgctgggttacagcgaggtggaaacacgccccttctyttctccaagggagagtgggttggggatgggaaggggcgtcttcggccatttctccagagagtcagctccgacctctccacccaacggcactcagtccccagaggctggggtaggggcgtggggcgcccgctcctgtctctgcacccctgagtgtcacgccttctcctytctgtccccagcaygggcaccagcctcagcccgaacgacccttggcygctaaacccgctgtccatcyagcagaccacgctcctgctactcctgtcggtgctggccactgtgcatgtgggccagcggctgctgaggcaacggaggcggcagctcsggtccgcgcccccgggcccgtttgcgtrsccactgatcgraaacgcggcggcggtgggccaggcggctcacctctcgttcgctcgccyggcgcggcgcwacggcgacgttttccagatccgcctgggcagctgccccatagtggtgctgaatggcgagcgcgccatccaccaggccctggtgcagcagggctcggccttcgccgaccggccgkccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggmgccttcctcgwccygaggccgctgaccrtcgtggccgtggccaacgtcatgagtgccgtgtgtttcggctgccgctacakccacgacgwccccgagttccgtgagctgctcagccacaacraagagttcgggcgcacggtgggcgcgggcagcctggtggacgtsatgccctggctgcagtacttccccaacccggtgcgcaccgttttccgcgaattcgagcagctcaaccgcaacttcagcaacttcatcctggacaagttcttgaggcactgmkaaagccttcggcccggggccgccccccgcgacatgatggacgcctttatcctctctgcggaaaagaaggcggccggggactcgcacggtggtggcgcgcggctggatttggagaacktaccggccactatcactgacatcttcggcgccagccaggacaccctgtccaccgcgctgcagtggctgctcctcytcttcaccaggtaaagcctctgggaggcgtgggccaggtcttttctcctctgaaaaaggcggagtagagacagaatatgctgagtttgcaagcagggccccgggtttggggtttcgctccaggtccccacccctcaaaaccaagatcgcgtcggtaaagggactcacagtgagggctgcgacacgcgcacgcgccccacccagcggtgccccgacccctccggtctcctatcttgtctctatcgtcccctcccctgcttgcgagtgagaacacatttgcaaagayccctccaccccccggaaaaacaagagtttttaaatgcttggagatgagccctgatatctctctccctggcgcattacaatcagaactggaatagttccgaaagaaaaggtaatgtcataaatatgttaaacacagcagcctctcctaggctagtcctcggcgtgcatccgaggccgcccagccctggcgctaaaagcgggccgcccgtcagggctttgttccaggccaaggaagcccatggaggccgggccagccgacaggtaacccgcacagaaactttcagaaggcggccacaactagcgggcagcgctaggtttataaaacctccgcgctaggagtttgagaaatgccggggtagaagacaagaagcagtcacttttacgaaagcagagtagcattcagaaaggcagatgggatatccaggaggcgcctgcagacgtttctggcccctgcgcttggctcagttagcggaccccctgatgcccacgttggtctctactaagcacggattcaacaggtccctggtgtcgggttgccagatttggcaaaagaaaagtaagttttacacgggaatactcacactaaaagattagcccttgttgatctgaaatccatatttaactgggcggcctgtagtatttactgtggaaacactatccctaggggcaaatgtttcgcaaggcaaattttgattgccgaagagaccagaaatcctggttttgtgtcatttcttggagcacaagtgagcagttggagatgctgaatctgcaggcgccacagaaaggtgtttggaaggcagagaatgactctttccttattaaaatccactgcaatctatatttccttagatactgtacagctaccttcacaaattaaaagtttctgtatacttaaaatggctttttagtattaaaatcatagaaacacccatggtgggtgagggagaggcagaaatcgaataaagaaaagtcaaccagagatcagggaaaaggaaatcccggaataggttccataggtttttgtgcatccgcagataggcattttaacttttgaaacggcctttgtttttcattagaaccacaatagttctccgagtactccaattaggcggcaaaaagaaataaaacaatttggaggtcactttcaattcaatatgctgatacttttttttcctttttagtgaaaagacgtatgacagggcttggcaaattacacgatctgtttttgtatatacgttttattgacgcagtcatgcccattcatttatacattgtcgatggctgcgttcactctacaacacaaggcagagcagagtagtgcaacaaagagggtttggtccacaaagtctaaaatagatactctctggctctccccaccatacatgtttctatgaaaaaagttggcagactcctgcaatataatgttgaagaagcgattctaaaaataactccacttcatcacatacgtgtatacattttttttcggagttgcaaacaatcagttacttgttttttgacttctaacactttgactcaaggtagtggacatttctaatcttttaatatttattttggtaatttttgatggctatatagtattttgctatgataatgtatagttatatataatcatttattgaactttaatgttggtcattggccttgattgcatttttaaaatttttattttaattttatrtatttacttaccttagagacagggtctcactaccttacccaggctggtcccaaactcctgggctcaagcagttctcccgccgctgtctggcaggtagctggggctacaggcgtgtaccaccatgcctggctaatttttagaattttaggtcctgttgtggttacatatttttgtatctcttaaattattttctgaaaatacatttctaggcatggattactgggtttaaaatgaggcgggaagaggttaccttcatgtctcttgcctcgtattaagattttgttttttaaaaagattgtatcagtttgtatcatcaacagtgaataagtactacagtttgtaccataattttatgaacattgggtatttgctttcaaatttaaaaaatacagtatgtagctttatccatcaggacaccaattatctttgtataaaatgagaacagcatgtctgttggaattgtccagggaaatgagggagaaaaaaaatttactttcacattgtaactttcgtgggccctgggtgcttttgcctttgtagattccttatactataaaaaaattaaaaattaaatttcatgactaccctgatataaagatgaatgcattaaaatgatgtatgaaaatattttcttctamctaaaagtgagtttttttaggtctgaagattgtaaaagacgtaaaaatattttcatgggcccctaaaaagtgttgtgagccctaggcactgtccctgcggtacccaatggaaaagtcagccttatctactattgtgctttttgaggctgggaaaacttaagagttttttgacttataatgggaaagacagcattagtcatgcaaggcctattacaggaaatataattcttaaagtccatcttgtaatttagtgagaaattaggaagctgttttagattttttttcccagaaatattaatttagtcactgagctagatagcctatttaagaaaaagtggaattaaaataaattataatgtgctttctagatgaaataagaattttgctcacttgcttttctctctccacattaaacaccaaacaggtatcctgatgtgcagactygagtgcaggcagaattggatcaggtcrtgkggagggaccrtctgccttgtrtgggtraccagcccaacctgcyctatgtcctggccttcctttatraagccatgmrcttctccagctttgtgcctgtcactattcctcatgccaccactgccaacacctctgtcttgggctaccacattcccaaggacactgtggtttttgtcaaccagtggtctgtgaatcatgacccastgaagtggcctaaccyggagaactttgatcsagstcrattcttggacaaggahggcctcatcarcaaggacctgaccagcagagtgatgattttttcwgtgggcaaaaggyggtgcattggcgaagaactttctaagatgcagctttttctcttcatctccatcctggctcaccagtgcgatttcagggccaacccaaatgrgcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagsataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaacwactgaatgaagmagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgakttatcatgaattttaaagtatgcattattaaattgtaaaactccaaggtgatgttgtacctcttttgcttgccaaagtacagaatttgaattatcagcaaaraaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtntaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttwtttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacmccattaccaaaataataaaaatcactttcataatcttgttatgaagttttatgttgtagcaaatayagtctaatgtatcactttatttcaactattactatggattattcaattaaaatattgcactgtaaacattttatttgtccattctacatttcaggccgaggccacatgcttttttttcccgtaggttttcatcaaccaaatttctaatctctatatttttgaatttctaagaaccaacacggaggttacatttcaatcaaacaatcaagccaaatgagaattaatttgcaatgttgaaagattgaatagattgcgactttaagttgctgatcgatttctgcttcatctaaagaatgcagtacacatttttcttcctcagcctcataccagtcctttctctgagtattttcttctttcatttttttaaaggtacatgtgcctcaattagtgcaattaatgtccaataaaataagatgggtacaagtattctgtcatgtactatgtggaaatgttttattgccaatctttttacttggtaaaaatacttgacttcacagggcctaggtcatgactctccaggccttcactgtgccacactcacagatgacagggcttgcggtaccaaaggctctttatcttccagactacagctcctattaatgtgaaaacaggaaaagaagtaaaaattgcacaaaatggcattgaaactttggcgtgggaacctcactttagcagccagaaggtatggctatggagtggtttaagagaatactcactagttttccagatgtatgacagtaggatcttggaaatgtcaggacagttaagaataagtgaaggaaatattttcatgggaaaaatattcctttaaataattataattggggccagtttttgcacaactgtctagcagagttggattctacccaatcaatccaacagagtataagaccggagtacagggtgggaaatgaatgcagctttggacataagtaagacaggcgtggttgttagaaactcacagaggttgtttcttcaacctcaacgccagtctgtttttctgcaccagtgcaacagaagttcactggctgttaactctccgttttttggctcagtgactctcacatgctctctgctctccagtttcagtctattagttataaatctcagaaagtgaaaaggaaagaagaaaaaaattaaatatattcaaatacatttaaaagcaatttttttaacttggaattatggaggaaaataatctagtttacataggtatggacacgctatgggtaacagctcatgcttgtagcacctctgctaagcgacatacaggctttgaggacaaatgctgtgctcttcatgcacacttttcaacatgtgtcagatatggagggaagaaatggaactaaaatatgttgagcacttacaatttttgcatcactatgctaaactctaatgcattattgcctaacagtcttcagagggatgcgataaagtaatgggccaaaattatatatttagaagtattctcatccagattttccctggagatgaactaattcaaagcccattatctttgtaccctagtttgtcccttcccagtgtgcctgtgtttggatttatagggtagtccgtctatttttttaggccataagatcctgggagtttcgcaagcaatttacttcctttgtctaaggcacattccacactacagacaggcagtaactgacattgtgcgggaatcctcaccacactgctctcttctgagaaaagcccctttaaactgttctttaggcaaaaccaaaagccaaacaaacaagcagtcatgctttgtcttataatcctaaaacttctgtcctagaacctgtctggaccaaggttccttgttggagccagggccatccttaggctggtccagtttcctgggacatggcctgtccatctgatagccatgcatcacctaagtgttggtgtatgtggctcatcagaacccttccgtctctcagagcccgtgaacactggccagagggagagagaagaaccaaggcacgaaacaagctttttgatgggaagcttgcctttgcaaacagaatgactggacctaccagaactagttttgaatcatttgaggcccctttaggtgagacaatgttatacagtagaagcctaacagcactgagatccctttgggtcagagctaagagtcattgagcaagcccgaaaaatcagccagcctctttctttttcttttttttttttaaatttattcctatttccttacatttgtttctctctctctcaatggataagtattacaatatgcttaatatgcactttttgtttgcgtgttccagcaaaatttgtattattgttttgaatatatatgttttactttatgtaagtgctgtacatatctcatcctgttgcttaatcttttctcagctccatccctgtgtaattccatagcttatagctgctgcctagtattccatggtacttatccaccacattttttctatccactctcttgggaatagatacctggataacttccaactttgtgagcccctaaatgatgcagcgaggaacagcttggtatgtgtttacttgccctcctatgtaaactttgtaatgcatgccatacgcatgattagaagtgttgggtcagcaagtgagtgcgttatgtaatttaaatattgcatgttctccagaatgccaaatctgtccacactcccatcagctgtgcatgaggggaagctgtacccacttccccaccaacacatggcatgacctctttatttttaaatgaaatatatcctcttgggagagagatgcattacatagatttttttttttttaacgaggaaaaagacatctaccctcatttttcaatacttcccatagtcatatttgtgtttacatcatatctccactattcgatggtatattcattgaaaagcagggactaagtcccaacaattttgttatggaatcatattgtatatacagaagcaagggtgaaaaaaggggagtgagttttgtcgcacctgcttctcagcactgatgatctcttcgccttctccatgactcagttttcaattggtactcttgaagtctaacctgtttctttctttctttttttttttgagatggagtctcgctctgtcacccaggctggagtgccatggtatgatctcactgcaacctccgcctcccaggttcaagtgattctcctgtctcagccccccgagtagctgggactacaggcatacaccaccatgtctggctaatttttgtatttttagtagacacgaggtttcaccatgttggttaggctagtctcaaactcctgatctacccgcctcggactcccaaagtactgggattacaggtgtgaaccaatgcacccggcccctaatctcagtttcttctctttgcttacaaattgagcttattcaaggtttttaggtttctgcttagtcactatgaagaaagcagaaatgccaactcaatggcttccaattttttaaaccatagcctcacagtatgcaatatattttacatgatttagtacatatctctacatgtgattgtgtgtacttcatagatatatatttatgtatgtatatatacacacacacacatacacacacacaaacaggattcactattttctgtgatggaatatatttttaaatttttttcataagaaatgcagcacagtgaaatactactacaaacctatcatagtggctaaatttttaaaaaaatgacaaaactgataacatataccaagtattggggaggatgtgaaactactggaactttcatacattgcttgggaaagtgcaaaatgctacagtatgagaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattacttttggtgttttagacatgaagtccttgcccatgcctatgtcctgaatggtattgcctaggttttcttctagggtttttatggttttaggtctaacatttaagtcttcaatccatcttgaattaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccgttgtagaagtcagtgtggcgattcctgagggatctagaactagaaataccatttgacccagcaatcccattactgggtatatacccaaaggattataaatcatgctgctataaagacacatgcacatgtatgtttatagtggcactattcacaatagcaaagacttggaaccaacccaaatgtccaacaacgatagactggattaagaaaatgtggcacatatacaccatggaatactatgcaaccataaaaaatgatgagttcatgtcctttgtagggacatggatgaaactgtaaaccatcattctcagcaaactatggcagggacaaaaaaccaaacaccgcatgttctcactcataggtgggaattgaacaatgagaacacatgcacacaggaaggggaacatcacacactggggactgttgtggggggtgggaaggggggagggatagcatttggagatatacctaatgctaaatgacaagttaatgggtgcagcacaccaacatggtacatgtatacatatgtaacaaacctgcacattgtgcacatgtaccctaaaacttaaagtataataataataaaattwaaaaaaaatgctacagtatgaccccactcctgggtatttatcctagagaaatgaaaacacattcacacaaaagctatacatgaatgtttacagcagctgcattcatcatgacttcaaactgaaaacaacctaaatttccttcaaagggcaattagttatacaaaatctgttacatccacccaatggaatactactcggtaataaaaaagaatgaatcattgatacacacaacaacttgaatgaatctcaagggaattatgttgagtaaaataagtcagcttcaaaaggttacacactgcacaattccattgctacgacagcctctgagagacaaaagtgtcatgatgaagagtagatcattggttgtcgagggttaaaggggagggagagtactacaaaaggatagcctggtggagttttggaaggttttctgattgtgacagtggttacatggatgtatacatgtgttaaaattcacacaactacaccaaaaagtgatgaaaagtgattggaaaaaatgttaaaggggaattggtgcaaatgaacttaagtgaagctgaactgacattggcaggtagcatggcagctgctggcagacaaggaaacgagatggcaacactgaacaaagaaggtcaggcctagagatgtgaacaaggatcatggcctgtgctgaagtccttgcaggagaggtaaagtggtgccagattctcagagcagaacaggaggcagaataccagcctttgggatgagcaacagctggaacctcccagccgaggcaattttaattcaatgtcataagtgttaattgagcacctattagtaggcagacactgtttggggcactgatgatataataatgaacaaggcacccaggccctgacctcatggagctgatattctagtgggatgggtggcaggagagaaaataagatttcagttaattataagtggtatatgtgtgtatgtgtgtatgtgtgtgtgtgtgtgtgtgtactgtgtgtgagggggcactgtttagaatgagtagtcagggaagccttcctgaaggaggcaacaccaaggggtgggcattaaggacaagcttcctcttacatcctctccatgtgaagaaaatacaggcactgagttaccagatagtataattaccttaaaaaaaaaagagggttgcaattcattaaattgatttttatggtcacaaaatcagggcagtctgaagtaaaataatctcagcgcactccacagcagatgacattggcccataatcagcactggcttctggcttggccgatggcactggtgggtccagaccgttccctgccattgactcttgagctcattccaatcatcttccccttggagcactgaagcaaatctgataactcagtgcctgcatttccttcacatggggaggatgtaagaggacacttgtccttaatgcccactccttggtgttgcctccttcaggaaggcttccctgactactcacttgttcctaaagaataaccagagaacaaacaggctcttggaactaacatacttttcaacaatgcctttaaatataatttaaaatggcctgatgattctttaattttatgtgcaccaaaggactccacactgattcttttaagcacttaatggaacttctcctggaa

SEQ ID NO: 12162 - DNA, 120394 bp, Homo sapiens
  misc_feature (1)...(120394): n = A,T,C or G, or insertion/deletion polymorphism (see Tables 1-2)
agtcagtgagaagcaatgaattagtggcccaggtctagacagcttatggcttcagagcagtgtttcacaacctaagtttcctggagtcgtgaggagtcacccagggttagtaagggtggaactggaaagttatgaacagccatatgaaacataacaataaaaataatatgtctgccttccttttttccccttcaaagataaaaatattagtttaacgacatttataacaacatttacttagatcgaaaagctcatatagagaactgaatcttgatttcatgaggcaactagattgctgaccaaagatgtgttgactaatttggtgaaactagtttcttattacctaagcatgttgcattgagtatgaattgccttgctttaagctagggagtagtaggcaccacccacagcttacttataaccacttgacatagatcactgtgacctatgcttgactattaacaagcacccacttcttatcacctcctcttccacctcaacaaaggaatagtttccacgactgaaacatgactttaagaagggaggtgtcctggataaagccaagacatgaaaatccaatctacccatacccccaggcagacttgccccttgcgagtgataaattctacagttcaaatgagtattcaacactgcaggcacaattacttataattgacttttgttctgtagcagaattctctctgattcctcttctttatttatttcacctatttcttttcatttggcaattataaaggtacccttataatttttataactttatgcacaataatgagccttcagggaaagacaagaactaccgcactcaaaaacatcagaaaagatttgcttatgaatgaagtccatattttttgtgctggttttcctcattagagggagaaccaaaaatataaattctaaccaagtactgagtgctgtggagatcaatgtatttcatttagataactataaatgacaacttgctaggattgtaattagtcttatttggcgttattaattctacagagggagcataaaacatttaataatacattggacttactcaactcactatttcttactttcgtccttaagatcatcttaaaggaaacatggtttgaagaccataatgaagtgttgtatgtgcccactattttactctaaatggcccacaagtgaggcctgaaggaattccaggagccctacccagacatgatgtggaggtggagcaaactaggcactgagccaaaggggatcagtgatagccagcttttgggagagccagatgaggcagagagctgggatagggtggatctacctccaggttcaggacattcagggcacaccactgagcaggagcatcaggtaccatgacacagggctggtctgtgttaggataaagcaagttcttaatgggctttgaatccacagaaactttgcttgtgatgtccagatgacggccccatcccttctgcagaagtcagagttttcccagaaaaaaagcaatgactgaactacagctaatatttggagaacacccacatagttgtactctctatgtatttctaaaaatcattaataaaattttattatgcattattattgatatttcctttgtcatattcattattttcatttaataacttatatgtttaaaaaatagtttacccttattgtatataatttagaagatgcagaaaagcatgaggaagaaaatgaaaaccaccctcattcacatttgcataacctacagataagcactttttatattgtacttcttccagtcttttctacatgtgtacatgacaaaattaggaatacactaattttggtaggtaaaaaaatatacacaattcaattaaatggctacttgggggaggaactcccaatccagaatctatggcacagggaagttcaggcaggcctcatcatcctgtgcaggtggtattctcactcccattttacagatgaagaaactgaggctaatggagattaagtaacttgtccaaagttagatagctagtaagtgaacacaaacctttgtgatttcaaagaccatctcttgagattggttaacttttaactaaacctcccagacacacagcctgaccttatcttccaatctttcttgcagttaggtgtggttatgtggcacagtcctctccagtggaatctgagtagaagtaatggatgccacttccaggattggcccacaggaactttccatacaaaatgctccatattttctcttccctgtgtgatggatacatgtccatgtccaaggagaccttaaaagccacatgttgaggatggtagagcttctgtcagcctgggtctctgaatgactgcatggagcagagcacctttgcccaacaccgatttccccttattcaaggcctactggacttcacatgaggggaaataattagcaagtatcactaccttaaccaaatcatccaacaagtaagtggcaaaaccaggatctaaagccagttctttgtgacttcacaagcctgtgctcttttcactataccattctgcctccctctgcagtcaactaaactacagaaattgtgtccttccacacagcttgctttaaaaatacataagctacctaagaaagctctaatttagacatttttctctctgctagtctctatgccacaaaaaaacatagccaattatattgtgttaactgactcatgctggctttacacaatttatattgattttcagggtggtaataaccagcttctgtgattggtgtgcatgtgcaagacttcctgcctaacccatccttcttgtggctcagctttgtaaacactggccctgggtggccgtgaacagaagttcttatcttagactgcatgcaactcatcctactggcactgaaagcccttctttgtctttcttcacctacttaagcaaatttacaagccactctttgcctcttctctcagcagccatcttggtcctttcaatgttgcctgtgtgcactcatgctgtatttatgacctggtccctctcatactttgagatataactcaagtccttccttctttgagaatccatactgatgggtcactttttaaatacttaaggtctgcatcaaacattataacatttgctgttcttcttttttattcttacttggtttatatactaagctttattatccttttaaggttaaaactttctcaaggacactaactgtaatgtgtacaacttggtagccagcgtaacatttgacatagtgtcttgtaaaaagaagatactcaatcagtttttgaatgattcaaagagtaaaataatggcaacttcttttatctcttccatagtgcaatcttcaatattttttaaacaactattggctgaattctaccattgtggtttagagctttctctgagacatttttgctaaggttttgaaacaggttccaaattggtccacagtgacctccaaggctctacaggagtggtcctcaagcttcagctcattgggccccactcccagagtttctgattcagtaggtctcaggaaaggaccaagaacatacattcctactgggtaatgaggaggctgctgctggtccagtagtcacactttcagagccactgccctgtgagctcatggcactccatgattcccgccacactgacataatccccagctgacttcagtcttgcttactccactccaggttcagcttccttacatacaccaggcatgctcctgcccagagctttgcccatgtggtttccccagatacccatgtacttgttcctttacctccctcaggtcattcctcatatgtcaccatctcagtgggcccttccataaaacccagttaaaaatggcaacatccttctcccctcacacgctaactgacacacacacatacacaaacacactctctctctcacacagcatacgtacacacactccctatcatatccctttcctgcaatgcttttctccataccatttacaccatctgatgtattgtatgtgttacttctttgtctcctctctatactgccccctccctgcccccagaatgtaagattcctgaggcagagattctcgtctgtcttattcattcctgaatcccagaactgagaacagtgtttggcacataaacattcaaaaagagccggtattttaattgggtgactgtagggaccacaaccctacctattttcagaccgtgaaccataaagaagacaagcttatagctgaagtgaattaagcacgatcaactcagtactcacactgcccagatgtgtctggccagcatgagggtgcagaggaagacaccctgaactctccagggccctggacagatggccactctgtcttcacttttctcatctataagatgaagttgttggatgatatatcaatatttacaatgttgtttctagctctaaaactctatgcttttatcttcccttggatcttcatggcaccagaaggaaagtcttaggacccttggacctgtgagcagatcagctatagtcctgagttgacaaatttctcttggcatttttaccctttgactgctgtcaataacttcagcacagcaaaggtagcaaaattctattgggaatcttttcccaatcaaagctacagccccatagctgtgttgcctttttggttttgtgtgaagcaaaatttttttcctgggtcctaattggtgccaaatccaatattactacatttgcgtcaactcagaagtcaacccattcagtttgcatagargaaacatctagaaatcttgcttttctttgctgaccttgatatatttgagatttgaacatataataacatataaaattatatgttataattttgggttttatgggctaagtcataaaccatcttatacataaattccaatagagaaaaaatggtggatgctgaattttaataaaaaatttatgacagagaaacctaaaattgagaaaatttgatcttacagtttaatttctgcaaattaagaagcactggcccatcaattgcatttcagagcacagagtggaagaaggttagcacagactggcatgtggcttcacatctactagttgttacaccttaggaggattatttaacctctctgtgcttcagtttccccaactataaaatagaaatgacatgatagcacccaactcctagggctgttgagaggcccaaatgaggtgatacaaataacatttttgaagtgggccaggcacccaaccaagtcttgaccaatgttgcctattattattcattgctgaaggctggagtgagaggcatttagggaaaagtaagctcaggcaaaggagaaaaaataagaacattgtaggaaaaatggaaagattcacaagaagggagaggaagaggcagcacaaatatattggaggagctccacatgcttatttgactcaagacctgttcatttgaacctttagaaaatcgttcatctttgcttatacagagcttcatctggtgtgtccatgccagggtgcaagagttgtctgtgcactcagacttttgagcaaggctgtttcaaatgttcttttagggtatttgtctccacaaaactctatagctgggccaggagcatctggatcctgcaaccagggattttccaagagcaatcttttatattgagggggaaagtttaaaggtatttttttttttgtcttgttatgtttttaagtaacttttcacaactacaggcctgtaaaaaataagggttgggatagcctgaattccagggctcttgctgggcccactctgctcaatttgcctctcgttccaaggtgaatcagcaatttccaaggcctgttgacaccctcagagggtttcccaagcacactctgtgtttggggttattgctctgagtatgtttctcgtatgtcactgaactgtgcttgggctgcccttagggacattgatccttaggcaaatagataatgttcttgaaaaagtttgaattctgttcagtgctttagaatgatgaaaaccgaggttggaaaaggttgtgaaaccttttaactctccacagtggagtccattatttcctctggcttcctcaaattcatattcacaggtaagtaacttatacttgtctctgcaaatccattccctcttccctttaactcttactttgtggagtggagtgtttctggtttattaaacattggtctcttgtccagtgtaaacaacgctacaatacttggatagaaacttacaggatgcattaatgatttcacaacattgtatacaatacagatgactcttggttgctgtcttctttatagcaatgctatttcatgtatcaatctcttagagagagagagagtggtgtacatgggtgtgtggtacaaatggccgaatagattgaataatctgctcaaagtaaaaataccagtgggcttcttttttaacttggctttgtgaaagcacaattctgtttgctctgataatcacagattcaatgatcacaaattctacccttgaaagctggtttaatgcagaactacaccgactttatcttttctccaacaccgtactcatttcttcattgtcccggttttcaaaaatatagatgcaaaaaaaaaatgagctgtggatgcatgtttagaggggagaaagtttgtttctaggatctaatttcagtttttaggtcacycaagccagtgggagtcacatattgctaatggcttgagcacagagatcaaatattattcacacttcagactgggaataaaagacagtatttgtcaacattttgagggggaatagctttttagagatgttagagacaaattatagtggttatacctaaaactttttaatattaggagttagtagtggtttttattaaacatttgaagtgataacttatttatgagctgttgtttaatagaagttcttttctgtgggcaacctcgtcccctcactgctcacccccctcaccttggttccccctgctgtgctctgtaacactgtgattgtctctggttgaagcctccatttccctgtctaggagcttctgtttacactccaccccactctagattgcaagccccttgaataatttttgtttcctagtaccaagaataatggtgacaaatattaggggatgactcctaaaaatggattaagaagctatttagggggaaaatgcccattttgtggttttaaaagatgctacaattgccataaaatgcccaagtttcattgcagaaatcaaatactggagttgtgttttgcttggtcaagaggaaagaactggccgggcgcggtggctcacgcctgtaatctcagcactttgggaggccgaggcgggtggatcatgaggtcaagagatcgagaccatcctggctaacacggtgaaaccccgtctctactaaaaatacaaaaaattagccgggcgcggtggcgggcgcccgtagtcccagctactcgggaggctgaggcaggagaatggcgtgaacccgggaagcggagcttgcagtgagccgagattgcgccactgcagtccgcagtccggcctgggcgacagagcgagactcctctcaaaaaaaaaaaaaaaaaaagaggaaagaactgtacatttagagacaaagaatcgctgtggcagttaactttggtgttacattctgttttcttcctaagcaattctttagtcctctacctcaacggtgcctctgaagaaaggacttacgtggccaatgggatcaccgtgtatttatttcccttccctatcagccatagccctcagggctggaagggcctcattttagtctattcccagactgggtcacccacagtgttgacacacagcatcaaccgacagtgagcttatctggaaaataatgcctttctattttctttgtttcttagcatatattaaatgtttctttccttctctaataatcttttagataaagaaatcatttgctgagctgataataacaaaagtatcctacctacatttttaaatgtcagcagtgaaagacgttttaagggctttaaaaaaaaaaaaaagaaagaaaagaaaactgtagtttagaaaggacatccaaattgaagaggagcaggggcagttctgttctctctgagcagctctgtgaagggggagtttgtggcgctggggtcttgaaagtctttacagagggcaagacttcacaagagaaaagccgtggagggaccctcacatgatcagaatattcacagtgtgatgtggggcatggtgggggcgggtgctctccactcccgggcctggcttggttcccctcactgtcctcagctcctcaatggctttgaggacatttagattcttcttaccatcttggcctgaatgtggaaaaagctctttttccttaattaagtctagaaaaggtcaacatgtttcaaaaaatagcatttgggtggaaattaaatggaaagtggaacaaatctctgcagagaaaatgcaaaaccctagaacacagacagagccatctctgcctcttggtctggtgggatctctattcttctcaaacccatttcctaacctctgtgggtgtgggctccaagtcccaagccttatcagggtaactttttttaagtataaatttgatcatatcctttcttgcctaaaagacttcattagcttcccatggcctttaggataaggtcccaagttctcagtggtaaggatcatgaggccctgaaggatcaaccagccacatcctcccgagttgcccatccgcctccctgagattcactgggctccttcagccttggacccggctgccctgtctcttgcatctgggcctttgcatgtgtccttccctgcctggactgctcttccctctcctcttcccatggaaaacttgctctcatcttcaacatctcatgctaagcacttgctccagagccttctccagctctctagacaaggcagctcctctgcatcagggcccaggagatgcctgtatttcccctttcctcactgccatcctgcttgacgcctaatttcccagataatgtctgccttccctgccacattgtaagttccatgagggtagggctggctggagggctggtgctccacacaatttttagggtaggtaaatcaggtcctcagagatttcttcctgggcctcaggctgccctgaactgatctcacagtacagggrttgacattttctgcaaagagctgtatagtgaatattttaggtatgggagagagaaagggccatacattctgtcactgtagcacagaagcagccaaagataatagaaaatgaaagggtatgactgtgttcccataaaactgtatttataaaataggatggtaatggtatctttcagcccagaaggattcagctctggagacaccttttctcaaccctgaccctttttttttcttcaattcttctacaataccaatagccaattgctagtattgatcccagccattggtgaagatcagcctgtccatctgttgctccaggctgacatccccaccagttcacactagcagccttgctgtagtggcaagtagtgggcactgacattttatgctctcaggatctttgatttctttctggcatggcttgtagaaccctgtatctcctccaattttgacagcctcaggacctttgtggtactactcattcaggcccatttttaaggtcagtcaaagtactaggttctctcaagtgaccatctagctgatggtctctcttccccatcccctcctccccagcagtgaggtctttcagaatgctgttgttagagtgtaagatagaaacatctttgatatgtttttaccagtaattgtcaggagactgttctctaatgtgcgtatctgtgttgataagattacacattttatcaagagaaaacttcaaccctgaatagttaaacagaagcgcatatagtgtgcaggttatagaccacatgtcacttagcagagaggaacactggagttggtgtggacaattaagaattcttgggggattctatgattaggtgtccaaagtctgccaactagtgcttagacatctcgatttcctgctttttactcttagattcccttaagtttattggaaaatacatttttctggaatgccttgaaaattctcagtctgttcctgaagagattttggggaggttaaaataatttaatatgttaaagtgcacagtaaaaatgaaatagcattggatgttattttcaactctgagttttcttgtgttagtttaagtaaaattttgttattgtaaatttgttaagaaaccctaattaaagcctccttcaatgtatgaaactcaaatcaagttattaggttaggtgctaaaaaagtgttacagctaatggccgagacagtagaactaggtgacattatatctacttgtaatcagtgaggaaaaataatgtggcaaaacaccatggtactcttaaatcatagaaagtgccaaatgaggaggaggtacactctcaagaacctgcaaaacaaatatgtttatcaccaaaaactagattcccactgcatttccagggtttcagagactggcagccatgtcctccagcatctgatgtatgggtttcccaacatctcatctgataaaaaaaataatttgccagtggaagaaaacatggtctaataatatatatcagatatatattctacattcataatgatacatggcaattcatctaatattcaattctgaaaacctcttttgtggcaaatatcacaggcaaggccttcattctttctagaaatttcggtttttcagtgtactttcccaaacttagtgttataaaattcccagtgtttttgtgggtacatgcaagtaattaagattttcagcacaatggccttcaaaaatcatcacagccgtttctaagctgcccaaagataaagggactagcttccatttctgactgaacaaccagtgcatgcctttagccctagagagtatacatcttttgaagtatagctccttggcatgtcaaaaaagaacagtggactaccaaagttcagagtgatgcacttgatgctgagaaagaaaacaaacaaagaaaacaaacaaaagaacaccctgttccatttcatagctggcctggtactcacacctaagccatgttattctcttattagacataaacaatctcacagagtaccaacctcaaagttactttgagtcaatgcaaggtcaatttatactttgttctcagcaaaggcaaaatcaaggtcactgtgcaacccacaaaataccaaacaccttgctaaatgaatggctgttatttctttatctagtcataacatagtcccagctttttaacagcatcyaatttagaacaaatacccactacattagatccttccccaaatcatctgactaaagcccgagttctgtaacaggttctttctaacaccattttactgagatgccccacagcccctgacagtgtgttcacccttggtgcaatgagtagcaaacacgacttgtttagctacagatgtattcttggtgctcactgactgaggggcattgacaatgctgtgggcatagagacgcatgatttaatggatttttgccttttagaatgtaacttttaacagtaaaatagaaaccacaaaaactatttgtaggggtattcggaaagaagcaaaatgtaagcaattgaaacctaatgtatggaattgacaaggggacacagaaggaaagtaaagagaataggttagtggattagtattcctgtgcttaatggaggacagattactacaaatgaccctggaagggcagatggggtggaggatcaggtagggaggactcggtctttaagcttgaagggcaaagggaacttcagctgctatctcccttttgctggctgctgtagagatacagtttcatttcatcttcacaccagtcctgcaaggtggattttaccaccatcaccaccacttcctgacatgaaagatggagaaatcaggacgtggagagagattttaaaataaatccaactacgtagagtgaagcaacaggtgtatcaggatctgagagactccaaatttcgtgggcaagacactacaccactgtcctctaaatactacgaggtatttgcacaccagtggaaagaaayctttttaaatggagagctaagccaagggaaaaaataaatggagactaaatttttttaatattgtattttaaaattaggaaatgcaataacacatctgtggttaaatgttgtttattattttctcattattaaagagtctctctgtttttttgaaaaaaaaatttggttaaaacttcaaaaattgtgtaaccggcaaatgttacagtctctgaatataatactgctatagtgagcaaattttgttcttgaataaaataactttgaatctggttcctttagtatattttaaaccagcctcataaactacttaattaaataatatttcttactctacttcttaatatgctattaagggacattctacaaaataagtgatgagtactcctcaaaactgccaaggtcattaaaaacaaggaaagtatgagaaattgtcatagccaagagttgcttaacaagatatgacaacttaatataacattataaacttggtatcctagatggaatcctggaacagaaaaggaattaggtgaaaaataagggaatttgaataaattatgcactctagctaataataatgtatcaatattggttcattaatactaatgcaagacatttacagtgcacattggtacgttaatactaatgtaagacattaatactaataatgtaagacattaataactgggtgtggggtacatgggaattttgtaccatcttcacaatttttctataaaatcaaaactgctctaatttgtttaattaaaagagattcaccagggttaagaaaaaaattattttctgtcatgaagtgttttattttctgcaaaatgattttgttttatttaggagtggtatgctgcttaagatggaaaaatacatgatgatggtgcatagtgcctccatcccaagcttgctaacattaacccttttgtggcattatccagctttccatatgttcttttttaagttttattttattttattttaagttctggggtacacatgccagatgtgcaggtttgttacataggtaaacgtgtgccatggtggtttgctgcacctatcaatccatcacctaggtattaagcccggcatgcgttagctatttttcctaatgctctccccactgccctcccccaataggccccagtgtgtgttgttcccctccctgtgctccctgtatccatatcatgaaatattttaaagccacaggaaaaaaaagagaaaaacttaatgaacaccaagttacctccttccaactttatcgtatcttaaaccctatgccatacttgctggaactttttgttttaagaaattaaaacatgcagatacagttcaggggccctctgagcccctccccagtctcattccacttcttttcctcagaggtaaccactatcgttaattcagtgcttatcagtttcaggtaagtctttatatttctactgcgtatctatatatctacgaacattacaaatagtgatttgcaggtaacacaatttacataaatggyatcatacagtatcattctgaaactttgtcttgtttgtttaaacttacgtttgttgagatttatccatgccaattcattgattttaatggctagataatattccactgtgtgtctattctatagattattgaatcaatctcttgttcatttgtattttctcctagctttttgtttccaaagaagtactgcaataaacaagcttacacatatctctgcatgcattttctgagtttcaatctcggctgtatcacttactaacttgtgctcttgagcttgtgacttagtccttcatactttagtgcccttatctggaaaacggggatagtcataatacccatctcaggaggctgttgggaggttttatggcatagcatgtataaagcatttagaacagtgcctgccacgtattaaatgccatttcattgttaattattttttaaattgttgaggaaaataccagagaaggatattctgggatctggggtattaacatgtttagccttgctagatatttccaaattgctatccaaagtcattcagtcaatttatattctcattagctgtgcatgaaaggactctttcctccacatcttaacaacactttgtactactggatatttcatctttgccaatatttcaatgaatagttttagtattcactgctgatcattaccccaaatttattcattagggttgcaaaataatgatttttttttaattttataggttttcaaaacaggaatggataatgatttttactgaatactttttgcatttatgaaaatgattaattattttttaccttaaataatcattgcattcctgggatcaacattgcttcatttttttcataaactgctgaattatgtttaacatattttatttatcattttaaaatctgttttcagaagtaattataagcctatttttatccttctttgttttgatgtcaaaattatacttgctttataaaatgatttgggtagcttttcttatttttcttttcaccaaaactatttatataagattagaattatctactgtttgaagttttggtaaaatttgcctgtaacattatctagccctgttgttttttgaggtgggagacttttgaatattgaatcaatattttaatagccattactttttaagttttctattcctttataaacaaattttgataactcatatttttctagaaaattaatcttaacctggttttcaaatttactaccatgaaattacttagtatttgcttatgatttaaaactttatttattttacctttcccattttcaattagtatttgtgatttatatctcttttcttcaacagtcttattgacttgcatgtttttagttttcaaaaaacaacttttgaattgatatatcctttctactgtttttcattttattttgttttctatcttataaatcttgcattttttaggttcttgattagaacataattcattcattaatctcttaaaagcaaaatgcatttatctttataaataaatcttgaagtatctttttagctgtagcccacaagattttacatatttatcaccatattttaaatattttctatttctgtcatgatttcatccttaacccatatttatctgcatatgtattttaaagtttgtaacacacacaattttactgagtatatgtgtgtgtgttttactagtgtttaattttttagtttttatttaattgcattgtcagaatatacacccttaagaataacaacaatatagagaaatacatagtttttcatttgtagaaattttttatggcttattaatgggtaagttttataaaaatgccaaatgtaattgaaaaatgtcttggttgcaggttccatagtaatgaaatttgtcatgaaaatctatygacattgtgttacaattataattaaatatatatttgattaaatcaaatgaaattgccaacatttaatctttttttacttagaaagttcaactaatatatgaacaatgttcaaccaaattttaagaaaaattttatgtagtaaattacataaaattacttattttttatttgaaaagcttttatgttttctaattttttgtctgtttatcagtttctaataaagttgtgtttaaatttttcattacagttgcaggctatgttgtgttaggttgctgggtatatacaatccaataattgatttgtcttctagctggattgtacttttaattattatatgtcctttattatatccattattgttttgaacatggattctatttttctgacattaacataacagctttgagacatcagtatttgcatgacgtatccttttcaccctttaattttggaccatttttatgattttataaattatttcatttataataagtatatgtctggattggctgggtgtggtggctcatgcctgtaatctcagcactttgggaggctaaggcagacagataatcagaggccaggagtttgagaccagcctggccaatatggtgaaactccatctctactaaaaatacaaaaatgatccaggcatggtggctcatacccgtaatcccagctactcaggaggctgaggcaggagaatcacatgaacccaagaggtggaggttgcagtgagccaagattgagccactgtactccagcctgggcaacagagcaagacttggtctcagaaaaaaaaaaaaagtgtatgtcttgactttaaaaaattcaataaactgacctgtctttttttaaaaaacagccttttgagggtataatttacatatcacagagttcacctatgtaaagtattcaatggttttcaatatattaacagagttgtgcgaccatcaccataatctaactttagaacattttcttcatccccaaaagaaaccttatatctgttaccagtcactcctcattcccctcccacccctacccctaccccagcattaggcaaccacttatttattttctgtccctatagatttgcctatcttggacatttcatgtaaatggaatcatacagtatgtggtcttttgagaccgtcttctttcacgtagcatgattttgaggttcatctgtgtagcatgtatcagtacttcaatctacatacatttaccgtaattactgaaccgtttggactattttcaataatattcatttatgttttctgtttgttatgctttttttagtttctttagttttttttaacttttgttggattgatgacattttctacatacttagtttttaatcctttgcttatttagaaactatagattttactggtactttttcattgctttttcttaaaattttcagatattggttgaactttgttcagatattagttgaactttgtaattaaaaaatggttaaatattggcaatttcctttggtttaatcaaacatatatttaattatagttgtataaatatgtatttaattataattataaaacaatgtcctcagattgtcataacaatgaacttaacatactttatctgcatatcgaacaccttatcttgtgttcaagttacactcatatctacatactgtgtagagttttaattatgttcttttgaaatataaaaggttatacttggtatcaatatttgattggccgtcctgacatattttgttaactcttgtgctcacccttgtttctctctttcatggctcccttctggatactccttctggctaaggcacatcctctagttgttgttttatgcaggtctgtaagtgtaaaccctctgactttgaatgtctgtaaagatgctgaataattttttggctcagtgtaaaattctaagttaaagattacttttttttctcatcactttgaagacattacgccactgttttctagcctctattgctgatgagaaaacttctgtcagtctgttctttatatttgaatatgcattttcccctttcacagtgtttaggatggattttgtttattcttgatgctttactacagtttgattcttgaacaacacaggttgcaactgtggaggtccacttgtatggggattgttttcaaccaatctcagatgaaaaatatagtattctcaggatgcaaaaccagtggatatgtagagccaatttttcctatgcacaagttctgcaagccaactgtaggacttgtgtatacctggattttggtatatgcaaattttggtatacatgggagtgctagaaccaatctcctgcatatactgagggacatttctatataatgtatctaagttttgactgatatctattccaatcaattcttggtgtctactgttaatttgaagaatcaggtaattgcttctggaaaattcttagcaattatctctttaattattacacttctgtcattctccactctctgcttctgggattccaattaggtgaatttagaagattttcataactcccccttyctctcttttatttgtacatgtgtgtatatatgtatgtaatacatatcacggtctcctcctgtgacctccatgggtctgcatttcatcataaggaatagatgcttcaatggtggccagcagtttcctcagggtcttctcagcagtgcatggggcccacattagctcctctggctccaagcgaagagatggtctctagmcccctgtttgatttggggcacttacagtcctctcgccagctaaactctcacactcgtcagcatccagacrctgaggggaaaataccagctgcttctgtgctctgcttactcttcggtacttctctgccatttctggttcctgaagatgtttatttttatttatttgagtctgactgtatctctttttaaaaacatgttatccaccattgctatatatttgaagcagagaaagttagtgaagcataaacttcatgctgaatcgagtgtctatatcctggaattctcagcctgtamccyctataaactaatttttccactgtgaataagactaatcatgactctgtcgacatttacattttatttagaaaatgtcttccttctgttcctttgatccaagcttgactcaccttaccttgaggttgcatttacaaaggaacactgaaggttacccaacagtatgtgggtgtcgttcatcaactacagtgactcaagaatatcaccagttggtttgcctttctcatggttttaatgttttctcattaaaaataaataaagcacagataagcagaaagaataaccrtccatccaacaactagaggaaaatttatcaatggttttgctttatctttcctataattaagctataaaaaacaaccatccatgtaacaactagagaaaacctttatcaatgactgtggcttatctttcctgataattaggctctttcagggagttattaaccgattttaaaacttttgtctgagattgattagtaaagattatttcttgaaccaaattgttctttcgtttggctactttgattaaaraagaaagaagagataataattgcaatgattcttttattttattttatagggtcgttggctgtgggttgcaattaccatgtctgactcagtaattcttcgaagtataaagaaatttggagaggagaatgatggttttgagtcagataaatcatgtgagtggcttttttccctcactgcatcttgtacaaggagaggtgagaacaaaagtaggacaagctggtcaagtttcaaggagcagaaaaaaatcagcaacagtaggtagaagtatcattgtgtgtgattcttatacacaactgtgtggctctccctagaatccatgtaacgtaatatctgaaagcactaggtaagaacacaccaagtgtgtgtaaatgaaagcatctctcaccaacacctttcctagatagagtagggttgttccagtggtggctgttatgactacctttagtcctgtattgttattattaatcataattgagtgagcgctcctccttaggaagaactgtgcccagactctgcagaccagaatgagatcatgtggagggggcctatagcactagcacctgggatgtcctgggctcagatggttctaagctattgttttctaaccctatgattttacattttacagatgacaaaactgagacttggatatgtttttgaaacttggcaaggaactcatgagtaaaattaatggaaccataattctaatccagttgtgtttgattcccaagcccaagatattgccgtctgtcaacattatcatgcttctttactttaataagagtaaacaggcatgatagtgttgaatgacaaagctccctagtggcttccttacacccctggctataatcactgactttcacctcctgccctgcatctattctgacctacactggggaaaacagtatgtggtctcaatcctatggcttctactagtgtagaagtgttaatgacatcttgttattaacatcttattgttaatttgtggtctatattttaaacagataaattctgatgcttttaaagaaccagacaataaataaatatcaattttattttgtagttcaaaaagttgctgtccatttgatattcagatgatgcaaatatttcatgtcctgaagaaaagtccataaatgagtaaaggtagcagcactcctggaccctaaacgagtgtcttcktgtgtgtgtgtgtgtgtgtgtgtgtgtgtgtgtgtgtgtgtgtagaaagatagagagagacaatatgagcaggaagaaagaaaaggcaaatagtcatttgctaatattccatgaataaaggtaatttataggaatatttttctagagcaaatttcttaatgactgcgttgcattttgtcattattattaactgcttttttgcgttgatttttttttctgacagataataatgataagaaatcaaggtaagtgactgatttcaacaatgcagcatcttttctagaataactccataatattcatatcaaaggcacaaagcagagaataytttcatgcacattgcacttcatataaaataayatatacaatccattctttttctctttaaaatattactataatttgattttaaaaaccttttggaatatcccttctaggttaggttcaaatgtcccctctgtattcaggaatggcacagaactcctgacctaagagggaggaggaaaagttgaacaacaagtataatttcatgggcattggagaggtctctaaaccccaaattcttgccacaggcaaagagtagagacctaaagtgtcattattgcatatttctgttcagctaaagattttgaattctcatatagaacacatatcagctaatcacagtctggtatgaaggcgggattagatgaggtctaatttagaagacagaagtgaggcatcaggtaagttcctgaagtggaggtggtggaaacggaagggttaaaggtattttagaaattttaagtaattcacagcagagggaggaagtgggagtggtaagattagctttgggctgggagtggtcaggtcagcctgggcctctgagagccacacgtttcttattgcrtgggaagtttaaaaaatgggtgtggatgtagatgaatggcaaggagaggatgagtaggaagttgaatgagttgctttgtttttagaggaggtgagcatggaatgagaagatcacagcaaattttgccagagctgctgagaagaatgggagcaatccgcagagaaatgaagtgtgcattgcatgttgagctggagagcacacattcactccattaattcattcgttttgcaaatattgagtgtctatttggtatcagacactattgtaggtgctgcgggtatagaaaagaacaaaataggcaaaaatgttggcccttgaggagtttacattttagtgagggagatataataaacattgtaaataaatcaaatgtatagcatggtagctagtgataatctatcactttctttctgagaaggaaaaataaactggaaatggagctatgaaatggtgcgtggggggtggggttgaaattttaaagactttggccaggcaagactctgttgagtaggtgatttcaaaggaaggtctagcggaggtgatggagctgtccctgtggttacctaaagaaaatgcacctggggagaaggagtagcaggtgcccgcacccagaggtgggaacagttgggcatggacaaaggtcagcaagaggccaggcaagtggggtgttgagaactagaatatagttggaggaggtgaggtcagagagccaagggccagaccgtggggagtctcagaaaaaatttaggattcttttctgggccagaagggaagcttagggcagctgagtactagactctgcctgtgttggtatccattcacaaggtggtgaggttgtgtccagcaggcccagcagcctggcttaaggagaagagggcaaacagctggatggatgcaggatgaagtttacaaggatgatgtagagaaaataattgaggatgatggtgagagtgtggttcaaatgcctggcagagggaccttggctgcatggggaaggaagcaaaatcttaatggggtttagcaatggaaggaaatgaaggatttaaaggactgcatggctcaagtgaggttgacaaataggtgtggaaggaggaaggaagygagaaaatgaggtacatgggcagtcacagagtgccaaggagttaaacatgtcagacagtagttcctggtgacagcaaggtccagggtgtattcatggactgcgtgactcaggttaagtcaagatccccgaagttgwagaggtcaaatacaggttaaacatggccttatgggaaatgaaatgaatgggaaatattaaggaaatatgattctrtgaaaagtgtgggcatgttcttgaatttttcatcattatcaacattatttaatgtagttgtaatatttttaagcatgaggaagctttaaaattagctaatccaaccacttcaacttacccatgaggaaatgcagtcacaaatagattgagggtcatgactgagggcaaagagttatttgttggtataactgggagtatagaggactttttactttctctccatacctctcaggtgttcatctctgtgaatcgctagtgaacctgagattgagctatactgaaatctctagaagagggaaatctagaagaataaagcttgtgtttaagatactaggtttggccagaattttccagccagtggggattttctttcttactaaagaataactcataaaatcaccacctagggagaatttcccattgtattggaaagggtggtctttaaatccttatgtttttctcatcaggttacaagaygagaagaaaggtgatggcgttagagttggcttctttcaattggtaataaaactgtgttgatttatggcagtgggtgtgcagctataaattgtttagatcatgaggggagtgttaaatctttagtcatattggcaggtttttaacttcagtgatcactttttcagtcataggctttgcctatgtgataacatgctgaataactattagaaatatattgctcataaagcatacaaatcctatccaatagatcagaaaaatgtcttggaaaattatcactaagcccatggttatcatatttgtaaggaaagtcatcacaacaatcacatatatatatttattcttatgacaaatctttagaaattttaaagtataggtgtttactccaaattttctcaggatggaggcatttctaggcagaaattggcattcttcatagtcactatcagttcaacaaaacaatttatagtatttctcartgccccacacagtttatctacttggcaatggcatcaatgacagtgattattttcccctaagttgtagatgagtagctaaaaackaaagtcagctcctgaaataaacagaatgaattcagagagcaggaaatttataacatgatctaacaatgtaagagtctaatgttttagataattgatgtaccgtgccgtttatttcaatataattagtatacgaactctgccactcaattaaggtgattcccatgaaatttggtgttgagtactattcatgagaatctagtaactaaattaagtagtcctcctacctctcctgctcttcacccatagatgatctctgaaccctttgtttttcaagtttcggttttcttcatyaactgayatttggctgatgtttgtgggaagtttgtgtgcatttctccatggaatagcccagccaggcgtgctactcatttttggcacaatgacagatgttttyattgactacgacgttgagttacaagaactccagattccaggaaaagcatgtgtgaataacaccattgtatggactaacagttccctcaaccagaacatgacaaatggaacacgttgtgggtaggttrtttttgtttttaattttttacttttttgctcatatcttaaattgtaattcaaaatgtatagaggggattttactggctgagstggagtggtatctaacacaaagagaatagaaacatgagtttacccatatttctagaaattactctgcctcaagtttccttctatcttactatgttttaaaatcttaatagaaacaggattgaaagtcactcaccaaatacattgccaaaatgttaccactttattgagtataggcttgagcatgacactaccaatacttaacgtcactagggaggtgacccatgaattttacttgagtatcatctccaagagttctatttttcccccccaccaactcccctctgccccttagctttgtggctgtggctggtgatccacttgatcttaacccttccatctgtaatgggaatttcatgaacaggctgcattactttgagtaaggtacactagtctcaaccagtagttgagtttgtttttttcttttttcttttttttttttttttaagatggagtctccttttttgcccaggctggagtacagtggtgtgatcttggctcactgcagcctctgcctcttgggttcaagtgattctcatgactcagcctcctgagtagctgggattacaggcgcccgccactatgcccagctaaattttgtatttttagtagagatggggtttcaccattttggacaggctggtctcaatctcctcaggtcatctgcctgcctcagcctcccaaagtgctgagattacaggcgtgagaaaactagggcagtgctgtgatcagaggcaaccacgcagaagtagccagaactcacacagacacagtcactatgctactgttttctttgtgataagcctgacaggccaccttgtaatcagtgagtctgtcgtgtactcagggctgactcactgtcatagcrtggcctttgcagtgtgcctcatgctggctcaagttcagaacagcttatttgcacataggaacccacatattcaggttcaagaatcaagggtggggcacatcttggctagaaagacactaggaatggctccctcagaggaatttatagttttcaccttcatttttgaaattttctataggcttgattccagactatgaatgagtccttctaaatcattgacactcttccataatattatctctcttagggtctttcattcatttactcattcaaccaaaatttttttaaacatcaaatataccaggaactcatgaaagcatcaaggacacagttgtcttaagagcatggtcctagccaggtatggtggctcatgcctgtaatcgtaacactctgggagggtgagacaggaggattgtttgagcccagaagttcgagacaagcctgggcaacatagtgagaccctgtctctacaaaaatttttttaaaaaatagcttggctttgtggtgtgcccctgtcatcccagctacttgagaggctgagatgggaagatcacttgggtctgggtgtttgtgrctgcagttggctgtgattacatgggtgacagaatgagaccccatctcagaaaaaccaaaagagtcatgatccctatctgtgtgaagcttaagcctagtaagccatcattcagtcaatgatcatttaaaaacatatgcagtgacagacttggaggtacctgacagaaaacacaggataatatacaatgtgaattattctttataaacaacaagcctacttattctatataagttccctaatgtctaaatatgtatgtttcttttctaaaattggaagtttcttttcatttgacaaactcagagcaatttgtataaaagagagattgagttcaacaaaagtctttgaaatccttcatttatgcgggaggacagaagtgaactgctttttacagaggggtttgaccacaaaacataagattaatcattctccccttggagaaaaaaatgcattcagacctatgtgtgatgtaaattgacccaagccacggataacacttatgaggataagtttttgaggaaaaggtcctcaagtatatcttatcatgccttaaaatttggaaataaatgtgagaggagccaaaatttgaggcatatacatgatactaggtgcttatgaatatttatccaatgaattaaagaatgaatctactttcaacatttgcatcatagccatctattaaraaggaattctctgtggccactcattactcactgtcttcattgttactggatcacatacctgaaggcgagcaaagaatacaaactgaggctttcagaagtccactggctttggctgaattcacgtaataccaaatgtgaatggacatttgtccttttctttttaaaaaaattcatacagatagctgaaattgtatagactatacctttctaggcatttctttaccaggaactccttgatgagttaaatactgtcatcgtgagttattgtgatcattgacatgaatactatttgttctattctgaataacatgtttgtttagctgttttatggtaagatcaccgygatcttatgacttgggtgggacagaggagaaaagagargacatttttctacctgtaagtagtttatatacctccaaagtcgcccaaactgtttgcaggtttctttcgtggaaaaagtatatcattaaaagtacagtttctccttttattacaatagatgtattagccttagaatatacaagacaacccaataattttagcaacaaaagcatgtgtgtgtaatgacaggagctggttttactattttattatattggtttccacatgtcaattgtaatctaktagatggaatttttaagttaaagccttccagatggctgtcagtgaattacactgataaggattacagagtgtcaggtctcttgattagcttatcagaatttctggtcagaacagtcgaataatagataaaaaaatgaaagcagatgaaggaataggaagttaaaataccacagttgcaatttcattttattttcttttatccaattaaagtgtaaacactcaaatggaagccacaaagtctcgtgtaacttaattgtagaagagacatactgtaatttctgccatattctatgggtcacagaaaccaaccctggtgtaatttggaaggagtctaaacaagtgtgaatattgccagatgagaattttaggggctttttggaggctgattactactgcgggcattggggagctcaagtcttcacttcctctcatacagataaatcaatgcagaaatctaggcctgtcctttcacttggatttcagtctatgttcttagcaatatatattcagtttgtataagcaagcactattttgtagctagacagtttaggctatatacttttgtaatggctttgttgagatacaattcacatactataaaattcacccactcgaagtgtacaattagatgttttttagtatatttacagagttgtgcattcactgccacagtcaattttagaacattttcttttttttccttttttttaattatactttaagttttagggtacatgtgcacaatgtgcaggtttgctacatatatacacatgtaccatgttggtgtgctgcacccatcaactcgtcatttaacattaggtatttctcctgatgctatccctcccccctccccccaccccacaacaggccccagtgtgtgatgttccccttcctgtgtccatgtgttctcattgttcaattcccacctatgagtgagaacatgtagtgtttggttttttgtcctcgcgatagtttgctgagaatgatggtttccagtttcatccatgtccctacaaaggacatgaactcatcattttttatggctgcatagtattccatggtgtatatgtgccacattttcttaatccagtctatcactgttggacatttgggttggttccaagtctttgctattgtgaatagtgccacaataaacatacgtgtgcatgtatccttatagcagcatgatttataatcctttgggtatatacccagtaatgggatggctgggtcaaatggtatttctagaattttaaaacattttcattactagaaaaagaaaccccttgcccctcggccatcactttctagtacctcatcctcctccctatccctaggcaacactaatctgctttctgactgtagatttgcctattctgaacatgtcatattaataatatcatataatatgtgatcctttgagattggcttctttaacttaagcatgtgttttttgcagttcatccacatgtatttttattgctaaataatatttcgttatatggatataatacatsttatgtatctgttcatcagttgatggacatttggattgttcccacttttgagctattacaaataattctgctgtgaacatttgtatacagatttttgtgtggacatgtcttcatttctcttgggtacatgtctaagtgtggaattgctgtatcacatggtaactctatgtttaactattctaggaactgccagactattttccacagtggctgcaccatttacatttctgctaacagtgtatgagggttctaatttctccacatcctcaccagcacttgttatttagcatctgtgatatctctcataggtagaataatgacccccaaagatatccaggtccttatccctagaacctgtgaatgttaccttgtatgggaaaagggtctatgcagacgtgattcagttaacaatatcgagatgggggagactatcctggattatccaggtgggccctaaatgcagtcatgtgtgttcttaaaagggwtggttgctaagaagaaggcagagggggatttgcctgtagagagaagagtagaggcaaggtgactacagaaaaaaagaatggaatgacattgccacagccgaggagtgtcagcagctatcaagagctggaagaagcagggggaaatttctctcttagggccttaggagggaacacagccctgtcagcaccttgatttccacccagcgaagctgattttgggcatgtgaggggatacatctctcttgttttaattgtggtaattgttacagcagtcataggaaaccaatacaatagccatcctagggagcaggaagtggaatctcattgtggttttgatttgcatttctctgaggaccagtgatgtttggcttctttttaggtgcttgttggccatttgcacatcttcttcagaaaaatatctattcagatctttcatttggaaataaataatataacaaaatatgtattcagccctttttaaaactgggatatatgtctactgattattgagttgtaggaattctttatatattctagatataagttccttatcagagatacaatttgcaagcaatttctctcattctttgggttgtctttctaacttcttgataattatctttgaagcactgaagtgtttaattttggtgatgtctagtttgttcttttgttgcttctgaattggtgtcatatctaagaaaccattgccaaatccaaggtcttgataattacctttgaaccactaaagtgtttaattttggtgatgtctagtttattcttttgttgcttctgaattggtgtcatatctaagaaactattgccaaatccaaggtcgtgaacattacacttgttttcttttaatggctctggccatgtgaagtgccagcttccccttcatctttcagtatgagtgtaaatttcctaaggccttcccagaaacttagcagatgctctaatccttcctgtacagcctgcagaattgtgacccaactaaacctcttttctttataagttacccagtctcaggtatttctttatagcagtgtgagatgaactaatacactcacggttagtctacgatccactttgagtaaatttttgtaggggtgaattaggggtccaaattgattcctatctgcatggatagccagttgttccagcatcatttgtggaacaactattttttccccattgattaatctcagaatccttatcaaaatcaatttactgtaattaagagggtttatttgtggactctcaatgctattccattgacctacacatctatctttatgccagtaacacactgttttgattaccgtagttttatagtaagttttgaaatcaagaagtgtgattctactactagggattgtctattctgggtctcttggattttcatataaattgtttaacttctgcaaagaagtcagctagaatgctaggaattgcattgactctgtagatcagtttaaggaatattgccgtcttaacaatattaagtcttctgattcgtgatccacttatttgcgtctgctttaatttatttcaacaaggttttatagctttcagaatattttgcaattttttgttaaattgattgctacgtattttattatttttgatgttatcataaatggaattgttttcttaattttattttcagtttgcccattgctactatcgcaaaatacaactttttttgtatattgatcttttatcctaaacctagctgaactacttatgagttcaatagttttttagtgggctctttaggattttttatacaagaccatatcatctgcaaatagaaataactatacattttcctttccaatctagctgccttttttattttattttattttattttattttatcttattgcctaattgttttggcccaaacctccagtacaatgttgagtagaagtggtgagagcacacatccttgtcttattcctatcttagggggaaagcatttagtctttcaccattaagtatggcattagctatgactttttcacaagtgtcctttattatgttgaggaattcccttctaatcctagtttgtagagtgttctaatcattaagtcatgaattgagtcatgtgcttcatctacatctattaagatgatcatgcagttttgcccattataatattgatatggtatattacatcaatgtatattcatatgttcaattacctttgcactcctggaataaatcccaccaggtaataatgagtaatcattttactatgctgcaggattcaacttgtttgtatttagtgaagatttttgtgtctatattaataagagatataatatataagagttttcttctcttataatgtctttgcctgcttttggtatcggataattctggcctgatagtttggcagtgttcccttccattctgttttttgaagagtttgtgaagaattggtattagttctttaaatgctttgtagaattcttcagtgaagtcatctcatcttagactctttgttgttgaaagtttttgattgctgattcaatctctttagttgttataggtccactcagattttctatgtctttaaaaatattttttaatttggcacataaaaattatatatatttatggtgtgcagcatgatgttttgaaatatgtatacattgtggaatggctaaattgagctaattaacatatttactacctcacacacttatctttttttgttgtaagaacactaaaaatctactcttggcttcaggcttcctgggatgccaaaaaactgtgtgtccgcttgctttctcaatggggaggcttgtggtctggggcaaattttcagccctggtcactggctgcctggaaatagattcagtgctgttgttgggggcacggtgggcatgagattaacctctagtactgcgggctgagtgggagcaggttaaggcctgtaactgccagctttcccccacttccctagtgacctgtatgacttagcagaggcagccataatcctcctgggaacataactccattggactgagaaccacacccccatcccccacagcagctgcagcaagccccgcccaaggagaggctgagctcagaggcgcctatccctgcccctacatggtggtctttctctacctgccctggtagccaaagacaaaggcccaattctcttgggaactctgtggccctgcccactgcttgggaaacctgaatasataaccaggtgtcctgagggcaactttgcattctccctataggaccatagctgatgcactcttgaaagtgccacctcctagctagaggccaaccaacataaaaccaacacactaaataaaaacacaacagaggaccttcacggagcccacttcactcccctgctgcctccaccaggtgcaggtgctgttatccacagctgcaagaactgaagacagatcacatcacaggactctttgcagactcttgccagtaccagcccagagcctggtaactttgctgggtggctagacccagaagagcaaaaacaatcactacagtttagcttaccggaagccccattcataggggaagggagagaacaccacaccaaggaagcacaccatgagacaaaagaatctgaacagcagcctatgaatcccagatcttccctctgacatagtctacccaaataagagagaaccagaaaagcaaggttctttaacaccctgaaaagatcataccagctcaccagcaatggatctaaaccaagatgaaatctctgaattgccagaaaaagactttagaaggttgattattaagctaatcaaggaggcaccagagaaaggttaagtccaactgaaggaaataaaaaacatgatacaggatatgaaaggaaaattcttcagttaaatagatagcataaataaaaaaacaaccacaacttctggaaatcaaggacacacttagagaaatgcataatgtactggaacgtctcagcaatagaatcaaataaacagaagaaagaaacttcagagtttgaagacatgggtttcaaattaatccatcaaagacaaagaaaaaagaatttaaaaaatgaacaaagcttccaagaagtctgggactatgttaaatgaccaaacctaagaataattggtgttctcgaggaagaagagaaatctaaaagtttggaaaatatatctgaaggaataattgaggaaaacttccctggccttgctgaaggaagatctyttgtctagggatgtagacatccaaatacgagaagatcaaagaacacctgggaaattcattgcaaaaagatcatcacctaggcacatagtcatcagattatctaaagtcaagatgaaggaaagaatcttaagagctgtgaggcaaaagcaccagrtaacctataaaggaaaacctatcagaataaaaacagacttctcagcagaaaccctrcaagctagaagggattggggtcctatttttagcctcattaaccaaaacaattatcagccaagaattttgtatccaatggcacttaacttcataaatgaaggaaagatatagtcttttccagacaaacaaatgctgagggaacttgccactaccaagcaaatcagggaaatgcaaatcaaaaccacagtgtgttatcatctcactcytgcaagaatggctataatcaaaaaatcaaaaaagaatagatgtkggcatgaatgtggtgaaaagggaacacttttacaccattggtgggmatgtaaactagtacaaccactatggaaaacagtgtgtgattccttaaagaagtaaacgtagatctaccgtttgatccagtaatcccactactattaataggcatgtacccagaggaaaataagtcattatacaaaaaagatacttgtatatgtrtgtgtatagcagcagaatttgcaattgcaaaaatatggaaccagcccaaaggcccatcaatcaacgagtggataaggaaaatgtaatatatatattacgtatgatacagatatgatatatatgtaatatatattacattttatattactatatattacattttaatatgtttttgtgtgtgtgcatatatatatatatgcacacacacacacacacacacacacgcaccatggaatactactcagccataaaaaggaatgcaataatggcatttgcagcaacctggatggaattggagactattattctaagtgaagtaactcaggaatggaaaactaaacggtgtatgttctcactcatatgtacgagctaagctatgaggacacaaaggcatgagaatgatacattggactttggggacttggaggaaagggtgggtggtgaggaataaaagactacacactggatgcagtgtacactgcttggatgatgggtgcaccattctaaaatctcagaaatcaccatcaaagaacttattcatgtaacccaacaccacctgttccccaaaaacctattgaaataaaaattaaaattttttaaaaataataaaatgtacattataaaacaaaaaaaataaaaatctactctttcaataattttcaagcatacaaaacattgttactaactatagtcagcccagtaaatttcttgaacttattcctcctaattgaaattttgtattttttaaccatctccctaatctccccacctctagcccttagtaactaccattttactctctgcttctatgaattcaaattttttagatgtcacatttaagtgagattacactgtatttgtctttctgtgcctggcttatttcacttaacatgatatactcgaggtgcatctgtgttgttgcaaaggacaggatttttttaaaaggctgaataatattccattatctatatgtaccacattttctttatccattcatttgttgatggacacataggtggctattgtgagtaatgctgcagtgtgcatgggagygtagatatctttttgatatattggtttcattttccttggatatatacccagtataggattgctaggttatatagcagttctatttctaacttttkgaggaacctacatacatatttccataatgactgtactaatttacattcccaccaacagtgtacaagtgttcccttttttccacattcttgccatcacttgatgtcatccttcttttttataataaccagactttgcttcatgtgttttggaggctctttttttaggtgcatatatctccataaatgttatcacttcacgatggattgacccttttatctttacaaaatgatttttatctctagtaacaagtttttaaagtccattttgtctgatattagtatagccactcctgggttcttacggttgctttttgaaatgattttgtttttctatctttttgtttcaacctgtttgtatctttggatctaaagtgtgtctcctgtagacagtacatagttggatcttgttttatttaatgcaatctgacaatctctgtcttttgattgtattgtttaatccattatatgtaaaacaaacataacatcctgaaaagtggggggaaaaagtcaactggctagagccctcaggagccaagtaataacatgttgataagttccctgggtatcttatgcctgatatgtactagattaagtgttagaaaagctggcaaactggaaaccccaatgagtgcagaccaaaaagactcaacaaaatcctgctttttctagatagtgggtcagaaagagaaagcctagtagaaaacttctaagcaataattgctctactctagccaaacaccacagaagaaaacggtgacctcactctcacccatgccagcgaatgttgatttgggagcatagactcttccacacttgctaggtggtaataagcccctcttgtgccaccccctcactcacccccatggtgtcaatggagaatatgtgggaggcctgactcatccccactatagtaaggcacctctccccttacctgctgggttggggtgacagagtcaaaacattaccaccaccgccatggaaggggaaatcaagacattttcagatgaaataaatcaagagaatttgttgccagctgacttaccccaaaagaatggctaaggaatgttctttaagcagaaaggaaataataaaagaagtcctagacatcaggaagggagtgcgtagtaacaaaactatgagtaaatgcaatagaccttccttctcttaagctttctgaattatgttttatggtagaaactctaacactgtgatatgatcctactctgacactgtctgatgtgtgtttaatttggaaatagataagacacttattaacgaaggagagtagaggtatgtaatgggaggtaatctttatatatttcacttgaattggtaaaatgacagcactagtagactgtgaaaagtgatgtatctataatgtatttcctagagcaaccacttaaaaagckatacaaagagagacacttaaaaacgctatagataaatcaaaattgaattctaaaaaaatgttcaagcagcccataggaaggtaagagaaagcaaacacagaaataacagagagaacaaatagaaamcaagaaagaaaatgacatatttaagccctaatatatcaaaatataagcaagattttttgtagatatagaaaagattaccctaaaatgtttatgaaaatgtaaaaaaactggaatagctaaaataattttgaaaaagaataataaagtgagaagaatcaatctacccaatttcaagacatattatatagctaatgcagtcaaggctgtgtggcattgacagaggacagatatatagaccaatggaacagaatggagaactcagaaatagacccacacaaatatgtccaattgatttttgacaaaagtggaaaaacaattcagtgggggaaagataagctttttatcaaatggctgtggagcagctggacatccatagggcaaaaaaatgaaattacacaaaaattttcttaaatgaatcatggacttatatgtaacaaataaaactaaacttttagaaaaatatggaagagaccattttcatgttctagggctggacagagcatgtagatgacaccaaaagcacaattcataaagggaaaatttgataaattggacttcaataaaattaaaaactttgtaaaagatcctgttaagagaatgaaaagacaagctactgactgggagaacatatttgcaacttgtatatccaaaaaaggactaggatcccgaatatataaaaaattctcaaaactcagtgttaaaataacaatagcaaatttcagttcaaagatgggaaaaagacatgagtaaggacaaaagatggcaaatgagcacatgaaatatgttaaacaacatcaatagagaaatgcaaattaaatcaaaatgagatattactatagacttattggaatggctaaaattaaaaatagtgataaccctaaatgttgatgaagatgtggaagaattggatcactctaccatcactcatgccattcaaaccaygtcatagctatcctggaaaacagtttagtaattaaaaaaattctaaacactcaactaccatatgactcagcatttctactcttggggatttattccagagaaatgaaaacttatgctcacataaaaacctatacacaaatgttgatagctgcttaatttgtaatagataaaaattggaaacagcccagatatcctccaaaggatgagtggttaaacaaactgtgatccatctatctatattatatggaatcctccttaataaataggaatgaactgttaatgatgaaacttgaaagaattatgctaagtggaaaaaagccaaccccaaaaggttctacactgtgagatccatttatatgacattcttgaaatgacaaaattacagcaaaagaaaacagactggttgtagctggggctaaggaggatatggggattggatagaagcatgtggagatataaaaggacaatatgagggagtcttgagatgatgagaatgttctgatcttgattatatcactgtcaatatcctgggtgtgatattgtactacagttttgcaagatatttgcaagatatggctttagtaaatctgtaagcttgatgtgtaaattgaatgacaaaacaaggtaaaatgaaaaaaaaaaaggtaaaaagtttccaaaacaaggtaaaaagaaacaaaaaagcaaaataagtcctcatgtcataataatttgtaaaacgtctctttatcttttttcctctaatgtcatctctctcccttctttgctattcaacaaatggggaatcttaattcattcaagtagattcaggtctgtttttgctgttaaaaaaatgccattctgtggtccaaatcacctgcacactttatagaatccttcctggggttttatgatgacaagtgttcccaacattcaggcaataaagaccttggtatgcagtcaagggagcaaagccaggcctgctcttttccttcctgtcagtttttctgataggttttttctgttgttccagaaatattatcaagttctctaaagccttaatcacctcttcttcccagaataaaataaaaatgagttaaccactcatttcagagacaccgcaggagtgaagagagtgataaactgcatatatctttatctgcaccatccagcagtgatagaattatcttgacctttgttccagaaaatcccagagctgggccagtgcccaacacccttaatccacatatgtttgtaaactggcatttttaatgacagtcgcttcatcacttccgcttacagtgcttgtagaataaagacaccacaggaaatttaagttatttattrttatcattttaattgtcacataagtatacatatttatgggatatagtgtgatgttttgatgcatgtatacaatgtgtaatgatcaaatcgaataattagcatttccatcacctaagacatttatcatgtcgttgtggtgaggacattcaaaatcctctcttctagctcttttgaaatagtcaatgtattattgttaactattatagtcacctactatgcaatgtagtaccagaacttattcctgaacagtaactttgtacctgttgaccaacctctccccatccctccccctccactgctcttcccagcctctgttaactactattctctaagtaaaatgtttggacaaatgcttatagttttctggtttgggacaccccaaaacaagctgaaaatgaagagaattgactcatgtataccttagaaagcttttacttataataatatagtatactctctgttcagagatatttagcttttataagagcctctgattgtggatattcatcgataagtttatgattttctagttcttgttcatctcagggttcttcttagtcatcatgaaagactgggaatgtggtgagcacaagagaccttagctggttttgaggttgtcagaagggttgaccacagcagttatttcccttcctaattagtattttgaaagtcaaagcaaaatcaggaaacatttattgatttcaggcagagtgaccaagcagtgtaagcccagcccttgaccttgagtagcttgcaatctactagcaagacaagcataaatgtactcaatataaatatattcaataaagatattgactaatagtgcagtttattctgtattaaatgaattatgttgcaatgcttgacctgagttcaatagagaaaaaaaatcaagctcaagccacaaaaagaaggctgacagagagcggaaaggatgtaggatgaagaacccatgctgaagaggctgcttgctgattctctaaagtagactctataccatttaacttgtccctgaagatcataactgtcatcaaccaatatgttaattttctaattatggaatgccttcattcataaaagcaatttcagaatttttttttcctccactccctggcactgccaatcccaaaccctgtgcagcaacatggtagtgctgctgggaaaaatgccaaagtatttttctttgctatttttcttcttgctatttcccacaagtgtctttggcttcaaccttagaaattgtcctggtgaatgaacttaggctgtagtcagcaaaaagacagggctaataaaatgcttttctctcccatgggaagataacaggcacatttttcagtgtcactctgagatagagaagttgaaaagctggctagcattcctagaagaggtaacagtaagcctcctgatttacagcacacatcgttctatcagtttcttttcagacagcctgtctggcttttgaaaatctttcttrcctgtgattgctctatcactgcatgatgagtatgcatggaagagactaaagtggaccaagccctgggctgccatttagggtaccctggcttccaacaactgctaattaattatttcatagtcctagcatctctgcctataaaaatgaaggggatatgcatattttctgtgattggtaccatgaggtctgtttagaaatttggttggayttattataattttgcatagataaaatgtcttactcatgtctaatagaaatatactatatatagtatatttattatatattatatatatatttaaaatatatatattttttaaatccctctatatccacaaatgtaatctctggtggcttgatcctacttgcaagtctgaacattcttttccctcttttgaaggttgctgaacatygagagcgaaatgatcaaatttgccagttactatgctggaattgctgtcgcagtacttatcacaggatatattcaagttagtagctcctccgtataatttatagatcaatatctgacctcaaagacactacaatgagatgcaatgtgttgccactctttaagctaatcagaagccctaagaactacagtctgtttccagaggacatgagagaatggagagggattcttctctcagatggaaacttaggaggatacaagtggctgtccagagagatgcataatagactcgtagttgtaatgtcctgtcctccccctgcctttccctacttcatcctctyttctatatccagaaatggacatttgcaggtgtgtttgtagsgggcagttgagtagcttgaagaatgtggggcagggggagatagaggaaagcaaaatttactttytttttctcgcattgstaaagtctcaacaaactgcattccaacccaaattytgaaaggctgaatctagagcatattttagatttaagtgttggaagggcttggaggtacttaactcttattaagaaagaaaaatattttatcttttgccttcttttgtagaaaaataatgaattccttcccattcattcaagaattccacacagtgctgtttgtaaagagaaatgaatcattttttcccatttaggcattgggaattttaatgacaggcttttttttttttttttttttttttagttagggaaaatctatcagcagattagatttttgctgatgtcataatttttgttttacatttcttgaaaattattgcctgaaaactatgcatgaatgcttctaggcaggtctttccgggaggaaattcactcaraaatggcattaaaaatagttatttaaraacaataatgccttatttttggtgctgtgagccttctttcacacatggggaaagtgaagctctgtagggtaaagtccaraaracatgggcctgcttaagtgtcaragctggattcaaacccaaatctcaggctaccctgctgaaggttctgtttacctccacttttagcagcagatgacagagctcacatcttagttcccaaraagaggcattttctgaattactttcccccttttctcaactgttgtattgaaagtactttcttctgaaaaaagaaattaacaaatatttcaaacattgcaatgctaaacattcctttgtccatttccagatatgcttttgggtcattgccgcagctcgtcagatacagaaaatgagaaaattttactttaggagaataatgagaatggaaatagggtggtttgactgcaattcagtsggggagctgaatacaagattctctgagtaagtagctggtaaaacagtattttagtgtgtgatttttggataataaaacccttgtttctaaattaaataaaaatttaaaaatattttcagttttcctatgtttcatctcttaaattgggctttcatatgtggcatggctttttcataagtaatacactgtcaaatatggacattaaaaattgaaacccaaggtactgcaatttggtgtgtagaccttaattaaaatattagaaaggaaatattatagaagacagttaaaaaggttatttagctgtccaggtgtaactggatttaaatccagtttacacctagtttaggtcattaacagccacccaggaattctaaatgagaggaattagaattggtcgaaccctattgaactgaattttgaggtcccctgaaagacagtcactctacagtgtagataaagcacactgaaattcaggacccctgacttccrgcacttactctgctccttactgtgaccttgagcagttatctaaccctgctggaacacaatggcctaatacctgggtgatgtcttaggttctttcttgctgtttagttccaagctctcttcactccaactggacaagagattaaggaaatgttctcaggaatatgaatttaatataattatattcaataaatattctggagcaattgccttgcacttgtgctcttgaggaacttacagcctcgtaggggaaataagaaatgcaagcaaataatcagaactaacacatattgtttattatatgataggcgctgtcctataggctttacatatattcgctactttaatcctcattattacccattggggtaggttctattattgttcttattttacagacaagaaaattgagccacaaaaaggttaagtaacttgcccaacaagagtctgtattcaaattcctagtctggctccagaatctgcactcttcaccactactctatactgcctatatgcagaatgcaataattccacacacatacaaatgcacaaggattaattacagtgttacggaaacacagggagaaaggtgttacttcttcttgggggattatacaagattgatgcacgagaaggtatgtgactagaaccttgaggctgaaaggattcagcaggcatgargaaagaaaagctttgcaagacagagcaaggatattagctatgtaaaagaaaaagacaaataagatggtttccaaaagcctttatcaacactgagtaccagctgggaaacctagattaagaacaaaattgattggctatcaggaaagaggcttgataacatcccaaggtgcagcaaattttccaagatctgagaggctgttaatgctatccaagggtgatagggatagagagatgggaatgtttaaaagggaaagactgagactttcagcaagatatttgaatgatcaaattcagttttagtgaccaaaatctttctggtttctagtgatrttaataaaatcaatgatgccatagctgaccaaatggcccttttcattcagcgcatgacctcgaccatctgtggtttcctgttgggatttttcagggkttggaaactgaccttggttattatttctgtcagccctctcattgggattggagcagccaccattggtctggtaagaatgtctttttgcatctctccatgggaagacatttgccttcataaacagccaaaaatgtgaagcttgagtcccttttcctgagtacagttagcaacataattatcactatcttcatgtagtttgttagattactccccagtgtcaaatgacatttcatcraatagggattaatgatgttttaataggtaaatattgttttattaacagcaattacatttattgagcattcactgtttctctaggcactactaggagcttaatagtcattatctctaatctttacaacaatcttataaagtgagcactaacatcattttaaatataagaaactaggctcagaaaggtaaggggatttgtctgggactgcacagctrgcagagtaggattcaagtctaaggggctctgactccaaaccccactcactctccaatatgcctattgttctccatgtcctcccaagcttgggcacttccctgaaaaggcacaacagacaaagagcattaacaagcacacaagaaggatttctgcaatcacaactgtgttctccatttcatcttatctttcagataacctctttcagagagaggtgatctgacccattccaagagttatcccagtcactgtctcggttccccaggaattgaggcctggacaacatataggaataggaatttcgggtcacatcagctaaaaacactcccaaggactgagaaattattattagagcagccacattagatagcacgttatggaatcaggcatactaaaactgtgctataaatgagamtagaatttaactgaaaaactgcatacaccctcacacatcgttgagcaataggtaccaacttcctattgctcaatagcaaaatattctcacagtgtctacattattcaaacatttcccagataaaatagaaaatggtttaaagtgacaatagcaaagagctcgctccatttcattaggtcaccacttggctgtaccgctaacaggttgtgtgactcaggaaaaatccatttaacccctgaaaacctcagtttccttgtctttaaaatagggataatacctcccaaaaacattatgatgattcagggaataatccacgttatgcatttaagccgtgtcgggcacagaatcaattgctaaagagagatgtatatgtttttcaatccactatatcattcaagttttacggcagtctttcctactaaccactttccaactatactccagagaaccctcaacttccacagaagagcttcaggggttttgcaaacattttttcattttttttctgaatacactaatctctttcttcaaacctgtgataaagtaatatacacactcacgtggatcataggccacatttcaacatgttggaggttaacatatagcccagttcacttggttttaaacagctctaacgcttagtttctctagtcatctcagtacccatttctagcttctcataaactcgtcactgatttggaatgttgtaggtctgcacatgtcttgtcttgctttcaagtctgtgtatgcttgtccttatacaacaaacttctacaagcaactatacaacaaactatacaagcaacttcactaggctcaaatgtaaattttaatgttaataaaaacagcttccagtcttggtaacacagtgagatcccatctctacaaaaaaaaaaaaaaaaattttttttaaatagccaggcatggtggcatgtgcctatagtctcggatacccaggaggctgaggccagtgaaatgcttgagtacaggagtttgagactgcagtgagctaggatcatgccactgcattccagcctgggcaacagaacaagaacccgtctctttaaaaaaaaaaaaaaaaagcctcactttccttactgttacatgtttaattcacatgttttataaaatgtacactgatgaaattaatatattgtttttaaaaactactatgaatacttacttaatttacatcttagaattccatctaagattttgataagagttttgctgctaaaagtttggaaaaactactggaagataaactcccttaatctgggtattatatatatttttatatttctgagctagttgatcttccgcaatatgtgttttttcctcttcttatttattaatctgtgccagggttttctttgggggttcattttgactaggactcaatccaagtcagttttagaaaaagtaatgtgtctactgttaagtacagatgtcttttcatttccttttgtaaaaatcaaaactacatagttgagcgtctccaactgagtgaaaatggactttcttttctggaatcatctgaaatcgtctttcaacatcatgcctatactttatatgttatatgtcatatattatacccaatcatgatatctgcatgtgtctctggcgtttgtctataaattatgcaatggccattggctaatagcaatgamctatgacatggtctaacttaacactttattagtataatgactgaaacactttagtcttacagaatgtcctatttggaatttattctttgaggaggttcttacttttagtagggtcattttgatatatcaacaaccagacaaccctggatgaagcttaccatagaccaaatttggaccagatttcttcctcctgtcaatgatgttacagtgagamtctaatattgtattaaacccawgccacatgttaaatgaatctgaatgacagactgacttacctaatttcttggacttcacattttcttttcttctttttgatttttagagtgtgtccaagtttacggactaygagctgaaggcctatgccaaagcaggggtggtggctgatgaagtcatttcatcaatgagaacagtggctgcttttggtggtgrgaaaaragaggttgaaaggttggttaattggaatctgattctttccttaatttcatcaatcagcatagtaccctgagtctctcagtttgtgcaaagcggcagacccaccttggtctgtggcctccagaggaagtacttgttcaagagggagctaagcagagtaatttaggttggtaatttaggtactataagaagtcccaagcctttagcagtatgtttttaaagatgttgcagttggcaatttttagaaagccagctyagggtagatatttatttcaaactctgatggtatgtatgtataaatattatacctcatatcagtctataatgctgtttgctgtcattaaagaaaagcctacatgagacattacaactgataccacagaaatacagaagatcataagagattactaaaaacaaacgccaacaaattggatgacctagaagaaatggataaattcctataaaaatacaacctgccaaggttgaatcacggagaaataaagagaaataaatctgaacataccaataatgagtaaggagattgaatcagtaataaaaagtctcccatgaaagaaaagcccaggacctgatagcttcattgctgaattttaccagacatttaaagaaaaactagtaccagtcctcctcaaattcttccacaaaattaaagcggagggaatacttcacactcattttacaaggccaatattaccttgataccaaagccagaaaaggatactacaagaaaatcaaaggccaatatccatgataaacatggacgtgaaaatgctcaacaaaaatactagtaaaccaaattgaatagcacattaaaagaatcattcaccatgatcaagtgagatttatccctaggatgtaaggatggttcaacataggcatgtcaataaatgtaatataccacattaacagaatgaaagacaaaaaccatatggttatctcaatagatgctgaaaaagcatttaacaaaattcaatatcctttcctgacagaaactctcaacaaattaggtataaaaagaatgtacctcaatacaataaaggtaacatatgacaagcccacagctaaatcatactcaagggtgagaatttgaaagcttttccccctaagatcaggaacaagacaaaaatgcccattcttgccacttcttagcaaccacaaaagaccttgaatagcaaaaatcctgaacaagaagaacaaagctggaggcatcacgttacctgatctcaaaatctactacaaagtaatagatcattattagattatttgattactatagtaataaaaacagcatggtactggcatagaaacagacacatagaccagtgaaaaagaatggagagcccagaaagaagtccatgcatttatagtccattgattttcaataaagagaccaacaacacaccatgaggaaagggcagtctcttcaataaacgatgttggggaaactggatatccacatgcagaagaatgaaatttgatccttacctcacactatacacaaatatcaactcaaaatggattaaagttttaaatgtaggatataaaactgaaaaactactagaagaaagcatagggaagaagctctatgacattggtctaggcaatgatttttttgacacaaccccaaaaggacaggtaacaaaagcaaaaatagacagatgggattacatcaaactaaaaagcttcaaaaaggaagcaatcaacagagtgaagaggcaatttatagaatgagagaaaatatttgtaacccatacatctgataaggggttaatatccaatacatataagaaacacaaacaactcaatgacaagaaaacaacctgattaaaaagtggtcaaaagacctgaatagacatttctcagaagaaaacatacaaatagaaacgtacaaaaagaaacatacaacaggcatgtgaaaagatgtcacacatcactaatcatcaaggaaacacaagtcaaaaccacaatgagatatcatcttatacctgtaagaatggccattataaaaagaagaaagatatcaagtgttggcaagcatatggggaaaatgaaacactgttacacggatcgcttttggtgggaaagtaaatcagtacagccaaagagtatggagattcatcaaaaaatggaaaacagaactaccatatgatccagcatccccactactgggtatatatccaaaggaaatgaaatcactatgtcaagagaaaactgtactcttatattcactgcaacattattcacaatagccaaggtatggaatcaacctaagcacccattaacagacaagtgaatgaagaaaatgtgtgtgtaaatttacatgccatattcaatagaatactattcagcctttaaaaagaagaaaatactgttatttgcagcaacacgatgaacctggaggacattatgttaagtgaaataagccaggcacagaaaaataccccatgatctcactgacagagttgaactcacagaagcagagagcagaacagtggttaccagggactttgaggtgggagggggcaggcgagaactggggagacgttggtcaaaggattcaaaatttcagttaaacaggggtagtttgagatattttaaaaataatgacattaattatctaattgtagttgttttaatttagttcatggtgatctaaaagaaacccttccttattcacatttaagaggcagtttataaaktcaagaaatgtgttgttaacatggtgactatggttaataacatcacattgcatacttgaaaattgctaagaatagatttttaagtgttctcatcacacacacacacacaatataagtatgtgaggtaatgcatgttaattatcttgatttagccattccacaatttatacatacttcaaaccatcatgttgtataccataaatatatgtaagttttgtcaattaaaaaataataaagaaatgccagcatgattcaaaatgctatttcacacatttttattgaacacctttttaattaaacacactttattcaggtactgtgctacatgttctttataaagtctgataagatttctatttggtcaaacaggctgggcacagtggctcacacctgtaatcccagcactttggaaggccaaggcaggtggattgcttgaggccaggagtttgagaccagcctgggcaacatggcaaaacctcatctctacaaaaaaatacagaaattaaccagacatggtggtgtacacctgtagtcccagctacttgggaggctgaggtgggaggatcacctgattctggggagtttgaggttacagcgagctgtgatcatgctactgcactccagcctgaatgatggagtgagaccctgtctcaaaaaacaaattagtgttgaaaagttatagagcattattctagagattaactcccagtgaaaagaaaaacccaaatggccaaaataatacagttgtccaaaatgtaattttgtttattctttaatttatctggtatttattgagtacttactacgtgccatgctttgatttttataaaatagctaccaactgaatagcaactcttactttatgtgttgtagatttggtaagatggtgttattctcagttgctaccaaatccatcaagtaaaaaagagaataggatttacaacctcttattatcgtcttttccccacttcttttggtttgtggagtgaggttccttatttcttgtaaaaaatttcagtagcatatttcttccaccatgaaagacattatcttttattgtcaataaaagagacagtgtagtgttttaaaaatggtaacaaacataggatagaccttcagtttgtgtcctgcaaaaggttaaaagttctccatgaattcaattcctgagatgtaggaaggcagtttcagaatgcctgagctatatatgagacaaagcccattgttaatggctagatcatggaattactgaaacctattccttgcattggacttccacatagtttcagttatccatgtytcatggctgtgaacctgaccagtgtgtcacaacacagcgtctcagccacagggcagatgggtgagttatagatgagttggtgcaaacactagttccaagcctggggagctggaaacaaaaagtctggtctgcttatttggagccagttgcattattttctgataaggacatgtcatgtgactcaaggaaacacttcaaacataatactagatctctcttgttcatatatttatgttgaaaattcttttctcttggggccaagcttacctcactatgcaatccaagcagcaatcaggcagctctgttaagtatcgccctttcaacatgtttcattgtcaggttaaaacaaactttaaaaaactacataaaggttattggagatttttctccctgaagctgctctgtgtttgygatgattttatgatcattttgtaaaaccactgcatcayggcctgttttaaacattataacttgagctgtttctgcygaaattgactcaarcrttttgtcttcacaggtatgagaaaaatcttgtgttcgcccagcgttggggaattagaaaaggratagtgatgggattctttactggattcgtgtggtgtctcatctttttgwgttatgcactggccttctggtacggctccacacttgtcctggatgaaggagaatatacaccaggaacccttgtccaggtaccttggacttattgwccgagacatagcatttccttctggtatctcagaaaagtccatggattagatattttgtttattactttggtgccttcaggaaaaaagcatcaatgattttatggagtctgtctgtggaaacaagtaataccttaaatttttttttatttccataatttttttgggaaacaggtggtatttagttacatgagtaagtcctttagtggtgatttgtgagattttggtgcacccatcacccaagcagtatacactgaatccaagctctggtcttttatccttcactgccttcgtacccttttccgctgagtccccaaagtccattgtatcattcttatgcctttgcatcctcatagcttagctcccacttatgagtgagaacatgcaatatttggttttccattcctgagttactttacttagaataacagtctccaatcccatccaggttgctgtgaatgccattaattcattccttttattgctgagtagtattctgccatatatatatgtaattatatgtatctgtgtatatatatacatatatgttatatatatatcacagtttctttatccacttgttgattgatgggcatttgggctagttccacagttttgcaattgtaaattgtgctgctataaacatgcgtgtgcaagtatctcttttgtataacgacttcttttcctctgggtagatacccagtagtgggattgctggatcaaatggtagttctatgttcagttctttaaggaatttccatactgttttccatagttgttgtactagtttacattcccaccaacagtgtagaagtgttccttttcactacatccatgccaacatctattatgttttgatttttttattatagccattcttgcaagattaaggtggtatcacattgtggttttgatttgtatttccctgatcattagtgatgttgagcatttttttcatatgtttgttggccatttgtgtatcttcttctgagaattgtctattcatgtccttagctcactttctgagtttattgtagattccggatattagtcctttgtcagatgtgtagattgtgaagattttctcccatcctgtgggttgtctgtttactcgctgactgttccttatgctgtgaaaaacctctttagtttaattaagtctcacctatttatctttgtttttattgcatttgcttttgggttcttggtcatgaaatctttgcctaggccaaagtctagaagggcttttccaatgttatcttctagaaattttatagagaaacaaataatacttatatattttatagtaaagggatgctaaacatttgaattgataagaccagcaatttaataatttcaaattaactgaacactttatagctatgaaatgatgattttctgactgagtccaaaaagaaaatatgccatgaaaatggaaactcagtgatctctcagctaaaaattaacagctcgtataactgagctttatgatagtccaagatatatactaataaatgtacttgtgaaacataatgagttactaaaatgccaggtcaataacagccttaactgaacaggtgctacaaatgtactttattgctcacttgtgctaaagtagctaatgcctttaattttcattgtctttacagttattcattcaataagtaattattcagcatctactatgtgccagacacttagaaaatgcaggggattcaacagtgagcaacggaaatgtggttttgtttttgtttttgtttttttgccttgatgggatttacactttaatggagaagacaagcaataaataagtaaccatgtaaatgaatacagacaaatagagacatgctatagaggacagagaaccttgacagtgaatagcaggataaccaggtgtggcgggggtccaggaaggcttcttatcctgctccctctcccaaggcctttcctccttagcttatggctctctcttgttgcaactggactctgatcattgtttgaattctcagctaaatgccactttcccagtcaggccttttacactcacccatttttcattctcttttgtgatctgctgtacttttttttcaaagcacttttgtgatatggaatatttgcatttatttacacttgtgcccaccygtttctaccctcagacagtaaaatctacgaggtcagggaaacaaaaaatgaaatatctgtttcatttgccctgcaagtaaatagggagtcgttttatatcaaattcttaagtaaaattttttagctccagattccggatagagcaaacaatgaaaaatatcaaaaccttgtataccagaaatttgctagctgagagcttaaaattcaaaatctactgctttaagataaatacattgccagggaaaattgagtaggattttgatttgcaaatggaagtgattatcagaggtcaaaccataatcattccaaaccacggacttwatttcattaagaacatgataatacacaaagaacaactttttcaattcagtttatcttggcagcatgaacagctgacatcttttgaactttgttaaagaaaataaatatgataatacaggttaatgtgttttgtaaactttaaagagatagtatggatgggaagtgttaccaattttataatttaaccacttcttaacaacttagatacagtttttacagattggaaaagccaytgaagtattgcaggtccagattttaactatagtcccttgtctttattgatccaattcctcctaagaactttgacatttaccaaaatagggatatcagtagttggctttagtcctagctgcttatacatacttgctatgcaagaagacaagcattgagaaaacttatttttccttttgttccatgcctacaaggagaggatagaggtatacaataataatggttcagagggaaaagtgaattggtaaattgaaaatcaaataatacacaataccaactggaagcacttgaataaaaatccctttggtaactctctgtagtaggaatccaattttatgtctctcatctttaaatttcctgcccattgtacagtgagctactctacttttgtaaataatttattctttcaaccaatatttcttgagtccttgctatgtgcagacatggcatactatgggtctctaacattttaatcaactgattattaacctkttactcccaacgtctttctgtaagcctctgcttatatcttaagagaaaatttcctttgggaagatgaaatgcatcctttaacactatattccttgctctctctctctcttctctctctctctctcgctcgctctctctctcaggtcttggccacacttctgagcagcaaactatgaaggctgagtgtgcatgggctgagttgagtgttttaatccacaaaactaattaacggtttggttaatccagtacgttttgtgatacacaaaatcgttactggctgcatggtaattgggcataaatggtaagtagttcacataagtgactgtaattagtatcasttgtgcacagagaaaaaatgcactctgtggtctggtagggaaagatgaaggggacctgaatggtgcagaaggttgttctttcaygaccttcctgagtttcagaattcattaataaaaataawcacataatggagcgtgacattcattcagtatatacaaagtgtcaagcactgagtgacgtattatgtaataaaattactgcatgtaatgctctcaatctcattccgtaattggtgtcattatactaccacttaaaaatgaaattgaagccatgaagtcaagaaatattgagagggatttgaactcaggtctccctgactttgaggcctacctattaaccactgttttcctgcctctgactctgtcttcccaggggccatggacccctttttctccagcacacccatagcttaattgttccacagcagtctcccttcccatctctctgtctacactacttctgctgttcacagggctaaagaatatgatgttgagtgacaaatgatggcttattgggatgttgctagctactgtgatgatttgggaatgtgcttttgtcctgtctcactcactcctccccatccagagagccattcaaagagttggaccccaaacttcaatttaggcctccagtcagccaggagtcagcaaactatggtcgacaggccaaatccagctcactgcctgtttttataaataacattttactgggacagagccacagtcacttatttacatatgtctatggctgcttttatactacatggcagaactgagtaattacttcagagcccatatggcctgaaaagcctaaaatatttatttggccctttttcagaaaatgtttgctggccccggatctagggcaaatggaaggttcctttgctgaggtaggaagacctctgacgtgtgtggtcttaaactaaattggaccataagaagtgttctatctgcttcctttaccgcctcctaagtgtgggacctcaatactttcttcactgtcagcatcatcatcaccaacatcattactaccattgaagwgactagcactggattaatcatctttacacacattatctcatttgatcctgtaataatcctatgaaatatatgctatcattatccctgtgttgcagatgaagaaatgggggcttgaaagattacataatctgcctatgggaggaaccacctgccataattgaggacaaggaaatgaagagataatttttgtccctatgcataggctgggattctagggagaaagcgtgagtggactaaccyaccacccatgtatggcagccctggccctgttaatcatcctaatgtgtggaatgaagaggttactgaagagggagagacatggctgagaggctctgacactttccatggttcagacactccagccacaaggaagaaagagaagcaggagagactcaggcaatttgcctcaatgtgatacaacaaatgggaagggtctggcctatagaaaccatcacagaccaggatcatttgatcacctgaaaaagactacattcatgcagggccactctttggcttggcratagactgtggccaatgaaacatcctctatgcgagtcacaagagtaggaccattctttggttgacagggtagagaggaggagactggtattccttctggaggccaacttgaggatttgcctcattgtctcttccttacctttataaacagtgctgataataaaaacagagtgctatttggtaggaacatctrggcatgatcaggtagccttcccctaaggtaatgagatgactgcattggtaagtcaaagaacagctgccccaagtctgmacaggaacctgaccactccacctgcatatagccagcaacaggtgagtctgggagctaggtagaatggcagtcaaaagcctggattcaaattctgctctactacttatgacatgttgtaacctagtgcaaattgggagcctccatacctgtctgttcactcttctgttgtaaagataaaatgaaataatacagataaaacacttagaaacatacctgttattattgttattattactgttattcatagtagttgcagtagttagcccagtgactactggaatagtagcattagtatagcggtaacaacagtagcaggttggttttgcatgtaccagcctctagaatagtcaggctgatcttagtgtctgtattgtttttggcaaccctttaaccagaaaatcactataaggctgattatataatgaattcaattatcaaatcactattcaagtccactttgggtctacaggctaccttgcttagacttcttactcatttcaaaacagttctactttgtagragagtaatattcagtaaaaaaataaagtggtmttttaaatcataacagtggaaaacttggagatgctttacagaacaaaaattattttgggtatttccaaacagccaaagagctagcttttgaacccacagaagagaatttctgataactctctgcgttaacatggaagacccaaatgatagtaattactatttacacattaacaaaaacacatgaaaaatctctctcttttcatttcagattttcctcagtgtcatagtaggagctttaaatcttggcaatgcctctccttgtttggaagcctttgcaactggacgtgcagcagccaccagcatttttgaracaatagacagggtatgtataagccaaaagtaaaggccattaacaggtgggggctggggggtggggcacagaatgaactcctgaagaatttaccttaaagttaaaaatataagaagctatcgcaaggcccttaattcagcaacacttattaaatgctatcatgtgctggtgccaattctttttttttttttttttttttttttttgagatggagtttcgctcttgttgcccaggctggagtgcagtggcacaatctcggctcactgcaaccccctcctcccaggttcaagcgattctcctgcctcaagggagtgaatgcaacagggaactagaacaagtaagacccctgttctttactcatgctgggagaggacaggcagtaaagaagtatgcacattcaaagataagacaatagcagagagtggtaagtaaataaaggaaataaaatagggcaatgtgacagcgactggggtgggagaaagagtctttaaattgggtggtggtggcagtatctctgaggaggtagcatttgagtggagaactgaagaaaagtcagccatacaaatgaggattggaggaggtggggcgtgggaagtaagagcagggagggcattcatggaagagaggcccccaagttggaaaaggctgctgatttaaagaagctgaaacaagcccagtgcaactgaatagagtgaacaaggggcagaggctggaggcatgggaagggcctaccatgcaggacttcaagaccatgtccataaaattcgcttatcttctaaatatggcaaaaagggattttactggttagtctatggaagcacactggaggccaagctagggagtcaaaatccaagaacaggccaggcatggtggctcttgcctgtaatcccaatactttgggaggccaaggtgggcgcgtcacctgagcccaggagttcaagaccagcctgggaaacatggtgaaaacctgtctctactaagaacacaaaaattagccagtcaagatggcatgtgcctgtagtcccagctattcaagaggctgaggtgggaggatcacctgagcccagggtggccgaggctgcagtgagccatgattgcgccactgctctccagcctgggcaacagagtgagaacgtgtctcaaaaaacaaacaaacagaaaaccaagaacagaaggggaagttggcaatctgttgttctttctctttaaaaaaaaaaaatgccctgagctgagtccaaagcaagccctggaaatccagaggtgatttgcgggctccctgaacctgtttggttcactgtccgctgtttgatactctttcgccaaacagtgaagttgtaacctattaaggaagtgactcattgctttatctgttttataatttggggtttcatatattggagtacagagagattgttaaaaaccacataaaaatgttcattgatggccaggcatggtggctcacacctgtaatcccagcactttgggaggccaagtcgggaggatagcttgagcccaggagtttgagacaagcctgggcaaccctgtctctacaaaaaatttaaaaagtagccgggtgtggtggcacatgcctatagtcccagctagtcaggaggctgatatgggaggatggcctaagcccaggagtttgaagatgcagtgagctatgatcacactactgcactctggcctgggtgacagagtgaaaccctgtctctgaaaaaaaaaaaaaaaaaaaaaaaaaaaaagtcaatttattcaaattctacctctttcttaagattgttatatgctcaaataagatgatgactctaaaagtgccctgaaactaaaaaattaaggcatttaaaaattatttcttacctttattagcaacccagtaaggaggtagattacattatactcctcaatagagctaaagtgattgatatggtttggctttatgtccccacccaaatcttatcttgaactgtaatccccatgtgtcgagggacagacctggtgggaagtcattggatcacaggagcattttcccccatgctgttcttgtgatagtgagggagttctcatgagatctgacrgttttaaagtggcagtttcccctatgcgctctctcctgccaccatgtaagacatgctttgcttcccctttgccttcaaccatggttgtaagtttcctgaggcctccccagccatttggaactatgaatcaattaaaactcttttctttctaaattacccagtctcaggtattctttatagcggtgtgaaaatggactaatacagtgatgaatttccatcactagttatggacaagggaagaagatgatgctggagtgttctggtagcaggaagaggccctcacttttctctgattaaccagagtggttaaattctagattgggcttgttgctagcagaagaggtgaaattcaggacaacarttgaaagttggtagcatttgaacacatcatttaggaacactcagttttaatcatcatctaccatggatactcaaaagaataccctcggacccccgattggttgactagttgcctggtcttagaaacttaatctttctgcaattcctccacttcttcaactgaaaatgggcatatcaccagtctagtttggtgacggtgacaattatgtaaataaaagtataaaaacacctagtacattgtctcctatattatcttagtaatatataatatataataatattgttaacatatgttatacatttataatattaatacaacatatgtattatatatgtattattatataatggcacatattatataatatctcagtaacaacatgataaataataacaattaaataaattaattaaatatgtattatgttaatatataatatctcagtaatagctcaagaagtagtgattattctcactattattaataaacgtttaatgagtacacatctttggcgtatctctgcaatgttttatctggttgttgttctaagtaaattcaaattaagatacatgcaaactaagaggcacaataaatgtatacatcttcatttgaatttactcataaaacagagcaacaaccagataaaacattgcagagatacgccaaagatgtttatttgaatttacaatttgaattgagttgtgcatcttagtttgagtttacactgtgtcccttttgtatttcactccagaaacccatcattgactgcatgtcagaagatggttacaagttggatcgaatcaagggtgaaattgaattccataatgtgaccttccattatccttccagaccagaggtgaaggtgagtgctggtctgttccccagaatagtaaatgttttcttcttcgatgatttatttgcataaccacaaattgctcattttctgaagcctgactctgtttccagtaatagggaatggaggtgtctttctctgaaagtatcctcgggtgttggcttatctcaggcaacagaccacattcctttgtgataaccataatgtgcaaatcccctggttgggacacagtctggcagtacattcaggctaaatgaactgtatgacgctctgttgaaatgagtggcaggtcctgtctttccatgcaagtgctagataaatgacaaggcaattasaacaatcargaagcacaggttcttcccaaccttcgcagagactgcagaaagtggaagacactgagtatagggtatgaagtggcaaaggaaagctgccattatgtaggtttttacttcccatctgtaaattcactaggtcactgcatcagcccttataggaaggtatccttgtgatattatgctcacgtgtcttgttcagggcacatggtgaaaaaaattatttcctgcctttaaattatctttacaggcaatttactctacaagaaaattaggatctactacccctgaataaattggctttgaaattagacttattcctcattttcaacagagtatctctagccactctctcttaatatttctgttatctgcacagaactaaatcccattttgttagcctaacttaattctgacaccacatacctatcatatatatatgtgatatatatgatatatatgtgatatatatatcatatatctgtgatatatatatgatatatatatcattctctctttgaatatatgaatatatacagagagaaggtaaacatatatataaaatgcaggtaaatatttatataatataatatttgtaatatataatacatatatatgtaaatatatatttatctataaatatttaaatataaaaatatttatgtatttatatatttatctataaatataaaaatatttatgtatttatatatttatctataaatataaaaatatttatatatttatctataaatataaaaatatttatatatttatatatttatctataaatataaaaatatttatatatttatatatttatctataaatataaaaatatttatatatttatatatttatctataaatataaaaatatttatatatttatatatttatctataaatataaaaatatttatatatttatatatttatctataaatatttaaatataaaaatatttaaatattcatatatttatctataaatatttaaatataaaaatatttaaatatttatatatttatctataaatatttaaatataaaaatatttattatatatttatctataaataaatataaaaatatttattatatatttatctataaatatttaaatataaaaatatttgtttatacatttatctataaatatttaaatataaaaatatttatatatttatctatattttatatctatatatacatacctacattatcagtatgtaggtaaatatatctataaatatatataacaaatgtacaaatataagtgtatatctctatttaccttcattatatacataaatatataaaacataagtaaatatatattctgattacataaagtatatttttattatctattacatatgtacctaaamatcaaatgttataacatatgtaaaggtgctttgtaagctatgaattacaaagtaatacacactcagtaaatatttttgaatggatagctaaaacttatattacawtggtggagagtaattgaggtttttgccattacttttaatagtgaaataaaatcttcttacttaaacctatatgtatttattcatagtacgagtwtgtttttaaccctctgtgtgccacattgtactggtgctataatgataaaaaagcacatttgatgcctgcttgctctgggagcttacagtccaatacaggccagtaagtgaaaatgtatttgcaagtttgactcctagtgtgaaatgaaaggcgtgaggttttgtgacacagaggaccccaaaccacattttccataatcagtacaaaaatcacctcttaaytggtgaaaatattgacagatagttatgaattagcttctcattctttcctcrcaagacctactagccagcattcagcctctacstagcaaacacaccgtgtatatttattaagtaagtttattcaaatggtatgttcatacaccatacacatgacggayggcttaaaatccgcaaatttccttactgttaatccatgatcagtaaattagtactatatttctaacttaatggattttttttctttaactaattggcatagtctccttatcctagtatgtcaggagtattttaaatyagattttgggacataattttaaaagttaacatgtcttatttacttcacctgtgttaatgtgcatcattttacttcttggtcatggctctcagttaaataattaagtaatgtgctaaatgccaaaacctcatccttgccaatgtttycttttactggtttttgatggatttcagtggacgttgctttgggggcatacataaacgcacacacagacaccgagtatcaacacaaagcatctgcacctgtagcctaattgtttgatttggtaaacagtgacaatctgaactttgctgttttctttcttctccagattctaaatgacctcaacatggycattaaaccaggggaaatgacagctctggtaggacccagtggagctggaraaagtacagcactgcaactcattcagcgattctatgacccctgtgaaggaatggtgggtgtcttccagaaactcctcaatacatggggacagtaaagtgcaaatggcagtatattgatcaaayagaaaggtgtagcatacattgagactgtcctggcatgcatagttaacttaatgatttgttactgaattgatgggacacgcttcctacatggtaacagtgttcartgaataaccagtcaattccattcactgtataatgtaactgaatgtgcagatacagtcagatgtggcatagcaacatttcagtcagtgattgatttcatatatgatggtggttccataagattataatggaacatgtatagaaatctgatatatgtcacttgatgttggcattgcagatcaagttaagagaaatgattgatatttagtaatggtgctaggacatttggaaatatatatatccatctaaatttgtgtaactacactgtgatgtttgccartgatgaaaccrcctaaggacacatttctcagaacrtatccccgtcgcttagctatgcataactgtacatttaaaatgctattgctgsctcttcagtgarctgtctattccacttttttctttgtattataacgaaaatattattgtgtccttaagttctccagacactaaatatagraataataacagggcttgaaattaagagagagcagtcctaagaaactaagaaaaatgagtattagtaattgccatttatttaycacatrttatgtgtcagatactttattaaaatgattacttattgtcacaatgacccccaaaggtacataggcccatttgacaaacaaggaagcagagagtcagagagatggaaacttgtctagggtcattcatcaggtaaatgaccaagtcaggattgaatccaggtgtgttgggttccaaagcccatgctcttttcactctgtctcaaaattattcttgtcagcatctccttgatgccttgagatggaatcgtttaactatttaatggcttcaacaaaatgagttctctatcatgcatatartattacacaggcatggcaaacataacagagttttcctttttcacagacatctcatctctgattgggtattctttactacctaccaccataactgcactctgaatatatagaaatcayagtttcttgatgtaagatttttacatttttactaatagtgatttttatttgctcccactgatagtttcacttgctttttaacagcaaagtgttatttgatgaatctggccagaaagtaagacttactataaatcatatatacaagatagggatcattgtttatttttattatatcttttgagtccatttttgtcaaaagtcaaaagatataaaaatatttaaaacgtagtgaataactgtctctactctttactggaatcaaaaatttgtccattcctgggccaatggtgttaaattaagtgaactttatttacatcatttatgtttccacaatgaattgttctgcagctatacttgatttcaattacatgttatcatccttatataaagaaccacatttcaagaggaattgtttccattagaatcttattggcctctattttttctgcccattggtcaagtatgacataatattatgattcagaacccygaaagattccaaaagttgtgatgttgtgcccatgctctctaggtgaccgtggrtggccatgacattcgctctcttaacattcagtggcttagagatcagattgggatagtggagcaagagccagttctgttctctaccaccattgcagaaaatattcgctatggcagagaagatgcaacaatggaagacatagtccaagctgccaaggaggccaatgcctacaacttcatcatggacctgccacaggtacccctagccatacattcctgggagaaacyaagaggtcatagaaggaaaaaaagttgcacaattatacacatttcttytcgtatgattcccaagtcattaaattcttaagccatgttttagtttcatgcctgaaaaagtaccatgagtgtttcctttcatctgaaaacacattgtttatgtgttcaaatctatcaaaaaaggaggttttcttttgaaaagctcactttgttggtaatatattaaacatctaccaaactggggaactatcttttttaaaactcctttgacatagatccaatgtccttattccttttattaagcatttgtctaagcagatgctaaatgtcatgtggcaataacttgcacaataatctcatgacagctactcataattttcttgtgcttaggcagctaatattgtgtcaaaaacaattcrttgtatatctccattctaagcaacaacaactacaaaaaccaactcctcagcattatacttcaatggattttgccaccgatggcctgctaagtcaaagaagagttattataaagggttaacacgtatacggttcttactacataccaggcactgttctaagcacttcacacctattaactcattaaaccctcacaacaaccctgttgagcaactaatattattagctccatctaaagatagaaaactgaggttctgagaggtcaaatagcttgctcaagattatacaacaagtaaatggtaaagacaaggttcatactgaggtgatctgccttcagaagagtcagtgatcttgaacacttccctttcagccttctaaattctctttatgaataggattgcagctgtggctatgatatagcctagtagttaaagagtataaagctttagaatcagattgccttgatacaaatcccagcttctctatttacaagctttacaaactttctcaagttactytgggcccagtgtttccttattcatcagttgcaaatagcagcacttgcctcataaggtatctatgagaactaaaagagaygttatgtgtaaaaagctcagaaccatgctttattcatagtaggggctcaattcatgttggttagtaataagcaagataagtgtctgaccrctaacacctaattattagattccaatgttgtgctaggcctgtgagataatcagtaaccatcttttgtcaatgataatccttataaagctagtttgaccttttattcataatgtaaaaacagcctttgcattatattttgctgtgttgtctaacaggagmaaagagacacggatttgctctgtgctttaatcctctgagatagatatttaggaccrygaccaatttttattttggytgaaaaatcttatttgaagttgagctaaagaggaatatttacacagcccagtaaaccctggaataaaagcataaatcaattcctttatttcacacataaatattgattagacaataacccrtctggggaagggatatttctttcagtggaagtcggagcagtgaaaattcgtgcttgagaagaaaactatgacagaaaggacattatagtggatcactgtcagaagccatcaaattcttttcccttcatgactggtgtcaccttccatctagcaatttgacacccttgttggagaaggaggaggccagatgagtggtggccagaaacaaagggtagctatcgccagagccctcatcygaaatcccaagattctgcttttggacatggccacctcagctctggacaatgagagtgaagccatggtgcaagaagtgctgagtaaggtttgtggaagtcttagtccattttacaggtccatgtggaaatgcttgtgctgctgcaggaaaggcagctccttgtggggtgggarggatgggagtagttgatactacatgggttcatgcatctagtctgattgtttagaaaatattagctgactacaatcttcctcacagttgaacagaagaaagttgtaatttgtttccaaaagctacacatgtaaaagtttaaatcttgttaagactagcttatgatattttttaagttacctaaaaaattgtttttagctgttgattaatggcagcaacagggccagtgtgtgttggggtttatggctgcaagaaaatgtgctggccttttctaatgtctgcacarcmtatttaagaatattcccagggaccaaggatctaactttcctatggattctgaaatgatgcaaaggtcagtgtcagctctgtctcacagttttgtttaatggtgcactgtacattcttacagattcagcatgggcacacaatcatttcagttgctcatcgcttgtctacggtcagagctgcagataccatcattggttttgaacatggcactgcagtggaaagagggacccatgaagaattactggaaaggaaaggtgtttacttcactctagtgactttgcaaagccagggaaatcaagctcttaatgaagaggacataaagggcaagtgctttttccctatacttgtatgttatattaaatagttaatgtctatagtgctttacggttttctatgtatttcaatactcactgttctcccaacaactctggcaggcgttatatagatggtaaaggaaacaactgaagctcaggaagctaagctatctgatcaagttacagcactaaaaccaaggcttctaactttcaattccatcccccccttttttttttttttttaaccctgcgcaaatagaagaggcttcctagagtgtgttccgcacgcagtaraagcttcatgcttattggctgagtgaattaatcaatgacaagaaagtataatacttattttcaaatgtagatagatacttcaggttctagtgcaccttcttttttatcagtctgaattttcagacttggtggttacctcaatctaaattaaccaaccactctaaactttctccaccatttcrctccattaggtgtaactactatatacatttaacataggagggttattctgaatagacttttgaaaagtttagtgtttctatcattttttttttgctacttctgatggacttctcttaaactttttatgatttatgctaaaaaaaaatacctgtttctgtagaggtaacaagctattgtatggtttaaatgactcagtcttgctgagtattttgaaattttttattagaatctgcaggacaagtcccgagttttatttattgcaataaagttaacagaatgttttggcatttgacatagtaattatattctaagcaaacatagtaaagaattctacttggatatggttctgtttattgtatatactaaaaaattgctcatgctgtgttgagtagatgcaactgaagatgacrtgcttgcgaggacctttagcagagggagctaccaggatagtttaaggtaagctcaagccatggggcagattacaagctttccaaatattctgaggagtcctctgtagtcctaatcctcagagaatatctcaggtacaacaaggaaactctgagtagactgccaggtcttgtcaaatatgaacatgcaagtgatccttggttgctatattgacatttctctccccaattcatggktttttkkttagcttctcatcttcttggggataagggttacaatggagatgctttatggttaaaattgttgtgtattgagcttagaaaggggacttcttttaaaaaaaatctgtgtttagtgttcctctgctccaagctaactgtggtatgaaacactgtcttacgtgaaggtcaaattcatgcctttagctccactctttaatctactgagctgcaactgaattacaaacacttctgctcccagagtaacccatctgaagtcaaatcattccataactagatgaagtaagaaatgtaattttttagcacttaaaaataattttcctaaataagagctatttatttttccctggatcaatataaagctgtttactttcaaaatatatttttggagtatgctattagtgagactacacactttagtctttcatcctggtttaagagtttcaataaaactgctcctctgatgttacaagtctgtattaagaagaattctgcccaggagtgtttgtctatatttataactgttattcaagatttttttttcttaagtcagaagatttttaaaaggcaatgagatggtagcaatatctctatgattgccatttccatttctaggacatttaatgcaaggctgtgcaaagtcgcagagataagacttgctcattcaagatggataattatttattgaaaagttgttaaagagccttaaaacattcagctaacaattccaagtagttcaaacgcagatttattcatttaaatattcaaagaatagctcacaaaaagtagtgtatttattttcagatgtagataaatacttcaggccctagtatatcttttccttatcagtttgaattttcagacttgggttttcctatytttcttcttgagaacaagtttattcaaacaaattttaagaaatgctagtttgactgaatttactgaatttggcaaataacaaagcaatagcttcacattactctgtcatgtaaaaggkataaaacaatgttataggcacctggtagtaagtttagtcatgcttttctgattcgatactaaatttaaatcattcaagtcattagaatcacaacctgaaaatatcaactaacttcttaaacccagagaatgactaggcatctcttttggtcactaggttaaaggttgcaaagtggacatgtttcttatgatcaggccaacaagaaaataaatattttcttaactcttcagacaaacaaaattctactcatgttaagtagtttatttgcagtttattattagaactagttaaccattttaatgtgaacattaatttggctataatttctcacaaatgttacattttggtgattaggatgagaaatccagaaatacgatctacacacagaaagtagctattaacctcctgcagagaaagatttgtacatttgagtatgaaagtctgttaaaatatctcattgtaratgctgacggatttttcttgttgtcgttaaaagatgactaaatgaagtgttaatatgtatcttgtttctttggtttcagtttttctgatggctaagttccttttcagcaatatattttaaattcaagaacaatttaatacataacagccacaaatttcctaaataataatgttgagaaagatagtatttagtcccccaagttagttgtttttatttgcagtgagaagtggtacacagcttcagagaaggggagagacagatgttgtcagtttctgaaaagggatggtgtttctagtggatgagagaggtaaacctgcctagcacatgcactgcccatggcctcatgacagcctaggctagacagctcgaatgatctggagaatggtgaaagagagagacttaaaaaatataaagtagatatccaaggggccaaggacataggtcttcccatactcagaactggaaggtagtcagtcatatgttgatggcctctcctgctccacaaactcctaccttggcatccattgctctgcatttgctttttaggtccttgaccttaagtctcctcctatcawgcaccttgttctcaccagctgacacaagcctattctgcacaccttctggagaagacatcctgacctctgttacctaactgggagaaatgacttcattgctgtgtagtttcaggctaggtgggagggagtctctggaggtgtcccagaagtttggtggcagggagtagcgttgaggagtggtttaatgcctggtcataatgagtcttggcaagrgtctgaatgtgcaagagcaaggaagagggagggcttgaggaaactgcatggtgttgaacctgggtgactaagaggatggaagtgccattaacagaaaatgggaacaaattggagcaactcagttgatacattactgccttctctggaaggctagatgagcatatagtaggcaggcaccaccttgatatttgttttggtgaaatttcacttggatgcaaaatggtagagaaagatatgtgaatggattcatctagatggcactaaaacagttgatgcmggtctcctcatcactcacatctctctctttacaccatttacttcaggtgattctttctaaaacacagtcttcagcattgcctcttaaccattaagactgtttacaaatgactgaaaacctaacccaacttggatttacctttagagagacagaatcagctcatataactaaatattccaaagatgctttggcttcaggcaaggctagagcttcagtgatatgtccaagctagaaaatagtttctctctcttcctttctcagctctactatttcactgttggcttcatttttcagaaagcttctttttttgaaggtctcaacataattgtcaacagctcccagcactaaatactttaagattaacctagaggagaatgggggcctccttcccaggagtctgggggagggaagaggagggtggagtctgaaccaatcacttcccatgcttgtcatgtactcagtatattcagcaagcaaccctgtcctcccctgtctccatgcttatgtttatacattctctcagtcagaaatgctcttttctatagtctacaaatccccatatcctaccttakycatctcatccatgaatcttgccttggtaacacctgccatacatttctttttcctttgactttccatactctttattcaaacctgcctaatagcacttaccacattcttctttaccttagggtgtggtacaggcctcttctataaggtttaaattttttgaaggagaaatctgttattggctagtctttgtgtccccaacatcacctggcattggtttgtaagttgtagatgcccaataagcttctgttgaattaatgaataaatgaatgaacacattgagctaaattatatttcaacaagatactcattcatgcatgtctgaatgcagggtagtatatagcctggagaaaatctcatcagaggccctatttcctcatatcatttgtaaccatgctaaagtgaacacatcaggtatgagagaaagatatcaagaccacaatytaagccagaaggaaagtaaaggaaatagactgttgccaaggcagcaattagcagaaccatgtgggtttggaaagtatttgagccttaggtggttttttgatgaactggtaggacagctttgctccctttctctttctccctccctgactacactctgaatctgggtccaacacttgcaagagtttagggcccagagcaatcaacctgattagctctgccctaagattagctctgtcaaacctaacctgcaagctccctttcctggttaccatgtgacctaccaaacatttctatttatttgacatatgaaatgtaaacttggacaccagttgatcctgctccaatctggccacagtctacactgtttcatctttctgtttatttacagggcttccatccggcaacgctccaagtctcagctttcttacctggtgcacgaacctccattagctgttgtagatcataagtctacctatgaagaagatagaaaggtcaggcaccaactgcttatgggggggaatggaagaagtctctcctggggactgttgggtaccctttaagcctgagaatatgagttttctaggtatatatctagcagtgtttcaagtcagactaaaagacagagcattaagacctaatgaaaactctaagttttacacaatatttttaatgcagattagttaattgattatttttaagaatacaaggtaatgaaaactggacttcgsagggttaattgtcttagacaaactattctaacaaacacagaatgtgtgaattctagatatttagcagattatttgctcatatgtagaaatccttttataaaagttgttaagaatacctgaaagcttttttctcaaattttaaaatttctttcttaaattacaataattttggcaaaaataccttgatcaacaaaagtgtttgaataggctagcccttattacaagttatcaaaatatttgaattaatggaggccaattaggtttcacagacatttgttgatttcatacaatttttataatggttttaagatacatttaaaataatactatcaattttaacataattcaaggtagcataaaattaaagagctaggaaagcaaacaacatgtatagcaatacacaatttcttcctaaggatgcaggtgtcctgctgttgtagacattgtctaattttcacataaacagaccacccattctcctccaagcctttcctcattactgcacgttacatgtcagccctgatacttttacgttcattcccctaccacccttcgttagaaaattttcatggcaattttcttattgagccttaatcaaagtcatgttgacttatcccctttctaaattataagcctctgaaagttagtgatacaycttatttgtgtttgaatcaacttggttacctaacccagtgccttgcacttagtaaggcatcaggagattttaaaaattagaatgaaaacatgaatttctacaataaaataaaaccccaactgcaagatttatcaaagcaaataagtcagagaatttttaaattacaagcacatccattatgcatgatataatttcaaattgtcttaaataaaattccaacacgtgaatccactaggcagtaattacaaacattgattcataatggacaaatttggaataaagtagagtactctttatgaccgtatgaaaatgacaagggagtgattgggttctcttttgtttttaatgtattaatactgaataaacagaggtctcaatttctaacacaggctttaaataaattccatggaagactttttctcaggagcagcaggatgaatcacagtgagagaaaacacatttagcaagcatagtttcttactgcatcctgccactaaagactcaacctctcttctagttctagaaatagctatttcattgagtccatggtgctgtcccagataactataagatgtattatataagagcaggagtttaatagagcttcaggggagaaagaaccaaacactacattgacatttctattgaaccataacaataccaatcatatttaatttttgcattttaattttttctagtttctgggtagatatttgacaataaaagtaaaagtaagaaaggatggaaagaagggagggagggaaggaaaatctgactttttcattgttgttgttcaagctggtagaggacctagcgtaggtgtaggggaccatcagattccctggacatctggagatcagattcccatagagttctcttgatgcaggaacaattcaggagggaaccatttaactaaaaggaaatctaaatctaatatacggtctagttttacagagattaaaatgtttcatattatgttctactagtcagcattatacatttagaatagaacaattaaactcagttatatgtaggccagcatacgttttaaaagatgtgactttacgttctctctagttaagggagatagaaaggaagaagagagaaaaaatgataggagagccaatgtgattatactaaagctccaaggggaaaaggtctcataataataccactggtttgtacgataattttgttagtcctttaggtttaaaaaattaatgatttttgaaaagaaaataatggaaaagggttaataaaatttgacttatgaaatttctaatctcaagtaacattatatggtaaaatgttgctctgttttggtattttaaagtattttaayacttaactaaattccacaagcccaagcattggtgaaatcctttctttttctcatgttgatggaaaaggcctaaccttactttctgtagattgggaaatactctcttacggtgctaaaggtcgattcacacaaaggagttatcgccaccttgtggtcttgtggagtattgactctaaaacttagaaccatttcctgagaagtctgtgctttcacccaaggtctcatggttagttggtgacagagatgagactatacccatttatccttgctctccaagcagtactcttagctcctgtaaacggggtcagatgttagttacaatgttgacaacattaagtttaggattagggaaacccacaggctaaaggttttagtctctaatatttaggcaatctcttttggtgaaactaaaacacaaggcagaacatgtatgagatcaagtcaggatcaaatattagacacccataactgcatcacagataacttatgtgataggatttaggcattggttaagataagacagagatgggacccataaaaatggctatcagtattagttcatttgaaaaatctctgctcctttgtcatagttaccactttttatcatcaaatcttaaagttattattagggcagggaacctctactgaatggaaggcagaaattagtgtaacaaagtatagaaagcaagacctaagatttaagtcggaggttatttttcctctggcctacacagaagatgtaagaaaggaaacagaaaagcccagtgtctagcattgaactatgaatgcatcatagtagatgagcaattttaaataaatctcttgttgcatgtatgcagcatggacataaaagtttcattcattcttttatcccataaacatcgattgtacactgtgaagtgccaggtatcacactggggatgcaaaaatgaacaagagctattgttactctccctactatggagctgctgacaggcatttctttacatatgattttttttaaaagtgctgtgcaacctgccagtgctacaatagaagtacaaggaaacacatataaattttataattttacctgtctrtgagatttgttgttaatttataatcttctctttatgtttaattttgcaaaatcagagagaaaaatatttctttacagaatgactttaattattttttgtattgttttcttttattcctctcctgttcttttagtggagatatcaaataaaatgcaataaaaagtccaatatttagggacagattttctagtttttgcatcattcaagctggacagttgcattttttcgggggggtcaaactttaaagtcaaacttttagtatagaggaaccaaagaaaattattttaattaattcgtatttcttgttagtgtctcttggaatgaaaaccactagacaagaattactttgtatcgctttgaaatgtcctaagtgttgttgtttagagttaaggataacttcaggtatcagaaggttgggaaaatttctatcatgtcaggctgtgggtggaccatcctgtggggcaatsgttccagaaaatgctggtatttaatgtcacaaggaagctggcagaatttagtgagtgctaatagtcttcacaagttccaaagcctaccctttgatggtacgtacagcacagctgacacatctaaaacatacattatagaatcctagccatttagtggtgagaggagccttggagttctcacatactgaactttggttaccagaattacctgatgagtattttttaagacagagattcacagttaggcctactaaattggaattctcgtgacaggatacaggaatctggttttttaatcatcaacccacatgaatctgagagcatccagatctggataccaaccactctctagaacagagaaggggtgaaatattttgctctattgcaagcattcagttagtctcacacaatttcatgatgctggcagaatacatgagcatcctgaatcacagtgttcatattcgggtttttttttttttttttttttttttggagatgcagtcttgctctgtcacacgagtaccctgaaccagagacaaaggactttattattcatagcaatagcagtagccagtgttcagcatttgcactggctccccaacccaacccccagttcccacaaggcaatgcaaagagggccagatgataccaacaaatgaagtgggtgttttaaacgagaggaaacctgggcttgaggagcctgactctttcataatgggcagatgggggcagtaaggtttgcacttcacttgggatgaagacatcttctttgtcctccaaaactgtttgctatacaaatacccttgaaaaaataacccgaatgaaggtaatcaatgcctctgttcacaagatgtgcataaacatgggagactcagagagattgtttccccagaattacttagtccaagtctctcgttttaaggatgaaataactgaggtccagagagctagagcacttagtaatacactttacgggtggccacgttgggcttttccaagagctccattttttctatgcctattacactcatgctttcccaggtacccttattcctttctggcataggttgcctagagctagtaagctgtcacaggtgaaataattgaacagaaggacctgctgcatgagtgagcagtaatgacaaagtacaaatggtgagagcaggccaagagagaacttgaagtggaggtagtaccaaattcatcaccagtccaagttgccttccctcattttatttgacttgcaactgtaatgaaatggacatgacacagactttcatttaaaatgaatgtggtctttgactttgtaagcaaagggaaaatttttgaagatccttgctgttgtctatccctgccatcctgctccctaaaagataaattactgtgttaatgaaagagagcactaattaagctttatagtcgatttgctgtatatatttttggtaaatgtcaatagaaaagcttttaaaaatcaatacaaatctatataagctacctaaaatcctttctcaaagtgggtaataaatttaacaaattaatgaattaattacgcttaagaccaaacttgagtagtatccatagcaaggaaaaacgatggccaaaaaagacaacggaggtccatgtataatatttgcctttgagaagataaaaaactgctagctctgacttaatggcaactaaagagaaatgctgattaatgtccactctgtgtgatgaaaatgtgcaatttagaaatccaaatgcagtactacttacctctgggtactgattaaggaaaaccttactgaaaacatctcraygataactgttgacaccacttaatgtattttaaaaattattttgtcttatttcatatatactggcctaccttacagctttagccagttactatattatagaaccttgacatttattttaaaaaattgaaaatttcaccagtcctcaccggtataaatacaaccgtagcaaaggttttctttttttaatgggagttatttttctccaagatccaacatatttattactctctgagagttaatacacatgtaatcatgaaataagaactataagctcaccttcaaatgcgtattccctcagttcagtttttattcaagccacagcaatagttttgttcaaaacgattcctcaaaaaataacaaacaaccatatcccatagacatttgaggtcactcataactaatcaaactatgactcttaaatctgtgaatgccaaaggatctgctgcaaaatgtcttgagtacatttagatgattaatataamcctctctctgctcaaggacaaggacattcctgtgcaggaagaagttgaacctgccccagttaggaggattctgaaattcagtgctccagaatggccctacatgctggtagggtctgtgggtgcagctgtgaacgggacagtcacacccttgtatgcctttttattcagccagattcttggggtaagtacacagctggactagctttcttcttctcataccttttattttattattttgataagtccgctctttgttttcatgtatttagctcttttctgttagttcatttttctcatctctaaagaaygaaaaatttcctaagcctccatcacacagagggtaagaaggcaaagctgagaactctcatttgggctcgcagggcactcagacagtcattgtacctataaaaaagaaaatggtactgtcactgaaaattttgtgttagaagtgggcaatttttctagtaatgtatatcaaacctaatcaaaatgcaaagtggattcactgaataatacaaaaggcttttagggaaattttgatcttgctgaacagcagaggtacaaagtttgacttatatagcaggtgttagtgtttgatgtataattctccacggattgcactattgaaatagtaatgtggataggaagcagaaaaagaaagacagaagtaaaataaggcatgattgaaaactaagcttattccaatttttcacttcctagaatttcttatgttctctatctgacttgattgctgtaatcatcataataactatgaacatgtatcaggcaatatctaagcattttatgtacaatagttcatttaagtttactaacaaccgtctaaggtaggtattcttgttatttctattttacaaaggagcaaaccaaggcacagagagcttaggctagcaagtggtggagttgggattcaaatccagccagtgtaactgtagagccaggttctagtaaaatcttgtcattgcaagattagttatcaaaatttgatcatggaaacagtactgaaagacagctgactagatgcaggtagtatgtgccttctccatgaagaggaatcagaatagtaggtagatacttacatttggaacagattatctgggctagaacattaggattcatcaaacaagggatgggaagcaccagaaataagaaaggagaggatctaaggcagcttacccagttggggactgcctgagagccacaagaggcttttggatatgggcaaacagtaagagagaaayatccagggctccaaaatgggctttyacaatcttggctatgggrtaaatccttgacccactagggccttttccctgacatgaagagctgcctaaagattccacggagatgttactccaaaagggaaacccacacagaatcacacaggcatccaatcctggagcagcctctgtcaggcatcattttgagggcctagataccaggaatatacaaacatgcactgcctctgcactgcttcaaggagagagaggggagactagataatcccatcacccccgggaggatccctgccatgctgttgtggtctactgttgagactgagtcatgaacagactcagagtagtatcatacaaagatcacactactgcatgaacccaaaatcaaagccaaagtattttttaaaaatctcccctacaaaagcaaattcaaaaattggaacaagcaactgatacatcagatatacagatatcaatggaagaacataggaaacatgaaaaagcatggaaatatgacaccaccaaaggaccacaacaagtgtccagcaaccaataatggtgtggctttgtgtccccacccaaatctcatgccaaattgtaatccccacatgttgaaggaagaacctggtgggaggtaattggatcatgggtgggtggatttcccccttgctattcttgtgatagtgagtgagttctcacgagatctggttgtttaaaactttgtagtcttcccctttcgctctctcttcctcctggtttggccatgtgaagacatgccttgcttccccttcaccttctgccatgattgtaagtttcctgagacctcctcagccatgtggaactgtgaaccaattaaaccttttttcttcataaattactcaatctcagcatcagtgtggcctggatgtgagacaaggtgtcaaaaaagattattttggagctttaagatttaacgactgccatgctgggttttggacctgcatgtggcctggagcacctttgttttggccaatttctcccttttagaacagaaggatttacccaatgcttgtacccccattttatctgggaagtaacaaacttatttttgattttacaggctcatagttgtaagggacttgccttgtctcatatgagactttggacttagacttttgagttaatgcttaaatgagttaagacttrggggactgttgagaaggcatgactgtgttttgaaatgtaagaaggacatgagtttttggaggggtcaggggcggaatgatatggtttggctytgtgtccccacccaaatctcgtgtcaaactgtaatccccacatgttgaagaagggaactggtggaaggtgactagatcatgggaggagatttcccccttgctgttctcataatagtgagtaagttctcacaaaatctgataaaagtgtgtagcgcttcccccttcactctttcttcctcctgctttggtcatatgaagatctgcttgcttcctctgttctttccaccgtgattgtaagttttttgagatctcctcagccatgtggaactgtgagtcaattaaacctcttttcttcataaattacccagtgtcaggaatagcagtgtgagaacagtttaatagagataccaatgaaaaagaatttyttgaaatgccgggtaaataatttaaaatattgatttttaaagatagtaaaatgcaagagaaatctgaaaaccaatacaaagaaatcagaaatcaattcaggatatgaatgagaaatttaccaaggagataaatagcattttwaaaaaataagcagaaattctggaactcaaaaattcattgaaggaaatacaacatacactttaaagcttaaatcatatactagaccaagcagagataagaatttcagaacttgaacacatgtcttttgaaataatccagtcagacaaaaataaggaaaaaagaataaaaagaatgaacaaagcctttgagatgtctaggactaagtaaagggactgaacatggactaaataaagcaactgaacttatgaattatcagtatcctgaaagggaagagagatcaaaaggtttagaaaacatattttaaaaaatcatcaataacaacctcccaagtctgtcaagactgttagacaaccagttcagaagtccagtgattccccaggcaaacacattacaraaaggaattcaccattatatattatgttcagaatgtctaaagtcaaagtaaaagaaagaatttttaaattagcaagagtaaagcatctactcatctataaaggaaaccccatcagactaatagcagacttttcagcagaaaccttacaggccagaagagaaagagatggcattttcaaagtgctgaaaggaaaaaaaaaactgtcagccaagaattttgtgtcctgccagaataagcttcataagtgaaggagagataaagttcttcccagacaaggaaacatttagaaaaattatcaccactagattggacctacaggaaatgctcaaaggggtcttaaacatggaaacaaaaggtcattgctcaccatcacaacaacacattgaaatataaaactcacagttcatataaaataatcacacaaggaagaagagaaaaaaataaaatggcataacratttcatcaaactacaaagacaaaaaaaaacagaaaaagagggaaacaatttataaaataacttgaaaacaatcagcaatatgacaggaacaaagcctcacatatcaatattaaccttgaatgtgtgactcccaaaaatctgagacaggtcccagttaatttagaaagtttattttgccaaggttgaggatgtgcacccatgacacagcctctggaagtcctgacaacatgtgcccaaggcagtcagagcacagtttggttgtatacattttagggagacacgagacatcaatcaacatatgtaaggtgaacattggtttggtctggaaaggcaggacaagccaaagcagrgaggggtcttccaggtcataggtagataagagacaaatggttacattcttttgagcttctgattagcctctccaaaggaggcaatcaggcatccctttatctcagtgagcaaaggggtgactttgaatagaatgggacgcaggtttgccctaagcagttcccgatttgacttttctctttagcttagtgattttgggggcccatattttcctttcacaaatgtaaatggattaaatgtccactattaaatacatattggaagaatggattaaaaaaataatccaactaaatgctgactataagaaactcaccttacctataaagacacatatagactgagagtaatggggcgtaaaaagatattccatgcaaatggaaaccaaagttgagcaaaagtagccacacttatatcagataaaacactttaaatcaaaaatagtaaaaaaaaaaaaaagacaagataattatgtaatgataaattcaacaaaacgttataacaattctaaatatatatgaactcaacatcagagcacccaaattcacaaaacaaatataagcaaaactaaagaaagatagggcaatgcaataatagtgggggaatttaacatgccactcacacactagccagatcatcatgtcagaaaatcagcaaacaaacattggacataaactggattttatatcaaacttaacagacatttacagaacattctacccaacaactacagaatgtacagtcttttcmtcaggatatggaacattttgcaagatagatcagatattaggccacaaaacaagtcttaatgaattttttaaaaactgaagccatatcaagtatcttctcaggccacagtgaaataaaactagaaatcaatactaagaagaagtttggaaactatacaaatacatggaaattaaacagcatactcttgaataatcactgggtcaatgaagaaattaagatggaaattagaaaattttttgaaatgaatgaaaatgaaaacacaacataccaaaacctgtgagatacagcaaaagcagtgctaagagggaagttgatagcattaaatgcctacataaaaaagtagaaagatcacaaattaacaatctatcattgcacttcaagaaactagaaaaagaacaaaccaaacccaaagttagcaaaagaaaagaaataacaaagaccagagcagaactatacaaaatagaaacaaaaaaaaaaaaaaaacaaaggagcaatgaaacaaaaaattgtttctttgaaaagataaaattgataaactgctagctaatcaaaaagagagaaaatccaaataaactcaatcaaaaatgaaaaagaagatattataacagataccacagaaatacaaaagattatcacagactattatgaaaacctacactggaaaacttagaggaaatagataaattcctggaagcgtgcaacctaccaagattaaatcaggaagaaatagaaaacctgaacagactaataatgagtagcaagactgagtcagtaataaaaaatttcctaacaaaaaaaaataaaagcccaggaccagaaggattcatagctgaattctaccaaacaggcagagagctaataccaatcctcctgaaactattttagaaatcagaggagggaattctccctaactcattctacaaggccaatatcacctgataccaaaaccagactaggacatcacaaaaacagaaaactacagaccaatatctctgatgaacatagatgtaaaaatccttaacaaaataactgaatccaagagcacatcaaaaagataacacaccatgatcaggtgggatttatacaaggcatgcaaggatggttcaacatatgcaaagcaataaacatgatatatcacataaacaatawtaagggaaaaaattatcatttcaatagatgcagaaaaaacattcaacaaaattcatcatcccttcttgataaatattctcaataaactaggcatagaaggaacatacttcgacataataaaagccatacaaaccaacagcaaatatcatacttaatggggaaaagttgaaagaattctaagaactgggacaagataaggatgccaattttcaccactcttatttaacatagtactggaagtccttgccagagcaatcaggcaagagaaaaaaaataaaaggcatgcaaattagaaaagaggaagccaaattatccctgtttactgatgaaatcatattatttatagaataccctaaagacttcaccaaaaactcttaaatttagtaagtgaattcagtaaactttcaggatacaaaattaatttacagaaatcaatagtgtttctatacaccaatattgatctagttgagggccaaatcatgaagttaatcccatttacaatagctacaaaaaaaatacttaggaatatatttaagcaaagaggtgaaagatctccctaaggaggaccacaaaacactgataaaagaaatcatagatgccacaaacaaaaggaaaaacatcccatgctcatggattggaagaattaataacattaaaatgaccatacttcccaaaccaatccactgattcaatgcaatcactatcaaattaccaatgtcatttttcacagaattagaaaaaaacaattttaaaattcacatggaactaaaaaaaagagccctaatagccaaagcaatcctaagcaaaargaacaaagctaaaggtatcatattatttggctgactaaattattctaccaaggtatacaaatagacacatagatcaatggaacagaatagagaacccagaaacaaagccacatacctaaaaccaagttatctttgaaaaagtcaacaaaaatattcattgaagaagtgacaccctactcaataaaaggtgctggaaaaattggatagcagtatgcagaagaaagaaattasacccatacctctcaccacttacaaaattaacacaagatagatagaacacctaaacatagacctgaaactataaaaatactagaagaaaacctaggaaaaactcttctggacatttgcttrggcaaagaatttaattcaaagtcctcaaaagcaaacacaaccaaaacaaaaatagacaaatgggaataaattaagctaaaaagcttttgcacagcaaaagaagcagtcaacagagtaaacaaacaacttacacaattggagaaaatatttacaaacattacatccaacaaagggctaatattcagaatctatagggaactcaactcaagcaacaaccaaataatttcattaaaaggtaggtgaaggacatgagcagatatttttcaaaagaagacatacaagcagccaacaaacattaaaaaaatgctcaacatcactaatcatcatagacatgtaaattaaaaccacaaagagataccattttacaacagtcagaacagctatctttaaaaagtataaaaacaacagatgttagcaaagatgtggagaaaaaagaatgcttatatactgctggtgagaatgtaaattagtacaacctttatggaaaacagaatggagatttctcaaagaactaaatatggaactaccatttcatccagtaatcccactactgggctgtattagggacagcgttctctagagggacagaactaataggatatatatccatatatgtatacacacacacatatacacatatatatacatatttataggcgtttataggatatatatcctattttgtgtgtgtgtgtgtgtgtgtgtgtgtrtrtatatatatatgggagtaataggatatatatcattttatatatatataggagtttattaagtattaacttacacatgatcacaaggtcccacaataggctgtctgcaagcttgaggggcaaggaaggccagtctgagtctaaaaactgaagaactttgagtttgatgtttgagggcaggaagaatacagcaggagagaaagatgtaggctgggaggctaggccagtcttgctcgtttacatttttttcttcttgctttatattcactgagagctgattaaattgtgcccaccagattaagggtgggtctgccttccccatactgctgaytcaaatgttaatctcctttgtcracaccctcacagactcacccaggggatcaatactttgtattcttcaatcaagttgtcactcagtattagccatcatatgggcatatacaaagggaaagaagtcattatgtcaaaaagatacctgcactcatatgtttattgtcacactattcacaatagcaaagacacagaatcaatctaaatttttatcaacagaggattggataaagaaaatacgatataccatggaatactactcagccataaaaaggatgaaatcatgtcttttgcagcaacatggacagaactggaggacattaccctaagtgaaaaaattcagaaacaaaaaatcagatgccacatgttctcacttaaaagtgagagctaaacaatgggtaaacatagacatacagggtggaataatagacactaaagactccaaaagttgggaggatgggagggagatgaaggttgaaaaattgcctattgggtacaatgttcactattcaggtgatgggtgcactaaaagcccagacttcaatatgcatgtaagaaatctgtgcttgtaccccctaaatatacaaaaattttaaaaagttaattttaaaaaagcagtttaaaaaaatgtgatcatgttttcttggctgaaattcacacacacatatatacacataaatcctttgaggtccacaaggaaggaaacctagaactgtcaacttgtacaaggtgatggggccaggactagggcccaggtttaccgaatcctagtctatagaatttgccaacatatcacattgtcagagcttaktaaatgataaaagcttacattttagttccctactccatttctttctctcacatcacctctcctgaccgtaaaaatgaccccacaagcatgagttgtacagaaaaacctggataatccacaaacaaaatcaagtccatcgtgtaaggagggccccagccaccactgtagttttcgcattgcccccttgtggtaagtgaagaaatcacattaatttcagaaaggtagagaatcggaaacactcaactttgattaactgaatttctagttatatggtgccataaacttttatgctgaaaatctttgaaataatttatatttcttgatttcctagtaggtacaatatccaaatataaaatgaatcatcttttattccctcgacagatctgtattgattgtcttccccagacatggtgctgtggactggggaatgcatatcggttatgatgctttccctagtggagtnttcagtctgtgaggaagataacatcaacaaaaaaaaacccactcatcattcaacagatatttaccacctatagttttccaggcattgtaactaatgttgggcatagagtggaggacaagaaaatcattgtgtgtttgtgtgttgcttgcacaaagctgacattntagtagggagaagctggggaagtgcatttcactgggcaatgatgttagtgtagaaggtgtagggaatagggttggatcagaaagaatccaagcctgtgtcctggatgtttgctttttaaaagaaatccaaaatgtcagcttctttgctgattatttctttacctcttataaaagcagagtaaagaatatcctcacccatctccacctaaactgtgcatatgagctgctgtggagagttctgactttcctgtcaggagatctttcttctgaaactggctcttctagttacttaccacatcctgtgtgccctgggatcatgtcatacctcttctcccggtctccatttcctacaaaatgcaggatttaaaagatgatctctaagatatcttccagctctagtggtccatgaaatggctaagttaaaaaaaaaaagagattcaactataattgctgtccttcttgagcacctgcttggtcattggtggtgacaatattctctgtgtttcttctggtgacaaccagaaaccttaagatggacttagagacttaagggctgcaggaccagagtaggcagcatctaggtgatgaaatccaaagtctactcgtcgttcttgttctcacagggttatatttgctaagagaatgatgccgaacaaaccactatttttcctctctggtagagtaggttgtctctttgcataattatcatgtgttcattagtaaactcatgatgctttcttctcacagggtataattgtgagtctatttatagttgctctattttccttctgacatacctaaagggcacaatatgcacatttgttgtattgagaccacactgtgggaatggacccagcaaatgattgggccttattaggagcccagttgccaatctagctaagcctcaatatacatgtaaggcgtaatttgtctgcttcactttcmctgtgtccatttgacttggaaaatgtgccaatgttccaagcacagcacttgggatgtagcatgctggggaaaaaaaaaaatggatgtgagagtcgccagctctggatttgtagtaggtctctactctgtactatctgtatatatttaggtgagtgatttatccttgataaatttcctcatctgtataaggagcaagaaaatctacctcactgggttgttttgagaatcataattcctaatttaagttacagcaggttaatctacrcatttgacatgtggcacatagcaaaaggttaatgaatgttagttttctccttcaacaaacttaccattacaaaaatagcaaagatgtgtgccaaaactacaactagtaaaggaacagaggaatctatggatggatagcccttggagttgcatttcaacaataagaatatacaaagaactcgtggagcagaattttgtgaaaaaagattatggatagagagatgcccaaccttgaattggacagttgtatgaattttaacattagctaaatgctctttctttttttaacactgagaaggtaagtaatacaaaaagctaaaagagcatacccaatagaaaaccactgcaccagaagccaaaaaacaggcattttcttatctagtaataaccactagcttaatgaacttgaacaaacaacttgatgtttggggctttattttccatctataagagttaaatgggaaaatctgctgttctatagaccatcattataaaaggtgaccttaaggaggaatgggaattgtggcatcgcagtttggggtttcagggtatttgcacagtaattttaaaaatatttatctttaaatttttgaatttttagactctgtaaacttacgagttatgctatgctgggaagaattactgtgctactttctgaacccacttttaccagtattgagcaccatgaaggccctagaaacttcatcctacaaacagtaaaatctcattaatttagaacccctcctactcactttgtaatttgccataatttgaacgggttacttttgctttacaaaaaaaaggatttgttaatggagtagcacatattgtttccaaggagatttatttggcaaataatagctacttagtaaatatttttgaataaatggtctcctttgaacaactatttgttgacactgttttaatgactcaaattaattcaggaaaatgaataaagatgtattgtatagctctctaatgcatacttctgaccttcccagttccctcacctggcctaaattacaaaggttctgttatgcacaaaatccatttcaccacaaggcaatgtcattggagtatrttctttcatttttcttattgtaacaagatcctcagttacttgaacagatgtctgtaaattcagaatacgtttgagtgtagtttactaagcattatacactaaaaactcccactcacaatggccgtagttttttagggggtgggggaatgtttcagcttctggtgagttagaggcaacaacctcaatatcagatgaatgaaatttttttctctcctaaggcaattccagtcaatgctttgatagtttcttttttaatgctgtataktctatraaactaattaacyggcaaattacctgagtgaaagtcatattttctttcatttagtaatagagaaagatatmggtcaaaatattaatacaactttgagttttgtcccagacaacatttccagatctcgattccctccctccctcccttccttccctttttccttcataactccctctctccttccctccctctttgcttcctttcttccttcttcccttccgtcctctcttccttcttctgtccctccttcctttccttccttcctttcttccttctttctcagttttattacttaaatgttttaatcattttatcatccttttcatctgtgttgatgaaaaaccaacacaattgcctaaaaaggcaaaataacaagacaaaaattctgtaagtcatcaccattggttttcattcaccrggttttccgccccacagaggactgtagtacatcgtcatcatattcttagctaactttcgtttaattactagcatgtttaaagtggaaccattatttaaaagactttattttttagagcacttttaggtttacagcaaaattagaggaaggtacagagatttcccatataccccctaccaccctacacgcataacctcccccattatcaacatctcccaccagaatgatacatttcctacaattaatgaacatacattgacacatcattatcacagakccacagcttacattagggttcactcttggtgttgtatattttatgaatttggacagatatataatgacatggtaagaaaaattcattttaaacatgtaaatagatttatttttctatttataataaagttactttcttgyttactatctttccaagactttttcaattcctgataaagaggaacaaaggtcacagatcaatggtgtgtgcctactttttgtagcaatgggctgtgtatctcttttcacccaatttctacaggtaagaaatgttatttttcagtaagtgatttagttatttttccttttttctcattaaaatttctctaacatctccctcttcatgttttagggatatgcctttgctaaatctggggagctcctaacaaaaaggctacgtaaatttggtttcagggcaatgctggggcaagatattgcctggtttgatgacctcagaaatagccctggagcattgacaacaagacttgctacagatgcttcccaagttcaaggggtgagctatgggaggggaaatagaagtatattaactgcattggcattctttcattagagcattctgacaatcacctgcatgttttctatggaatagggaccagtgggattgggatatcctaaagccacattttccactgcttctaacactgacaaacagcagctaaagcacagtgtctcccaggcagtgcccagaatcaatatatggcatgcaccaaaatctgtcagggttttggatttcctctgagtctaacttaggaacatttctgagtctgttttcaggcccagagactcagcttcaacaagattcaatactgcccccagggggtgggtgaacagggcaaggaagtctccttactcacacaggaccccagagtgtggtttagccttatgaacagagaagctgtcctgggcagcctctggaggagcccagtcaggaaactgagggaaagaaataaacgatttttatctagaatcttgaaggcgtcgaagagctgactttctgattaaggtagacagagctgtggtgtgtaaaccccaaaacctacagccttgttcaaggggcttacacatatgatgaggctagacttttacaaaaccaggtgtttggattaaagtgaagagagccaaattgcccttccaacatctctacccactttctgtgaaaatttttwaaaaaaccctaayttaaaattatttttaaaaagaaataatatgttaataaattctttaaaaaacaaaaccaaaggaaaaaaattttaagtacaattttaaaactgaactatggtctgtgaggctcttagaagaaaaaaactcactggactgatagtgctgtactgtagcacgtctcaactcctagacagtttaaccaaaaataccaaaaatgatatggcagaatttcaacggatcatggaatcctttcacttagggggaaatccctataaataggccactttcaattcatctaggctttttctggaagcacatgtgtttcccatagacttagggttacactctacatatgtgttgcagtctttcttgtttcccctgaaataatctaaggtgaacatattttcataattatgtattcttctacagtagatttttaatgagtgcacaatacttcattctcatctactgtcatgtcttaaaggattctctagttacgtttttcccctaggtttttctcctccttataagcaatttatatcattttatatcgagcttgccacatccttgattattttcttagttctcaaaatgtaatcactcaatcagtgtataatcattttggaagattttgatatgcattgcataactgcttaaagaaactttgttccaatttcactctcatcattggagtactgtagtctactccctttactcttgaatttaggctaaataaataagtcataatcttatctcttctatttttgtggccttcaatctgcaaggagcttttgaaggttatttgctatcactagaattcagagagtagcatctaattatcttaaaaacacttatctttttaaaaagaggattttctcagaatttttctaatacttttgttgttttttaaaaaataagattgctagcccaggtcaaacttatcttaagattagtgtgaggtagatttggctttgttttcttgaagttggatagaaaatatttcaaaaatattttttaaatatagattacattttctactggtttgaaatgtttcctcccattgtgaatattaacttcccatatatacttagaactaactttggagattctctagtctgaattgatcaatttgacttattctatttaaaaccttattgttttarttgataattttttttaatttttgtagatagataccaagtaggtgtatatatttatggggtacatgagaggttttgatacaagcatgcaatgtgaagtaagtgcattatgaagaatgaggtatccattccctcaagcacttatcctttgtgttacaaacaatccaattacactcttagttatttttaagtgtacaattaaattatttattatagtcattctattgtgctatcaaatagtatgtcttattaattctttctattttttttttgcaccctytgttttaattcttataacttgatacattttagtatctggtaaggcaaatccctgcacactaatttttcctcttcgaaattctcttatctatttctggatgttaattattttaatacattttacactcattttaacttcttctaaaaatttatttttattctggtgaaattcatatgcacacatacatacacagtaggattgctattgtggggatactaaattttcctgagagacatacaaacaagactctagtttttagcaagattcatagttatattwatatgtcccactatcttgctcactttttctcatgtattttttccactattttgaatgagatctttttctcaattatatctgtaaatgagttgagatgaaagctgttagtttttgtatrcttatcttaaggactttccaagctctcttataagttataattttagaaatttaatagtctactgggttttctaggtatataataaaataccagatatagttctgaaatattacaggtttggtttcagaccaccgcaataaagagaatattgcaataaagcatgtcacactaattttttcrcttcctagtgcatataaaagttgtgtttacactatactgtattctactaactatgcaatagctttatgtctaaaaataaacaatgtacatatcttaatttattaatagcaactgactgaccacggtggtggttgctgaaggttagactggcaatatcttataagacaactgtgaagtttgcctcatcaattgactcttcctctcatgaaagatttatttgtagcatgtaatgctgattgatagtattttacccacagtagaatgtctytcaaaattggattgagttctcttaaaccctgctgctacttttattaacatagcattttcaccaggagtggatttcatctcaagaaaccagtttgcttatccataagaagcaactgcttatccattcaagttttatcatgagattgcagcaatttaatgcagcacatcttcagactccacttctaattctagttatcttgctattttcatgacatctgcagttactccctctgaagtcttgaacyctcaaagtcatctgtgagggttggaatcaacttctttcaagcacctatttatgtggatattctgacctcctcccatgaatcacaaatgttctttcataaatatatatatacatataaagtgtatatctatatatacactgtaagttctagggtacatgttcttaatggcatctagaatggtgaatcctttccagrgggttttcaatttactttgcccagttccctcagaggaataactatggcagatgtagccttgtaaaatgttacttcttaartaaaaagacttmaaagtgaaaattactccctgacccatgggcagcagaattcatgttgggttaacaagcacaacaacattcatctccttgtacatctccgtcagagcacctgggtgactaggtgcrttgtcaatgagcactaatatttttgaaagctgtattttttcctgaacagtaggtgtcaacagtggcttaaaatattcaaaaaactgtgttttcaacagatgtgctgtcatccagcctttattattctatttatagaacataggcagaggagatttagcatgcctcttaggggcctagaatttttggaatggtaagcttcaacttaaagtcatcagctgcatyatcccctaacaagagagtcagcctatttttcgtaagtttgaagtcaggcattgacttctcctctctagatatgaaagtcctagatggcatcttcctccaatagaaagctgtttggtcaacacggaaaatatgttatttggtgtagccacctttatcaatgaccttagctagatcttctggagaacttgtggcagcttctacattagcactgctgcttcaccttgcacttttacattgtggagaygcttttttccttaaacctcataaagcaacttttctcccaaagyttcctcacttctctcagccttactagaattgaagagagttagggccttgttctgaattaggtttggcttaaggcaatgttgtagcaggtttgatcttgtctccagaccattcaaactttcttcatatcatcaataaagctggttcacttcactttcttattatttgtgtgttcactagaatagcacttttaatttccttcaagaactttttttttctgcattcacagcttgactatttatttagycctatctcaggactaaatgaggctaaaatgaggcctaacttttagcctatctcagccttcaacacaccttcctcactgagcttagtcatttctagcttttgatttaaagtgagagatgtgtgactttatttcacttgaacacttagaggccaaggtagcgttattagttggcctaatttcaatattattgtgtctcaggtaatagggaggtctgaggatagaaagagagagagacagaatgaccagtcagtggagcagtcagaacaaacacatttattgaataagttttcagtcttatattggcgtggttcgtggtgctctaaaacgatggcaataataatgccaaagatcactgatcacagatcaccataacagatataataatgaaaaagtttgaatattttgagaattactaaaatgtgatgcagaaacataaaatgaacacataccattggaaaaatggcaccaatagaattgctctgcrtayacagggttgccacaaaccttccattagtaaaaatcacaatatctgctaagcaaaaaatgcaaaaaagatcattttgtcttttcttttctttttttatrtttatactcattttattttcttattatattagctagagctcattgagaaataagagtggtagtagaggtgattctctcaagcaagacaaaaactcaaaactacaaagtagacatgttggacttcataaattcaaaacttttatataaacaaatgataaactagaaaagcatttataataaatattaatatccctaatataaccatattatgtgtagtgttcctaaaaccatcatgaacgatattcatgaggatggggaataactgacactttcatacaatgtacaaagtttttcaatgttttttggagagtaatagtaaataatagtaagcaaatgttttggagagtaatagtaaataatgatatccccccaaaaactttagagttgcttttcaagtattgtgtaatgcctgacagtccttgccaaccagaaattctttttcttttttaattatatactctttgaacagaattctgatgagtgaattccctcctattgtgtaagaatgtgtgttcaaggatatttatcattttttatattaaccaaaaaattaataaaattccctggaaactacccaaatatccatcacaaacagaaaaagagttgaatcaattatgatacatttatactaaggaatattgcacagctattttttaaagtgttcctatatattgatctggaaggatagttatgtaccattgataagtgaaaaaaagtcaaagtacaaagtaatatgtagagtatgagccctttttgtaaagaaaaaaattaaaatatatgtatatattgttaaatatgtatctatgttttgtttgtgtcttaggttgtattattttcaatttttaaaaaaataccaattgaataaaatgtaaaaggaaacaaaataacgacatcccaaagarstgcaaagttgcttttcaagtcctctgtaatgcctgacagtccttgccaaccaaaaattcttttttaaaaaaaattgtggtaaaatatttgtaacacaaaatttactactttaaccatctttaagtgtacagctgaatggcattaagtacatttacattgttatgtaaccatcaccactattcatctctagaaatgttttaccgttccaaagagaaattctgtacccttgaaacggcaactccccatcctgctctccctcccctcagccccagcaaccaccattttactttctgtgtctatgaayctgactactctatgtacctcatctaagtggaatcatatgaatttatccttttatgtctggcttatttcacataacatgatgtttttgaagtttctctatgctatagtatgtgtcagagctacatttttatggatgtttattttatggatatatcatgttttctttattcattcatctgtctgtggacattcaggttgtttggctgttgtgawtaattctgctctgaacgtgggtgtacaaatgagaaattcttgatttagcctgttagtctccaaggaagtcagcactaacacatrggaatgctttgggacacaattttatattccatttgtgtcttcaattcagtataaagatgcaaattattcctgaataacagtgccttagcatcgaatggttactaacaggttaccttttgtcgttttacatttttttgtcttaaataaaaatgtgtttctacaattttaaaaagaagtgatgtaattgtcctcacccaagtattttctacagagtgtgccaagctttggtcgtacctgcctagctgcaactgaaacracgatttggaaccattggatactctgattagtatagatataattaccacagtggtccattctccatctatattgggactgaatccattttgtccatctgcattgactaaatagctgtgtattacagcagcatgtaactttgtaccaaygagcaggctaacttcaatgagaatcaaagtggtatcttataatagtcttgtatcaacttcaaaaatataattatagagcaagcattaatcttcattgaataagtaatattacctcaagcccaatggctggatatcttcaaacaagccaaatgcatcagtacttgacacatgtgtagcccatgtttagggctgcattaatctcagacagactgctctagcactgacactcttaaaatgagattagtcaataaatgaacttcggataagctatgaataaagaaccttttaattaattcagccttcagatacgttatgtgagctcatcatttaaaagaacttaatcatttaaaagaacttaactttttgaacaggggactaccatatgacccagcaattccactcctaggtctatatccaaaagaattgaaagcagggacttgaaaggtgcttatacaccagtgttcatagcagcattattcacaatagccaaaagttggaaataaccccagtgtccatcaatggatgaatggatatacaaaatgtgatatacacatacaatggaatattcagttttaaaagggaatgaagctaggtgtgatggctcgtgcctgcaatcccagcactatgggaggccaaggtgggaggatcacttgagcttaggagtttaagaccagcctgggcaacatagtgagacctcatttctactaagattaaaaaattagcaggtgtagtggcatgcatctgtggtcccagctacttagcatgctggggcaggagggctgcttgagtccaggaggtcaaggctacagtgagccataattatgccactgccctccagcctgggtgacagagtgagaccttgtctcaaaataaaataaaataaacaaaaaataaaaataaaaaggaatgaaatttgtatacctgctacaacatgcctgaagcttgaaaacattatgcttagcaaaataagccagacacagaaggaaaaatattgtatgattctacttctagagatacctagggtaggcaaatttatacagacagagagttagaatagaagtcaccaagagcttgggggagagagaagaaagggaggttattgtttaatggatacagagtttttgttggacatgattttaaaagctttaggtatagatgtgtgatggttacaaaacattgtgaaatgccactgaattgtacacttaagaatggttaaaatgatatatattgttatgtatattttatcacaactttataaaaggtctgacctttttgtgtaatggtaattggtaaaagcgactgtgtgtctgagacgggttgattgctttttggtttgcaggctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacaggtaatcttgcagatctaattttcccattcctcatggctgagtggctatcagacaaactgttaaaaacgagtagtacgaagagactgaaggaagctgtcagcccacaagacaggcacacttaagaaccttccaccaccctttctatgcgtgcttggcgcaaaggctgaggcaataaagctccgagactctgagtatgagccagtgtggagaaatagcggagtgaacacaggattgcctgttcaatttcctctcgcatagtgattcattccacattccaatttggtgtactctcatttgcaggggtggatagttcagtttyctggccgtgaagcttttgcaatttaatggttcccctgagccatgctttccacacacacaggagctatgatggttttaatggcacatgcctttgctcttcatactttagagtcccccaggcttggggcaagtgtctttcccaaccagaattatgaactacagtttaggttttggatacacttaggttttagctacacattttaaagtgtgttctaattaatatcttgtccttgsggggtaaatgagggatrgtagcataaacacttctcaagtataagaattaagggaaacttgaatttaactgaaaaattgtctcgtggtccagttgggttgatctccagccacgtctttgtattcccagatgatgcattctctgatttgtaccacattctgccatttgcaccatctaatccaggcagccactgaaatgtcacgaaaggagttatttctgcccttgtattcctaagactctttttcaatcttcagattacaaatgaagccctcagtaacatccgcactgttgctggaattggaaaggagaggcggttcattgaagcacttgagactgagctggagaagcccttcaagacagccattcagaaagccaatatttacrgattctgctttgcctttgcccagtgcatcatgtttattgcgaattctgcttcctacagatatggaggttacttaatctccaatgaggggctccatttcagctatgtgttcaggtgaggaatatctagccaaggtgagaaaagatcaacacacaaggaaggaatagcctggttctgtcagttagctttttgctgcttagcaaaccatcccaagcttggtgtcttacaatagctgggattaattatttctcaagattctgtgggtcatcagggcggttcttctgacctgggctgactcagtcaggcttctgtgtattcttctgtctccacatggcctgtctagcagatgagcttcttttcttcatattayggcctcagagttccaagtgccacaaaagagggcaagccccactgtgcaagtacttttcaagtctctccacgcaaagaaactttctaattttctgtttggccaaagaaagtcataccatcaagcccaggtttaaggaatagaaaaaaatagaatccactttttgatgagaggagtaaaaaagccatgttgcaaagggatgcatgaaagtgtgaattaatatgatcgttgtttataaacaatctgccacacatgttaatgctgagaaaatctagaggtcttggctaagatggttcatagagaactgttttgtttgaactcctctcttgcaaagagggctgactcctcccaactgactcctcctaggcagagacagcatgggccatacaggtgaaggatgttccattcgtatagccaaagcctgcttttctaataagattagcttttagtccaatttctcacatttccagaggtgaaagcctaagggtgtcagggtactggggaaygaggtacacatgtatatgggcgagtcggggggtaagggtggagatggtctgagaaaggtttggagggcattaggaaaagtggtcctataggaatcggttcttgggtttccttctctagccatgagtcccgccttctcacctggtatctctttcagcacttctctcccactccactacacccacccagctaggaaagtgtctcttttctaaatctttgcatatttaaagctactagtctaaattagaaaacacaaaccattggcttatttttatttagtttatattaaggttttagaataattttagaataatttagaataattttagaataatttagaatatttttttgccaacatgtaaaaatctggggctacaggctgggtgcggtggctcatgcctgtaatctcagcacctcaggccgaggcgggtggatcacttgaggtcaggagttcaagaccagcctggccaacatggcgaaacctcatctctacaaaaaaatacaaaaattagccaggtatggtgatgtgtgcctgtaatcccagctacttgggaggctgaggcaggagaaaggagaatcgcttgaacccaggaggcagaggctacagtgagctgagatcatgccactacactccagcctgggtgacagagtgagactccatctcaaaacaaaacaaaacaaaaagtggaactacagaaaacttccaatttctggcttcactttaaaaattggaacgtcatcttccaccattttccatttcatttcaagtgcttttcattcccttaggctttaaactgggctcccggggatgttcagatttgcaattctggcctaaaacaattcctgcttatgaactgagcagtgtgacacacaaagacacatcccttatccctatccccatcccaggcagaccctctgtgcatgacagtgcaggtgagcagctttgggggctactactcacatcataatctctacagcaacaaagttatctctcattatatttatcattcatttattcattcactctttcgttaattaagtacatgttgactatagttagaggctaagacaagtagaaggagacaggcaattgcatctgtcttgctctctgaagcataaattatatacatgcctggtgcaaaaatgatgcttatatcatcaatcattatcttttatatacctattatagattcaataactgttagaattctagaaaaatcaactcaatctggtgatctttcaagcctgctttttcttttaaaaaaattttttcagaagtctttttccccctcaaacaattttcttttctttttttttttttttgagacggagtcttgctctgtcacccaggctggagtgcagtggcgcgatcttggctcactgcaagctctgcctcccaggttcataccattctcctgcctcagcctcccgagtagctgggaccacaggcgaccaccaccacgcccagctaattttttgtatttttagtagagacggggtttcaccgtgttagccaggatggtctcgatcttctgacctcgtgatccgcccgcctcggcctcccaaggtgctgggattacaggagtgagccaccgcgcctggccaacaattttcttaaaggaagctattgtggtcraataaaggtttggaggtctgagctctccccccttcatgcttgttcagtcctcttcttactcctttttcatagaacacagtttgaaaactgccagtcccttaaacaccaccctctccatttccagacaagtctgaagtgacttgctcaaggatatttggtcctttcctggcagaaccagggctagatccccaaacttctgccttcaggtcatcacaccaaccacgccaccctgctctcttcctgtgtgtctgtctggttacagggtgatctctgcagttgtactgagtgcracagctcttggaagagccttctcttacaccccaagttatgcaaaagctaaaatatcagctgcacgcttttttcaactgctggacygacaacccccaatcagtgtatacaatactgcaggtgaaaaatgggtaagtgttggaatactatgcagccataaaaaaggatgagttcatgtcctttgcagggacagggatgaagctggaaaccatcattctcagcaaactaacacaagaacagaaaaccaaacaccacatgttctcactcataagtgggagttgaacaaacagaacacatggacacagggtggggaacatcacacaccggggcctgtcaggggatggtgtggggtaggggagggatagcattaggagaaatacctaatgtagatgacaggttgatgggtgcagcaaaccaccatgacacgtgtatacctatataacaagcctgcacattctacacatctaccccagaacttaaagtctaataaaataaataaataaataaaatgtgtaagtattgatgaggggtaaggttgtgcgtrtgtgtgtgcaggacagccattagggatggccatacaataccacttggcttctaaattcctgctgtatatgggttcattcatacatacttggagaagacaaacagtagatttataaatacaaaggaataaagtaaattagcatcaaaaattattcctaaagctggcatttgaacaaggtgatgacattcagtgaatgctaaattctgtgtaatataaaatacacttagttcccaaatgaatgaagccagttgtcctctgagatctacctaaccactgtgttttctattgatgttctgatacagaatgtagaaaaatcacttcttcctgtccaataacattgatttaattcatgttcatcttgattcaagttttagcttatgtggatgtcctgaaaattaattcaatctcaacaaaatatctgttcttctaattgayagataggtatttgtaaatcttctctacctatttttgaaaattttagtatgttccagaaagcaaagcaaacytaaacactagtaaagctaagctaaattctgtaatctttctaaattggtaaaatttctccttcagttcagtaaatgtaaagtttctgtgtggtctattaaatgtctatccatttctagattttataagttagagttttaagcacaccaaagtacaatagaaagtattcacctttgcagtacagacctcaggtaactttctttctaggtcgttttaagtgtaacattatttttagtctttaggagaacaaagctatagggtttggacagttactggcttctgtratgtcatatcttccagctattctcttctattcagaatgtcaggaatagatggcaagaaaatccccttatgttagactgggaatagggggagtcaaatgtctttaatttcgttgcccaagccttcctttatactacatctttcagaacacaaaatggaatgtccttttattaagttgctgtctttatactttgcactttggcagcatggtttgaaggtatctcaagcagggattttaaactcaagatttaggtgtgttttcaatattctaggcttcagtaagagcatctctaattttgatcctcccatccacaggacaacttccaggggaagattgattttgttgattgtaaatttacatatccttctygacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtggtaagccacgcaacctttttgagaattttgccttctgcagagtatttccaacccctaaaagtgggcttcaagtttttgctttgccagactcactttaaaatgcttgcctaaggcacttaccccatgcatattttccagtcccagtcatttgctgcttcacctgattctacctcacaatttctaatgtcagattttccccagttccagatggcctgctgaccagttaggcaaagaaaactgggcacactgcaaagctggagatgagtgtatttaatagaagcactcacttacccgtaaatggagcagaaagtgcagactaatcaggaaactaatgaccaggaatggaaaaagtagagtgataagggaaataatgataaatgagcaagaaaggagagttagcatgaaaagatctaagacaatccttgttcaagaagctgaaatctaaataacgcaaggaactcagattgagagccatgtaccataaatctttagcaaggatatttgaaattttggtgaatagctttggtatttatttttcataacatttctttctcttttctgtcctttttttctttctttaaaagtaatatatgcagaaggtcacaaaatcaaataataaatatttataataaaaagccacccccctgctttatgcttacactcccactccacatttctctgctcaaaggcaactatttttgaccacttgatgttttttgatctcccaatggtgacttttatgtctttaaataatatgctcatgctatttcatgatttaacaaatttagactctctgtgatttattctcaagagataaaaatctacttactctcaccactccctccttttgcctacctcctcccaatatagttatatcattttttaggycttctatttataaatttgtaaacttctgatctgcttccgttgctcttccaccacctgtagatagttcctcttgaattctcactttctaaaagaaaaatgttagcaatcctacctttattttcacctcttactcttttcacctcttacttcttttacctcttaagttctaactgcacttttatcaagaattcagagcacattctgtttataacattatctttcctgccttcactctaagttgattctaaaagttgaaaatcaattgacagcttttttaatgattatgtaaatattgttcatccttcagtcaaatagtgagttacatttacattatatttttttgattgtttttctgaaaggtttctttttttcttgcattctttgtcttcatgaaaacctttgtgttcttccaatgtctctgtcaggccatctcttccctcatttctgtcactcgcaacgtttgcctgttgaacagtcatcatcctgtgagttccctgtgatatttccttggattagatccattatttcgtagttcccatacattcctttttctagtttttacccccttttgttggagctcatccaaaagcaaatttctaagaaatagttcatagatatgggtctgaaaatgttttgttttgcttcatacttgattaattgtttaatccctatattttgaaagtggcctttctgacttccctgaatagtataatctttaatgtaatatactattatgaagagtataacattatgaagagaaatgctaagaaaattttgaaaaaggcaactaaagatttccttgtataaagcaaagcaaggaaacaagcaaacagaaatkgacagaatccaggaagttataaaaataaggactaagtattgattgcctataatttataatcccttctgttattaagttgaggtataaagattgtaaatttgtttgaaagtatttggtaaccaataaacctagaaagcccattgtaaccagaggtataattctgataagtcagagggttcaattttccaaaatgtcacttctggcatgcctgcagccaacatagattgtgaactatgcaaggtacaggaaactgaatccctcatatttacttttccaacattaacatgtacattaagtatatttctctgaatatgcccagtgaatgttctggtcacaggtcgaaagcaaggccaataaggaaatcattatgacttcttgcatttcataggcacagtatattttgttacaacatcgtaaaacatttctacaaacattttaagcagaaaacctaccactttttaygtttttttttcaaagtcctctttgctcttaakctaccaaatgtaggygttcaatattttcaacatttatttggatacctatgatgtgcctgttactgcatgagtccctgtgggagagtctaaggaccatgaagcatgtcttctgccttctaggagcttacaatgtagcacatttagaagaatgagcaaacagcctgagtgtttaattattaaattgtgttttgcagacttaagtgctatggaaaatgagtagagcaagataagccagggctaattgttattgagaaatgctttatattttttctaatagtgtttgctttttccattacttagaaattatcttaaatataatctgttcataccatttatcacaatttttttctgaaataatagggccaaatactttatagtagcacgttaggcatctgtgcctttaatattctaggactctttagtgaatcagctcatgtggtagatattcaagtacctggactyaactgcctaactagactgtgagttcctaggaaacagagattatattttctttacgtagcagacatagatggcttaggatggtgctttgtggcaggtgattcaaatatatgtttgttgattgactaagtgaataaatgtattccttttttacttggttttattatctcagttatgcagagaatggtgttagtaaaatcaagaaaacaggtttgacccttatattgcccaaaagcttcacagagaaaaatcctttccataactcatgagtctcaaaatagagcaaccctgtatatttgtagagagtgtgctgcaccaaagtaaggggacgttgtttcttacctgaatacctgagcgtctttctcgtttgccccacctgtagagccagagttcaggaaataaataggaccatagtctgattagtgttaacatggatgccactcctgatagacattacatccagaggtcaaaggcaacataatttattccataattttagccttgggattgttagtctgttaagcaaaccaaatgtcctgcataacacctaatgctagaatatgaactttcctcactgctggaattctaaaaacctaatgacctgtcatctcctctattggcagatgatagatggtcatgacagcaaaaaagtaaatgtccagttcctcygctcaaacattggaattgtttcccaggaaccagtgttgtttgcctgtagcataatggacaatatcaagtatggagacaacaccaaagaaattcccatgraaagagtcatagcagctgcaaaacaggctcagctgcatgattttgtcatgtcactcccagaggtgagtacgaagtcagagccattccctatgagagacaaggatggggagaagtagaatgaccagagtgtacaggttgagcatccctaatctgaaaatcccamatccaaaatgttccaaaattcaaaaatttttgaatgccaacatgattccacaggtggaaaatttcacacttgacctcatgtgatgggtcacagtcaaaatgcagtcaaaactttgtttcatgtacaaaattattaaaaatattataggaatttacttctgggctatgtgtataaagtagataagaaacaggaattttgtggttagacttgagtcctatccccagggtatctcattatatgcagatattccaaaatctgaaaaaatccagaatctgaaacgtttctggtcccaagcatttctgataagaaatattcaatctgtattatgattgtggctctagaaggtcaaaggataygcaatttatttcacagtgcccctggactgtcttagttttttaagcaaaagaaatatccttcatcaacatactctttaattttggaaagtattgtattgcccaatgcaatggatgctatttttgttgaatttttttgtacattgagctttagtttagcatagtggggaaamacctgagatttggagctgacctgggcttgcatccaagctttgccacttagtagcttcatagctttgggacaattatcctttctgagattgtctatttcatctgcaaaatgcaagaaaataacgttaaaatgaagaaaacacacttaatagccacacaawgaaagcggccrctggtattactgccatcatcattatttcattacttggcaatgtgtaccgtgggtggtgggtaagttacacctgccttactgtctcttactttgccaaacccaagtccagatttcgcgcaatattgactctgcatttttccatccaccaaaagtccctcttagttttgatcacaagaaaaattacaacatggaaaccaaattgtagggccaaattttacctttaaccttctctacttactttttaaaaatatccctgggaaaattgtttttctttataagtgattatgtttataarttttgtgggtttgtggaaggctttttgtttgctcttttcacaaagtctcctaagttttaggctcttggcccagttcttacctgttagcccaawctataagcacatggaaattactatttgctgaatccagagatcaaaagcaaagattgtgtgtctcctggaagattcatttatcccacaaacccttattgaatagctactcatgttgggcaaggcactgkcatggagctggtttactgcattgtcctcatacagacttgcccgtggcacccttctctgagcactttgtctccacaaagacaaagcaggttttcatgggtctcacctggcttaaaggagcattcctcaggaggcaagggaagcagggaaaggaaacagctcgtgttgtggaaggcaaggaagagaagtagtcaaggcaaggactyagaggagagcaagattcactttcatctggattcagatttcactttcactgcttgttacttgtcctcgcaccattttcttacctccctgtgcctaagttttgtaatctaaaaaatagtgtgggtatggtttctgtgaatattaaatgataccctagctagaatagttagcacaatacctctatggtaaacactctatgaatgttaactaatttttatgtagccatgccaggcatgagtgattttttcttcctaattttctctaaaactcacaataaatatgtgaagtaagtgttaatactgcacctcagatgcctagccagctcaaaaaaatttaaataatttgttcatgaacacaagctagtaagcagcagagtggagcttctaaccaaagcctgtgttccagaatgctgcctccctaatacagcaatggaccagaagatctcgcaaaagacatttccattcttgggattagtccatattggaaggatttttccagataagaatctagaatcagagagtctcaaatcaaggaggatctcatatatgggctcttatgtggacacagggagaaggagattgaaaatataaacctaaaagaaatgcagaaatgaggaataawgtccccttgcttcccacatcaaatgtcacaaattccatatttttcttatattcctaagtggatttgacatcctccatcctataggaggactcactcactgttccctagttcaacaaacaaataatttaaattacagaggagaccttgacatgagttcagtacagcacaggagcaataactgtttctatttctcaaacttatcatactttttttcagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaaggtaagtgttgaatttctaaagtcttagatcattacaaataagtcttttgctgtaaaatttgtccttaataaaatggcactattttcaattttctgattcgttaacagtagaaattggcaatactttgtggaaccaaaagacaattatctagagcaagtgatttaatataagattgcttcaaaaaaaatattttacctttaaaatargaattgtttttaagattctttaggctaagtgacayttttttccaaaggcaaataatcacctttcttgaataaagtraaataatctagattatctgttatattttatagttctaaagttatgtgacagagaaggtaggccacaygcaacacaaagaaagaggtgatatctgatgtgtggtttkcatgaaagaagatgcaattgagcaaaacacaattatgaaatttaaaatgtataattaatgccataacaatcgggattccattttggagagagctaaaatgtcttcaatgaagagcagtatcaggaatggccacttaactgctaccctccgttgttttcttcatttcatttcaggaaactagaccatcaaatattgtaaaattatgtagggacttcatagtttgcttccttcttgctccactgaaatttctcagccagtgcactgccattgaaatcactgatgcattgcattcagggaatacttgcttaatcctctcttatgttgagcctttgggtttgccgtcaagtataggattgttattcaggtcgtgttaactgaactctcatgatggtgggctggggagcaatcatgcrtctttgcatcaactttccatcttctctttgcagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcaggagggattgctgggattgttttttctttaaagaagaatgttaatattttacttttacagtcattttcctacatcggaatccaagctaatttctaatggccttccataataattctgctttagatgtgtatacagaaaatgaaagaaactagggtccatrtgagggaaaacccaatgtcaagtggcagctcagccaccactcagkgcttctctgtgcaggagccagtcctgattaatatgtgggaattagtgagacatcagggagtaagtgacactttgaactcctcaaggrcagagaactgtctttcatttttgaaccctcggtgtacacagaggcgggtctrtaacaggcaatcaacaaacgtttcttgagctagaccaaggtcagatttgaaaagaacagaaggactgaagaccagctgtgtttcttaactaaatttgtctttcaagtgaaaccagcttccttcatctctaaggctaaggatagggaaagggtggatgctctcaggctgagggaggcagaaagggaaagtattagcatgagctttccagttagggctgttgatttatgctttaacttcagagtgagtgtaggggtggtgatgctaccattactgtgaggacctaccagtgtggctggagcagggactctctcccaggccttttactcctcagcacctccctgcatactgattgttgtttttagtttctgtgaaattatattcatgaaatgaaaatagcgcattttactttgctgtagtttcataaggttttatacaaaaaagcaagtaaatatggcagaaaagcactcatttgcccctgctccctcaaaacaccacagaatgacatagaactaaaggcggcaggaatctacaagaatgaagaaaacacagtgatgccacctgcaaaatcttgggagccagaaagcaaatggacaattgataatagagttacaagatgagagaaaacaaaaatgtaacctgttagttgggggagcctagaaacatcctgttttgtaccacagacccctagaaagtttcaagatgtaaaaacactggatccttctggaaggaggagacaaggggacagagggactgaagacagaagaatggaccaaaagcctgtatggaaacagaattgcagagccccgcctgcagcaggatggctgcctttccccagttccagcgagaaactgcatactccctctctgaggaggctcacagggaggtttgcacttagagacacaagatgaagttgaaggggcagctaacatacaagagacagggggattgaatgtaaagctgtgtatgaacagaagaactcccagcccctctcttctggcaggagattgaagaatgattttctggggaaattggccaatcttagaaaagaggtcgggccaggcgctgtggctcactcctgtaatcccagcactttgggaggccaaggcgggcggatcatgaggtcgagagattgagaccatcctggctaacatggtgaaaccccgtctctactaaaaatacaaaaaaattagccgggcgtggtggcgggcgcctgtagtcccagctactcaggaggctgaggcaggagaatgrcgtgaacccgggaggtggagcttgcagtgagccgagatcgcgccactgcactccagcctgggcgacagagcgaaaaaaaaaaaaaaagaaaaagaaaaagaaaagaggtcaaggactccgtccttggaatcctaagaaaattttccagccgtattacccttctatgaagcccacctgtcaaccaacaagcacccactcgatcagagcttccccaggctttttggtgtctcctccttgcatgggaattgacttccaaggaccaccagacactgaggaagtattttaacatataaagcaaaagcaacaatagggcagctggagaaaggaaattagaagtaacagagccaatgcagtgattagaaaaacactcaaaaaatggtaataaatgtgttcaatgggtcaagagaacatatttccatctatttaaataaaaacaggaatcaataaaagtgaacatacaaaaaagagctcttgtcacagaaatgaaaaccttgggagcaggactgcacccacggttcccaccaacctatcctgccatcatgttttctccctactccagcttcctcccaagctcactctacgtagatggtttttcttcccttagccaacaaacgaaattctgcctataaattaagccaggacactaggatatggaggtatattatttatgtctcttttccagtgtttcctggtatataacagcaaagatggtttagcaagttaactggtcaggccagaattcttgatggttgccaagtcaggaggcagacggtgaaggaatgcattctggttatgaaaaatggcaatgacgagtaagttgcagagtaaagatgccttttagaggaaattaaggtttgcaataaatacatgctaatcctctaattttgatgaaagactaaagctcttgttttggtttgcatttcaaagagcaagagcataggctcttgtgctgggaggtggccagtttcctggaaaggaatttatggagtctgaaagaggaattagtacaaattatattttcaaataagatacttgaaagttattgatgacagggaaaagattgtctaaagagggcttgaaattggggaaataattgaggctcagtgacaaaggagaagattacaacttcaaaaatgaataaataaataacattgcatgtttattttacaacaccagggggcgatgatgtctacgtttttattctgtatcctttatcgctgacaaagatttggtctctgcaattttaccttattgtttctcagatgaccaaggggttggcttaatttgttctgtttaaacttattgcaagtccttctgtaatttcctaatgttttcataatgtgtgttgtgaccagactctccttataaccccagttaataaaagttaacaggaaaaaaaaaaaatagaaggattggaagataaagttggggaaatttctctgaaagtaaaacaaaaagatagagatgaaaagtaggaaaaaataagaaaagaaaaaattgagggtaacaattcaggtggtgcaataattagtcaatagtctagttcaagagagtttatttaaaaaaataaatttagactattttaaaaaatagtctaagatcatttcctacaattgaagaatatgaatttccaagctgaaagagttcacccaatactgaatataataaataaaaatcctatttgggcacagtatgaaattttagaaaatgagggaaaaggagaatattttccaggagagaaggaggaatgtgtgacatataatcgataaagaattataatcatgtgactgggcacagtggctcatgcctgtaatcccagcactttaggaggccgaggcaagaggattgcttgagcccaggagtacaagaccagcctgggcaacctggcgaaaccccatttctaacaaaaaaagaaaagcaaaaattagccaggcatggtggcatgagccactcgggaagctgaagtggggtgattgcttgagttcaggtggttgaggctgcagtgacccaacatcgcgccactgccctccagcctgggcaacagagcaagaccttgtctcaaaaaaaaacaaaaccaaaaaaccaaaaaacaaaacaaaamacacacacacacaaaagaactataatgacataggacctcttgacaatgaaactaaaattcataaagatttgccttcaaaattctaaggggaatcattctatatgtagcaaagctattctcaagaatgagagaggtctaaagacattctcagtcatgcaggtctcaacacctctactccccatcttttctcagaaagccacaaaagggggctttttttttaaaaaataaggtcacagataaaaaaaataggaagatatgggatgtaagaacagatgacctaactcaagaatgaggtgctgggaatctccaggatgattaggaaggagatcccaggattacaggtgtgctgtacccagaggaagtagtcagctagattgaggcagggaaatgggttctgagaggaatgtcccccagaaaaacatggtgctgctagaatgcctggtgggtttgaatgctgagagaagacagaaccccctgctagagtttgagggtaagttagcaatgcgtaatagaagacaaagagagtgagattggagatttttagctattagctctaggtggaaagaaaagttacacaaaaagaaaatatatttttattttaccttatgactcatctgagaatgttatttacaaagtcacatcaatgtaaaagcttaatactgatctaaagcagaattatagatagattatgaaaggaacaagaaaatatgtggggtaggttgggatgggataggacatgggtaaaaaaagaactggatccttgtggtcctcatatttcataatggaaactaaacagttaaacatttaaacaaataagatgttttacaataaaaacatcttattgtaaaagatgaaggtgaatactgaaagaaactgctaaaagatttatgtacatatatatctttcattgaaaaaaataaagtttaagatgaaaaggggatagaaatgcagtacagttacaaaaattaaaacaatagatactgaaactattatagatttgaaagatacatcaccagaacagaagggagtccagaaatagattcaccagagatcccatttatcagaatatattttaaacttctaatcacaaaaagtgagcacacttttctcttcctgcattgttcacaatcatttggaaaaaatctcaaatctataaataagacgatggggtaaaggtcaaataagtttcggtacatatatgcaatgatgtttttcatgaagccaaaataatgatgttgacttacatttattgttttttgtggagcaatgcccatgttatattgtgcagaaaaaaaccatttctgatcatcaaagatggtatgatgctatctatctgtctaatcatctatgcacacacactcatacatgcatgcatctgttatgtgtgtatctgtgtttggtgtgtgcttgtacatacttgtatgcataaaaagatatctggaagaatttctgccaaattttggtaacttttatttccagccatttgtcctctgtgtgaccagaactccctgcatatactaaaatgtctattgatggtctttgagggcagagactgcctagttcatcttaatgtccccagtgctttactcggtacttggcataaagttctacctcaatacatcttgttgaatagtcttctcaaagtcacacaggtagtttataacttgtcagcccccacgtaaggaataaaagtggaaaacgcccattctttccatgggtcagagcagtgcctttcaacagaaatataatatgggccactaatgtgagccacataggtaattttaaattttctagtcacataaaaaagtggaaaaaaaacaggtgaaatttatgctaattgtatattttattcaacccaacatatccaaaatattgccatcacaacatgtaatcaaaaatatcctgagatttttacattatctactaaatattcagaatctgaggtgcatttacatttacagcacatgttagctcaaatcagccttatgtcaacgtctgttctcaagagccactagtggctactatgttggacaacacagaattagaatatcaggttcatgaattctctagtctgaatctcagttgtctctacaattctagtcttataaaaacatgagcccagcttctccattggaatgtgtccttacactgtactcagaaactttgcaaaacttcagttttgcaggatgtcagtttggatgcaagaaagacctttggggaatcaaacaaatcattttgatgtcagaagtcatagagctacactggcctgtatcagaagtggttaaaatgctttacatcatacattttatttgattcaccagtgtgagttgacaaaagtgaaataactaagattgtttagtgtaacaaaatacagtatgatattaaaaatggtcatattagctaagcttcctgaggacctcttcccaaaacaagttttcttccagttgatctgtaagaaccatttatgatttttttctgtgaacaattcttaggaaaagttgaagcagcacatcttccaacttattttgaaaacaggctctcagttaattttggtccatttcaaaattgcatgaaagagatgcccatatattagaaatgctactgtttgagaaaaaaaaaggtagaaaaattggcctctagtttttttgtccaaaaactcttttttatatagttactctaaatgtactctacatgtgcccttaggaaattatttcaatgaaaagattctttgaatttggtgctgcccccgtgcctataatttttggcaattatacactcattttaaaatgtaggtcctggaatattttaatactatattctgaaagtgtaaaatacataggatcataattaggtatagtttgccatatatttattcaataattaaatatcagtttcttatcgtaagaaaatatc

SEQ ID NO: 12163 - DNA, 54520 bp, Homo sapiens
aaagtaagctaaagaaaacgttttaaggaaatcatgaggagaaaatatatttactctccattaagtgtaagtgaatcatcataaatgtctccgtcctcataattttcaccttgataggctgagaagcgggggttggctttgctgtctcaggggtggcagaagtagaagaggtggaagaggaggcaggagagggaggcacaataagtgtaatctgatggagatacatcataatttgtctgacttttttgcttttccatttctctaaacatgtttccatttagcaccaattcttcttccaccatttgctttagattcagtgcctgtttcatagaaaagtccatgttataagagaagtcaaaagccatattgaataagtggaacccttctgccagattgtctaatgtcaatttgttttctggcactgcttcgtcttcttcctcatcgtctggcactgggttcagaaggagtcatctccatcaagtggtcttctgttaattcctctggtgtggtgtctcttagctcttgaatttctccaagatttgtatcttgaaaccttttttgccatatctgcaatctctttcatgatttccttgattggctctgtcataaatcctgtgaagtgatgcacaacatctggagtttcctccagcaggaatttgtttgggcttgatggcttttcatggttttttctgaaacaacaatggcatcttcaatggtgtaatcctttcagacgttcatgatattctctcaattggggttctcttccacagagtactgtgtgtaatgatccttaaagtccttatgactcccttatctagaggttgaattagaggtgttgtgtttaggcgcatgtagaccatttcaatgtgtttgtattgaactcatggggttctgggtggccaggggcattgtccaatatcaaaagaacattaaaggcaatcccttactggcaaggtacttcccgactttaaaaacaaagcatttatataactgatccagaaaaagagttgctgctcagccatcttgctgtacaaccaaaagagtggcaggcagtgtttcttttcccttcaaggctcaattttatagataagggcagtcctgatcatacatctggctgcatttgcacaaaacagtacagttagcccatcccttccygccttggatcctgatgttcacttctcttcctaataaatatcctctgtggcactattttcccccagaatagggcattttcgtttgccttaaaaacctgttcaggcagatatcttttctcctcagtgattttctctattttttttatttttattatttatttattttttttttgagagagtctcattctgtctcccaggctggagtgcagtggtgcaatctcactgtaacctctgcctcctgggttcaagcgattctcatgccttagcctcctcagtagctgggattacagatgtgcaccaccacacctggctaaattttgtatttttagaagagacagggttttgccatgttggccaggctggtctcgaactcctggcttcaagcaatccacccacctcagccttccaaagtgctgggattacaggcatgagccacaaagcctggccttttgtcctcaataatttccttaatggtgtctgggaactcgtcggctgcatctgggtcagcagaagctgcttctcctgttatcttgacattttttgaaagccaaaccactttttaaaattatcataccatccttcatcttccttttgctttgtcagataatgacttcactttttcttgaatattagattatataggtatgcctttctcatagcaatcctgcacccacaaaaagctgcgtttgcaatatgagataaaaaggtatttcccaaaaagtgcaaggttttcatgcttggtgtagctgcagcgatggcttcataaacttccttttgtttttataccacagtccttatactggattcatttatcttaaaatggcaggcgaccttagctgcagacctcaatctacaatacacagcaagcaattccgctttttctgtaatgtcattaacttttctctgattcttgggagcatttccagcaccactagcggcacttcgtaatggtcccatggtgttacgcaaggtttacagtactgcagtgaacacaacgagaaatatgtgagaacctcaagagcttaccttttactgtgatatgcaatgtactggagagatcaactgctcactcagagatgattatgttacttggaatttttagccaataccagcaacactgacgctcactgcaatagcaacaggaggtggctacaaaatcattacagtagtactctatgtactacagtgaatttgatgcagttattatttaatattgcatctttacaactgtttacacctctcttgaacctaatgggtgccatgtaactgtctgtttgtatgtgtaagttttgataaattttaactttttataacaggcttgtatatattttatgatagtaaataataaaatggcctagtatctacatatattttatgcattcatgacatatctagctttttcttttctttttttttccatatttcttggctaagcgattcatctgtgaggtttttcacaaaattgttgccatcgccaaaaatattccatttactgaaaaaaatccacatataagtgtactcacgcagttcaaactaatgttgttcaagagtcaactgtataaaaggtattaatatgtctggaaagagatatgtttccaatttaacagacactaccaatgaggagaagagttgggctaggcaggaaacttcaaattttccttttttactttatatattctattgtatctcaacttataacctgtggaccacgtttattagaagaaaatgcagattcctgaaacttcctgcagaccccatgagtgacaatctcagggagatggagttccagagtctgctttttttcatagatgtttctttgtcattcctgtgtatatctgagtttcagtagcactgctaatcaattgtttggggttctctctccttcaccagcatgttcttgcaaaactaaccaaacacatacaaagcgcaaacagtacaatagtgcactgcaccttcatgacccttacctgttccagcctcttcctacctcttccacatgtgatatgtgtgtacatacccacagacagaaacacagagacatgtttggaagccagtgtggatgccctgtgatctgtgtgtacacatgacaagtgcatacacacgcacataaaggaacccagagacgtgtttggaagccagtgtggacaccctgtgatctgtgcgtacacatttgacacctgcgtacacactcacagacagaaacacagagatgtgtttggaagccagcgtggatgccctgtgatctctgcatacacgtgacacatgcatgcacaggcccatacaggagcagagagacacatttggaagccgatgtacgccctgtgatctgtgcgtacacgtgacacatgcgtacacacccactgacaagaacacagagacgtgtttggaagccagtgtggacgccctgtaatctgtgtgtacacacgtgacacatgcgtgcacacccactgacaagaacagagacccatttggaagccagtgtgggtgccctgtgatctgatctgtgtgtacacatgtgacacgtgcatccacacccactgacaagcacacaagagacacatttgaaagccagtgtggatgccttgtgatctgtgtgtacacatgtgacatgggcatatgcacctacagacagaaacgcagagatgcatttggaagtcactgtggataccttgtcatctgtgtgtacacatgagacacttgcatacacacccacatacaggaacacagagacacgtttggaagccagtgtggatgtcctgtgatctgtgtgcacacgttacacgtgtacacaaccactgacaagaacatggagacacatttggaagctagtgtggacgccctgtaatctgtgcatacacatgtgatacgtgtgtgcacacccactgacaagaacatggagacccatttggaaggcagtgtggatgccctgtgatctgtgtgcacacatgtgacacgtgcatgcacatccacagacagaaacacagagacacgtttggaaggcagtgtggatgccctgtgatctgtgtgtatacgtgacacatgcatgcaaacccactgacaagaacacatagatgcatttggaagccagtgtggacgccatgtgatctgtgcccacacacatcacacgtgcatacacacccacagacaggaacacagagacacatttggaagccagtgtggatgccctgtgatctgtgtgtacacgtgacacgtgcgtacacacccacatacaggaacacagccacatttggaagccagtgcagacgccctgtgatctgtgtgtacacatgtgacacgtgcgtgcacactcacagacaggaacacagagacgcatttggaagccagtgtggacatcctgtggtctgcgcgtacacatgtgacaggtacgtgcacgcccacatacaggaacacacagaggcctttggaagccagcatgggcagacaggccctatcccaaagcggccggcaggcgtctcctaagaatggttctcggacacacctctgaaaggaaaatacaactcggcaccgcagttgactcggccaaaggaaaaaaacttaagctgaaagctgaggcctgcccgaaggagcctttcctgtggcgcctgagccgagggcttcagggagagggccgcgcatcgcagcgcagctgcccgtcttcccgtggcttccctacggccgcggctcccgctgctcctttccgccggccacgcgggtcgcacgaccttcccctcccgcccaccctgaggcgctgaagccctcgacgccggcctcgggaaaggcgcggccaccgcccgtttcggattcccgtttccttcctccaggcgcgtccttcaccgtggccaaatcagcctctcaactgctggagcccggcctcggacacttctcggcttacgccgccatacagtggcgcaccccgaaaccccggaaccgacagctcggctggccttgcgcacccacactctccaaggcagggctcggtccgggggctggttttgccaaggcgaggggcgaggggcagcccaggcggccggatggataccaagagggcgcgtcagctccggcgggacggggcttccagggcccgggaggggtccaggactccccgccggcgcctggctgtcggcggagggccgcggggcaggagggagtggagactgcggccccagttcgggcagcgcggagcccacccaacgccctcctcggccctcggctcttcctggggccatcccgcccctgcacctcggcctggcacctttccggttagcctcggaggccgtggccgagcagggtgcgttcgcctggctggggggcctcagaacgttatttccgggtgacaacctgcagggccttccgcccctcgcgacctctcgggagtcccttccccggcgcccccccggggctgcaggggctgcaggttcggtctcggggcctccttaccgcagtccgcccggctttaggctagtgggctttaactacgtcgataatatgactccggcgatcttgtgcggcgatgggatgcggccgtgggcggtggagtccaggcggagtccgctctccacacgcgagggcgcctcctcctcaccgctcgccggcttcaaagctcgcgcctcaggcgacggcagccaacgggttgccggctggaggccccgccgacgccccgccccttgcgtgcccacccgcgccccgcagccccgcccccagcgccgaccctaagtttcggcgctcagtggtccggcgctccccaaggctcggtgtccagcgtcaaccccgaggtctctatgccccgcctcccgacgccagggggcagggccagcgcgctgcgcgtcggggcggggctttggctgcgtcggccgcgtagcccgcgcgcggagcgtaccctgctgcggccgttggccgttagcgcggcttcggcggttgtcttggagaagcaagatggcggcgacgrcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgccccggcatggcctccgtcctgcccgccccacagagggggtcggctcgttcgttcgtgtggtcccggagggcaccgcggactgggggtgcctggcccrtcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggatmaatgtgagcttgttgtgaaaattgtcttgaaattataatttcctgtttcttaacttytttttaaggctgaactccgagcagctgtgtttttagcactagaggagcaagaaaaagtagaggtatgaagtttccagattttaacatggctgtattcgttaatacttaatttcttattyattaaaaaccgtcttaaaaatagtttatagtaacatatagctagggataattttgaactgttaaggattayattactattgwgagagagccaaaattattcttttttcgtgtagcttttgaatttgggrgtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatgaaacggggtatatagtatgcaacttttcccaaaattatctgaccactcaattattttgacaatgaaaaagacagcgattattttaaaagtgcagccactactctatatttaartgggtaatttaactttttcggagtcccaccaaccatcctgagtaaatattctggaatttgtcaacaagaatagaaccatcatcaaagycttaaactcttgctgtatgacaaatcagtctactgtcctctcacttctttagacctgtatacctaatctctaatttcatcaaaatcttcagttctttgccctttccatgtctgtgcaggcatcagtcttctcttggcagcattttgctytggaccctatgggtctggacccctaattaccttgccttaacggtcatacgtggtctggaagaaatctcagtggtcatttaacccagcaaactaactcttcccactttgcacatatgtgctcttggagaagagtcagtcaatcctgtggattgctgatgttgcaaattggcaggtaccaacctggttaggtcctgagcaggcccagcagctctcttcttcaccctagctgtgcagtagccttctatgtcacccctgcttccttctctctgaacacatggtcttgttgcttcctccacagggaaggtagaagccattagatcctaactttatgtcctcctctcctgtccctcaatctattgctcacctgtgaaaatgcttacctgtgtctatrtttatctgtacctctttccttactgctttagaagaagaggctctgtcctgtccaagaataatcactctgtcttgtgtatactttcaagtctttaattatttactgtatctttgaccccttccttttctgatggcttttcttttgagcttgaaaacatgtttaaataactattaggagtaaactgttttcctttactcacattctgcttttaataccgctgtggtttttttccttcacaacctggttttgaccactccttggtttctttagcatgatctttttcctgtacacctgactgagacttatccacagttgtcattctgtactgtctcacagactgaccttattcatccagtaactccagccctgtaactttcatgcatgtttctttcccgagcttcagacctgtatgttaaactgcccactgtattatgcccttaatgggaccatcatttatctggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttyttcttttccagattgccttatccccttcctacttgccagtctccgtttccgtggtgtccctcaccatctccctgaagtcctttttccacattgctcctagattggctgtttatagtacacatctgatcttgtccctccattctcttaaaatatttcagttgactcmctatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaartgatcatcacaatcaaggtactgcgcatatccttcaaacttttgaccttcaaaagttttccttgtgccccttatgtaaccctctcccccaccccaaacctttttaagaattatataaatggaatcgtatagtaggtactctttttttttrgtctgtttcttcaacataatgcatttgaaattcattcatgttgtggtatgtattaataaatcatttcattaatacattgtacagatatgacagtttagccattacctgctgacagacatttaggctgtttccagtttttgagtattacaaataaggtttctgtgaacagtcacatacaagtctttgcttggatctgtgatttctcttgagaaaatatgtagaggtgaagtgactaggtcacatgctaggaatatttgtgacttttaagaaacactaccaaattgctgtccaaactcgttatgccattttgcattcccatcagcagtgtatgaggctgccactgtagcagcaattaatgtggtcttaaggaagcttaccatgtgctacctactgtagcctcttctcagcaacaatcacaggcttgatggtctagaagtattttttccatacttattcaaataaatgtataattacaaaaataagttggcctatgggccgcataagatcatctcacatttcatggataaactgggaattacaagtgtataattaaattcctgttcatagtaagtatgctataaatggtagatacctgagatgacaaaacttttatcaaacttcatgtatttgaaataataaacagttgttgacatttaattgtatttcacacaggtatttgaaaatatctagcttcaaaagcagtttataaaacatttaaaaattaaaaatacaaatmttcatatatggttttgttatattaactttgagaaattactaaatagcacaaagtaagtcctgtagtaattaacagttgtagaatggattttgtaaaaccataattttatcaatgaaaacgttaaactttatattttgtagttgtttttagggtaaacacatgacacttaaatttttttttttttaacagaacaaaactcctttagttaatgagagcctgaaaaagtttttaaataccaaagacggtaagatgttcagtttgttcttgtttatctatctctgaatttttgaatcttgataccatttgggagaaatcaggaatttcagggctttttttttgtcttcaattgttataggtcctcattttaaaataatattttattgtacaacaatcgtgttgctattacatatttttggatttgggatgttgttgcttaaagccagttttactacaaaaagccaatattaaccattaaaaagcgaaacactgaaatctatgagatgattgtcttacagttagttacagactgatgatcccagtgaaaaaatcaggagattgagattttcattacttaatcatattattcaaagaggaaatttgtaacttaaaaaatttagaaacctttcttccattaatttagtgtatctatttcataatgttaatttaaaaaattcagtttttraagatttgcttacttacctttttcttgatctttataggtcgtttagtggctagtcttgttgcagaatttcttcagttttttaaccttgactttactttggctgtttttcaacctgaaactagcacagtaagaataatgatttttacatctatcttttgaaacctttgatacaaatgagttaatattaagctgaaagttaatagaatttgacaactgatagttttttacatttagattatttttggtagttgattatctgtttttcttaaaagccatatgagctttcagatagctggcaccagtgttgctgctttgtgttacttgaaagcttgctaataaaagtgttactatagagttaattttgatacgatgttagattgcacctgttaatggaaacgttgaaggtagaggctctgtaaaagaaataggcataattttttaaaatagacatttcattcattagtaagacagtctctttgagtttaaagatgtctttaaactctgaaaatatcttctttactccttgagaataacttctgctatttttttgtrcacttgtattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaagtaagtagaattctgtgttatctttttctattttaattattggctrcttagtttagccatgcagattagtgcatatatagtaaattaaggttttcatactagaagatattccttaaaaacaaaatgagatgcattcagattgtatcaatgcaaattttaatgaaaattaggaatgtgctgactgtgattctgtggcatatctgttctggtttttgatcctcaagagtgttgggtcatgagctaaactgtctggaacaaatcccaactcctcgttgcctcacttgatcctccattcattccatactgtgtatgaagtgggctctaccaggccctaccttggtgttctgaggcttctctgcataagccaacagaagcactcaacttgctattatttttattaaaacatcttatttaaatataaaagggctgatttataggatagttaataaatttttggacttaaaggcctctttaggcttaaaactaagctgttgattttgctttacgctgtttagaaacagttcaaacttacacttttttgatcagtagtacttttcatactcttaacctttttttagaaattgtgctaatgagattaatgatataattttattttcatacattaattttacatgaagatactctgttttatagatacaggtaacatctgtaactgttccagatatttgattaaatgtgagcttttagtcagaaatttataggtaagaatgtggagggctgtataggtttccagttattttctttggtgagtctcagaggatgttttctattagaatttttgaaaattgataaagcttgcctgagtactaattatgtgtaaggcatggtaaatagactttgtgggtactataagataaaatataagaaacttctgtgtctctgaatagcgcagagctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagarcgcaggttgtcacttcagcttgtgcatataatttcattccttcatttatcaatatccascaagcttttattgtgygcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttatgcatatttttctgtctagattgatctttcttccttaacataccactagcatggactctggaaccasgttacttgggtgaaaccccagctctgctacattctagctctgtgagcctgcagtcactcagcctccgtgtgcccaggttccttatctgcaacatggagatcacagaagtatcgcgcctacaggtctggagggggtctgaggaagcaagatgtgtgaagctttgagcacagtgcttggcacggaggactctgtgtgttactgtagtaggcatcagtggattcaattaactgcgaattgaaaatattcggataggctgagcgcggtagctcatgcctgtaatcccagcactttgggaggccgaggtgggcgaatcatgaagtcaagagatggagaccatcctggccaacatggtgaaaccccatctctactaaaaatagaaaaattagctgggcgcggtggtgtgtgcctgtagtcccagctacttgggaggctgaggcagaatcacttgaacccagtaggtggcggtggcagtgaggcgaggtcgtgccaccgcactccagcctggcgacagagcgagactccatctcaaaaaaaagaaaaaaagaaaatatttggataaaatacaacaaaagaatgcaaatatagtagaaaactatatagcatttacattgtattagatataagttagacacgatttgaagtacataagttatatgcaaatatgtcatttcacataagagacttgagcatccttggattttggtgtccacaggagagtcctacaaccagtcccctgtggatactgagggacgactgtgttagtattactgtttcttgttattgtatggatgactctttaagttcagtgtagtctgcctaagctcagctcagtcctttatcctagctccagactagaatttccagctcttcacaaaacatacctccctggataacccaatagtatattcgaatcctgtgtggaaaaacttactttcttctctttacctctaaaaagtaaaaacataaagacaaaagcaaatcccaccttactccccgcaaataaccctcttcaagttcttcttgctcacttctgtgttttgattgattctattcctgtgactccttggtttcatcccaaggagccacctcttcacatgtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcrtggatttgaggcctcccctgaagtttgccctgactttttcatagctgtgattctgtcaaatagagccaggataggaattctgtatcctcaaaaggtagttgttttactcccccaagttgctgaaccagtaagttgggcatctcatctccattttttgctagttttcccttcctaatatctggatatttaattttaatagtttgtgcatatgtatataaacaaatagataaaatatttaaaatagagacctcaaagatgtatgttttggcccttcattatttattagtgttttytattactttggaagaaaacctgttgtttataatgaaataaaaaattagagcttttattagcttttgactttgactgtagaaaactagctataggttaagctcactgaactaaattactgatgctttttaccaaaactgcattttaaccacctcaagaatcaggttgctgtgccccacccgctttaacctgacttttgtttggttttattggatgctcccaagccgtagataattaaagccctttcttgttttctgagcccctcaatggatcattttcatctccttcagcacctctaccatgtaggtccttatatctgtccaggatcatttcttcctaaaggttctcatgctttcagtctgtcattcactgttgcagaattatttttaaacttcagcccttcctctgttcctttcttctgtacgattgtagtgactgcactgccgactcaggagtcccagattcttcagcccttatgaaatgttctgtgtgatgtggccttaacctgtctttctagccttatgtgttttttttttttttaatgtggaaccttgtacttaagtcagattgaactttggacttactacttgaaagtggcttgtgttttttcgccttctcttatttcgttattctatcctccacttggaattatactctttccccttccccagctgtggaattttgtcagtcaggttttctcctcagctgcaactcttgttcttcctctctccttactggaaactgcatgtaacttagtgcctccttctgtcaaagttgtagtagtgatctgcactggttacacatggaaatttactgaggacaagggctttatcttcatatctcttacacagtctaaggcattgtgatttttttttgtttttttttgagacggagtcttgctctgttgcccaggctggagtgcagcggcaagatctcaactcactgctgcaagctccacctcccaggttcacgacattcttctgcctcagcctcccgagtagctgggactacaggcagccaccaccacacccggctaattttttttatttttttatttttagtagagacggggtttcaccgtgttagccaggatggtctcaatctctgacctcgtgatccacccgccttggcctcccaaattgctgggattacaggtgtgaaccaccgtgcccagctggcatagtgatttttaacatactgttcacagtcagtggaagcctttgaaaatttgaagaggaatacccatttagaagatttgtggaggttagattggtaaaatatggagaagttagcagactagaaagaagtgaaacacataagaaggcaaatctagacaagaatggtagcagtaagaatagaaataagtggacatacaggctagacatggtggctcacacctgtaattccagcactttgggaggccgaggcaggcggatcacttgaggccaggagtttgagaccagcctggccaacctagtgaaaccccgtctctattaaaaatataaaaattaatgttgggcgcggtggctcatgcctgtaatcccagcgctttgggaggccaaggcgggtggatcacctgaggtcaggagtacgagaccagcctggccaacatggtggaactccatctctaccaaaatacaaaaaattggccaggtgcggtggctcaaacctgtaatcccacattgggaggctgaggcgggcggatcatttgagaccagcctggccamcatagtgaaaccctctgtctactaaaaccacaaaaattagctgggcatggtggtgtgcacctgtagtcccagctactcgggagggcgaggcaggagaattgcttgaacctgggaggtggaggttgtggtgagccaagattgcgcctctgcactccacagagcgagactctgtctcaaaaaaaaaaaaaaaaaaaaaaaaaaatmcaaggaattagctgggcgtggtactcgggaggttgaggcaagagaatcgcttgaacccggcagtcggaggttgcagtaagccaagatctcgccattgcactctaacctggacaacaagaatgaaactccgtctcaaaaaaaaaaaaaaaaaaaagttagttgggtgcggtggtgcattcctataatcccagctacttgagaggctgaggtgggaggatcacttgaatctgggaggcggagattgcagtgagccgagatcgcaccactgcactccagcctgggtaacagagtgagaccctgtttcaaaaaaaagaaaaataaaagaaagaaagaaatgaatagataaagatgaccttttgagaatcaacaagacttggtaaactaatattttggcatggggcaaggtcacagaaggcaataagagaaaagaaaagctctcaaaggccagtttaaggattttagcctagaagataatatcaccaacagaaatagtgggactgaagagggagaactgaagttatgragaacagcacattttcgtatttaaaaagttacagtcagtcataaagggatttttgtaacaaacagccagtatttactatgtacagtgtcctagagcttgtgctggtagtggatgaattgtaggaagtgattttcatttaagaaacattttaaaaacctcctccttggcattaaccacagtgctcagaaccctgtggtgacagggcactgggcagcagacacagatgactcctgtggaagttgggctagaacaggtacttaccattttggaaaaaaaatgtgtgaaagtagaaaactgggagagtgaactactatttgaaggggtaaagtatttttaatgaaagttgttatttggtattttttcttgagataaaatgaagtagggaaacaaattcaaggagggcaaaaagtagatcttagagaattacaggatattatttgtctggagagtagggagaagggaagtgaggaagtaaatcctggaatggtagacctgggayagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaayattttagggtgcacttgatctatctgatgtacattctccaccaaagtcaccagagggaaaaacaagtgcacagacaacaccaagtaaggtgagttagctgyggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtggactacacaaacctgcagtccatgacaggtcgggtttgtattctttgactgtccctttgattttcatcccataggaatagagtgatgctgtggagtccattccaaaagatgaggtcccatgtgggtttatggtggtggatcgactctcagatacagttgcatctttttaaatagatgaacttccaggacgtagtgattatactacacgatacctttcttttttaaatgtctaggcacagaacattgctgaacgattgctgttattttttgcttgttctttgatgttgttgctcctttttattgtttaagtttggaaaactaaggaattttatacttcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaatraacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacscaacctttaggaaccagctttgtgtgctcctgagaaaggtcagatgaggtcaggacaagtcttcaaggaagttgcctaggarctcaagtgaggcttatttagaatgcygctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggstggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcgagaccatcctggccaacatggtgaaaccccgcctctactaaaatacaaaaattagccggccgtggtggtgtgcgcctgtaatcccagctacttgggaggctgaggcaggagaatcgctttaacccgggaagcggaggttgcagtgagctgaaatcgtgccattgcactccagcatgggtgacagagtgagactctgtctaaaaaaacaaaaaagtaacgatggcatgaaataaaaagtaaatttcactgtcagtttttatccaggtgaaaatcatactgttgaatcttaaaaccatgctctcagttttactttgaaaattcctgttgtgttggcaattagagttgaaaatacgtatttttcttttgaatggatgattatatacatattagtaacattgtgatttttatttgaggaaaatagaacatcaaactatttttttgaatacgtacctattgataaattaaaaattaaacgtatttcctccaagatgtttttgtgttctgtcatttttcagacaattgcacatttgtgatcctttattcagtgcccctgctcacagtagactgctgggggccagtgctgcrtactaccaaggccttggctgctttttcatcctctcctaaagatcacaaaaattgactaatccagtagattagctgcttatgaaatttaaatattagaagttttagaaacattatcagtacagtttttacatgtacttaggataagacaaaatatttaattttcagttctgtgagattcattagtcctatgctgaactttggttatgtatagattttttcactaggttgaaaatcttcaaacttaaagctttttaaaaattccacctgttgtgttagatggctttagttctaggagtttcaaaggtaaattcctattactgtattctctttctgttcacactgttctttatgcgttattaaacaagaagttgctttaaaataatgatttagtaagttttttttaacatttacatagtgaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaagrtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatrttaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatctatatttttttgtttttaatatttagaattagttgctctttatcattatattaaatgtaatatgaaagatcatcctttcttcttacaaatagttttcaggtgtctgtttctttttagagacaaggtctcactctgtcacctaggctggagtgcagtggtgtgatcatggctcacaccacttgtcctcctggggtcaagtgcccacttcagcctcttgggtagctaggacaacaggtgcatgccagcacagctggctaattttttaaaaaatgttttcatgtagaggcaggggtctcactatggttgtccattctgatcctcaactgtggggctcaagtgatcctcctgcctcggcctcccaaagtgctgggattacaggcatgagccaccgtgcctggcccagttttcaggtattttaaaactaacatgtattgagatgctttttcacattacgtgtaggttttggggcatatgtttttgtatctttggcagtcacctgaggattttccaaaccaggcgttaccattccctgtcacdctctcacaccatcctgaatgaatggatacatggatgcatgaatgttcccacacttagccctgtagtaaaattacttctctaaataattcattagtaagtcatggatcagaaactgtcgttggcagggagagaggtggggggcagaggcatgggtgaagagaattttaaatacagtcagcctcatatctggaggtttcatatgcattgctttcacacctgcagattcagtcgtatgtaaatggaaaaatggttataaaaaataataatacaaattttatttattatttatttatttwtttatttttttatttttttgagatggagtctctctctgtcgcccaggctggagtgcagtggcacgatctcggctcactgcaagctccgcctcccgggttcacgggaggctcctgcctcagcctcctgagtagctgggattacaggcgcccaccaccaagcccggctaattttttgtatttttagtagagacggggtttcactgtgttagctaggatggtcttgatctcctgacctcgtgatccacctgccttgggctcccaaagtgctgggattacaggtgtgagccaccgcgcctggccaataatgatacaaattttaaaataatggtatacaactgtctacatagcattacatttattaggtattacaagtaatctagagatgattcaaagcatatgggaggatgtgtgtaggctatgtgcaaatactacagcattttatacgagggacttgagcatcctcggactttggtgtctgcaggtgtcctgggtactgagggacaactgtattgcatgaattttttgaatacttttgcaaaacaatagtatttctttgatatttttcctacatgaacagtttggaaaaaaattcttttttttttttttcaggttcttaagtcagtctgatacaattcagtttttgactactgaaaaattaaggtttytcattgtgaaacttctctagtgctgactttttgttaatctagaaatgattggcttctttattatatgagtgtactattggataatttaaatatatactaaagctttcttatggctgcactataatttcccatagagcttattattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactycagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacrcccagctaatttttgtatttttagtagagacggggttccactatgttggccaggatggtttcggatctcctgacctcatgatccgcctgcctcggcctcccaaagtgctgggattayaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaaygttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcrtacacctgctgtgcacacgcatacacctgctgtgcacacrcrtacacctgctgtgcacaygcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagayataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatytctttataatcattaatttatattaataacatggaatgtgtagctctctagaaggcaataaaatttgcacagcatatatcttgcctactgtcarctagtcaagacctctacctggtgtaaagatgtaaacgtatatcrtaagacatgcataatgcattctgtctgtacccatatgaaaagtgaaaccatccttcaagagcgtcttgttcggtaatgtcyaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccgtgtatggtggctcacggctcacacctgtaatcccagcactttgggaggccgaggcgggtggatcacttgaggtcagaagttcgagaccagygtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaagaaaaaaaaatggagttaataattttggactacattccagattccttgtttcagttgagtgctttttctattattccacgggtattttacacaatactgctctctttagtaygcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaagsttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaataygagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacacaaaggttgcacacacacaaacaggtttgattatgctcatgagacttcttttattattgaaaatatcttaaagttttatctcaccaaggaggccttttctctttccctctctttctagaaggccaatgatgaggccaatcagagtgatayaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgtgagtaaatggtttttgagctatgagactaggggyttaaaaataagataaatgttttcattttatagttaaaaaataatgaactatggaaggtttataattattggatccataaatctgactatgcgttgttaatgcctttcatgttgtaaaacaatcccagattttagaaaaacctagacatgatttattccaacaagtaagtgtagattgagtgtcagccacttgccagggctgttccagggtggggtgcagcaatgatagaagagggaagactcctgccctcaggaagctcatgctctggtgacagagtcaggcaatgagggttatgctgcagcgtgtggggtgatgagagcagagcagtgatgggagcccgagtgtgtggtcagggcaggtgcatgtcagctgtccaaattggagggggcctcacttggaggtgcccagtgagcaaagagctagaggaggtaagggagttgccgtgggttgatggagctttggggagaggaaacagacagcagggaggcgagttgggggtagcagagagagcaagatggggatcggatgaggtggactcagakatgaggagctggacggcttttctttgagactggaagccctgaggatcttgatctggcgtacattacagaaggatcctgaggttgctggggaaggttggtcttagagtttccagttaggaggccgttaatgatggaaaaggatttgccagtaagtgctagagaaaagtaatatacagagtggcatcatggtttttagcctgcaaaactagaaggttggaaacacgttagatgaagagtggcaagagcaagagtggattacacagacaggtggcatgacagcctggaggcccctgttgctgtgctaagttagagaagattgctagtggaaatccaaagtaggctattgagtgtatgcgttgggattgatggagaggtctgagctggagatgtaaattaggagtcatcagtttgtagataatgtgggktgtgggagactacagaggatcaccaaggaagcaggwcctgcgcaccttgaggccagagcagggagctagaagcagcagaggagatggaaccaggagagtggtgtctgtggaggtggcggtagggaggagtagctgtatgatgccgttggatttagccatctggaggtcagtgatgaccttgacacagttttgttggaatgggggtgcgaggcaggttagagaattagagtgcattcaagacagacaggaaaggattgtagatgaaaaatagttttctgatgagttgtaaaagtgtgcagaggagcagggtggtggctggaggggcaggatttagggctgaaaaacgtgtttaggtgggagaaataacagcatgtatgctgacgagagctgttcagctttaaagatggaagaattaatgatgtaagggagtgagaggagaactggagggctgcgcagcagtggaatcccatgcaggggcttgtgtttgctggaaaagtggagagcgtgtgggtctcattgtaggcagggggtggatatgatggtggcacctgtgcaagctgtcacctgagttcatagttgagtgaggatggaggacggaggttggagataagaggagagtggagaaagcatgaaatctttctataagaaagtaaggcgagaaggcactgtggaaacccggagggttgttgggcarttttaaaggtccccttgaggttagyggtcatgactttaaggggagttcatcagcatggctgttagtggcttctgtaagcaatattaaatctgagaggtggcacttatttgctagtaaactcctgtattgtcccttggctgcatgtctgggtaatggaaaagggcttcygaaaaaaatcacagtgaagaggtcaatttagtttatatcaaacagaattctaaagagaggtgagctgatttcttacgccctggctgtgccgattgtggttgatctgtagtttgcactcccttggtgtactttatggttttgaatctttaaagtgtatattcttgatttccagccaccacacgtataaaatatctttaagttgcttttgtttctgtggcagaataaaagtgtttagtggcagaacataagagcaccgattaactgtccttgtttcttgttaggaggaakgaacctaggaagcaascaggaagtctggcctcgctctcggatgcaccccccttaaaaagtggactcagctccctggcgggagcccctyctttaaaagactctgagagtaagtgcccaaagaygtggacttcaatactcgggatattttttctctaattaaatactatgtgattattgttgatttttttycccaggaaaatcactaaaataaccyatcattttatcactcagagatatttcctgttaatattttgttgtgttttgttacttctaaggtggtcctattttatatgttgttttgtattctggcccttcctatacctatataccatcggaatacttttgggaagttgactttttagctgatttttattatctatagaaataaaatttttaaatcatctctccttttttggacatttacaatgacttgagttggatttgctttcaattaatttttaaaaatttggtgataccacagtaagtatcataaaatgttaaataaaaaattattctgcagatcattttcaagaacagtgacctgacatgtcatcgtaaatgcagcagagctaaagagcactggttacacatggaatagtctagctctggcaccagttactttcccacctctccccacacacagtgataggaatttaaaaagcatagccctgaacatgtaggatgggcagaggtcctttggaaaccgtatcatagtaaatgttgtatttaattagcgtagtgtttcagagcacgtgtacctcttttgagaaagtttcctaaagtagattcactaagaatttgcagtatgcgttttgcataattgtccagtatttccgaatctttttgtattgcttgatatactgtgggacttcctagggcacataagagagccggcctgttgcttctcttaaaccagccatgtatttataatgtccgcatcccttcccatttgcttctttcccgtggttactgccacctttaagaaaggaatccaggacatcatgaacatgtcattctgacattgattagagaatgatcatttagagaggacgttgagaacaaaggactaaaaaaccagtgaggatgtcactttagtaagtgaaatagcagttgcactgaagaaaaatttagaaattcaaaggaaaaataagactcatgaaaataattaacagtctatgaattcatacctaacagggctgtttatggaaagtgatgtcttataatgaggcaaaaaatggtttttggtggttgtgttccaataaagtagtattgtttatggtttaaaaagggatgtagctgggtgcagtggctcacgcctgtaataccagcactttgggaggccgaggtgggtggatcacgaggtcaggagttcgagaccagcctatccaacatagggaaaccctgtctctactaaaaatacaaaaattagctgggtgtggtagcacatgcctgtagtcccagctactcgggaggctgaggcgggagaatcgcttgaacccagaaggcagaggttgcagtgagctgagaccgcgccattgcactccagcctgagtgacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgytgatcgttttaaagtgattatttttagggtaaggctgtaaaagaagtgactccgtctgcctacgctgagcaccttcctgctgctgctcattcagcaggtgtttgaatggcttttaygtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtagatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcaatgtgaacattaccgagccctgggccatatgttgagagcacatttctcattcagtgttctgttctgtgcaagactgtagcagtgtgacaggcatactttaggcaaactcatttatgtaaaggcaaacttggtgacctgaaggaaacggtgcagccaggttctcaatggccacttcctatgctctctgtggatgtgatgggatcccttcctggtctgtaatcactcacacatggaagcattggaagagcttcacaggcaggttagggagaaagaaaggtgtgtccccatgtgcttttaaaacccagccctgtccaaggggcagctccgagaatgcccttccctcttctggagagacattctggatagtgcaaagaacttgggcttggagttggatagaagtgacatctcagatgtggcactgattgatgggtagcgtagggagataaactaaactgctatttcctcatctgttaagtggaactaataacatctgccttgttttaaagagtaaataggatttaaatatctcttcatatgtaaattaaagtacagtggctggcatggtaggtgcctagtaaatgttagttttctttttacgttacttttccccccatttgcagaagaataaatgttccctgagctgcccggattcttgttccgcacagtgccctggagtcctggtaactgagttgctggttgtgctgccatctgctctttgtgcgtcctggttgctggctggccagctaggtgggcctgcctcctttccctcccttgtgcttttcctgtcagctgtggtcatggttgccattagatgttcttttccactaaatctcagtggctaactgccaccagagactttactcctgacctctgcaccgtgatggccgccytgtcccctttgtgttctgtttttttcacttttgtggtgtttcactctgttgccaaaccttttagcttttttctctgactgctctattctcttaccaaagcgagggttttccctcctgtttstgagtggggagctgccgagaattgtcatcctcaggagggaatgtcgttgctggggctgcagagttgctgggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcrttttgcaacaatgttgttttctgtttgggttgtttacattttaaatatacagtactctaggtattttgagtaatatgtagacagatgttagtggaccagcctaggagaataatgatgttagtgrtaagtgcytggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaaaggtgcccaaaaggagtgtttatagataggtactttgcatatttaaagcaagagttgctaagctttttccgtaaagggccaaatagtctatattttagggtttgtggatggcatgtactgtctctcacatagtctttgtgtgtttttttgtttttttgttttttaacaatctttaaaaatgtaaaagccattcttagttcacaggctgaacaaaagcaggtcatcagccagaggcaagaatgaaagtaaggaaagcagaaggctgtcaggaagtccgggccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtcmscactcagaaagttctggatttyattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaaytacaaagaaccttcttaagcatgggggagattataaagaaycttcttaagggtkggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaatccacattgcagccacagccgtcctcgctgtctcagctcagtgtccacctctgctctcctcactggccttcacacataggaacactacaatgggtccttggaggctgacattttagtagctgccactcctggttttacttagcgcttgcaaaccagccacatatgtagtttgtttaatcagatttccacttctccttcttggccctgacagtgcctggtttctggcaagcacttgcagccctttaacctttgaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttccccgaccccaccccatcccagacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttggcctcccaagtagctggattacagatgtgcgtcactgctctgggctgcactggtggtttttcaaaccaccgcaccctcccccacctcagggcctttcacatgtttcctcttggaacacactgtccccagtaatttgtacctctgcaacctaggtttccactcagttgctaccttggagttcttcccaattgcactagcagtatttggtttgttccactgttcctcttcactagagtgtttgctccctgagatcagagataccatcttagtcattgctatacctctaggggacctagtcatcactcagctggttgataaattaatcatatgatttggctgtaagagaattacattgtctaactgtctggacagagcttgaatcccctcagcagtctgaccgatttagagacagtccagccttatctgagggaagatcgaggacaaggcccgcagggtctttgaacggctctctgtcaygccaggtcttctttttgtgatctgcatcttctgcatgtggctgtacatgcttcctgggtctttcataggccatccattcacattttaagttggctctcatgtgcctccaagtctgctttgaggctgacaactctttttcctcatctagccctcagaagtcctgggagggaagggctgctgatttgcaratttgtcctttatagccttaagttgatctgaaggtgccccctctgtcagaggcttgtggtgcactttgagaaactggtaacactgcctcactattcaccatcccaccttcattcagttgccttttattaagatcttactgtggaccaaggtctctgttaagcacatcatgtacctgaatccttatgttaactctgattggtgtggctttggctgtacgtcagagcagaggacatggccmagaaagggcacctcacattcccaggtcacagagctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttctagtctgggactttttaaatgatgcaatataattawttttttttaaggaaatgtgtgtttaatggtaggtaaattgtgacgcacattagatataacatatcttttcttaaacttatcaggaactggagaagatgatgactatgttgatgattttaataggtaagaaaaactattgggcaaatatataaatatatacgttatttgtaaacaatttccgaacacagacaagacaaaattacatttggtgcttattttaatgtatttgattctgttgttcatattgattgaagatgaagaaaagatagttaatccaaaattaaatatttgattttagagcatgtttttgattttacattagaatatagacagtcacattatgttcaggaaacttggtaagaagaagagaaacaattgaagaattaactgagaagtcatttagaagcagttcagttgccgtgtcataagtgctgattttctcttccttccatacctttttgtggcgggaattgtctcaaaattgacctaaaataattatgctctcaaattagttttttgattcagatcacatttcctaatatgtggatatgtggtctgccctaataagattgccattctctttttttttttttttttttttttttttgagacagagtctcactctgttgcccacgctggagtgcagtggtgcgatctgggctcactgcaacctccttctcccgggttcaagccattctcctgcctcagcttcccatgtagctgggcttataggtgcgtgccactacgcctggctaatttttgtatttttggtagagacagggttttgtcgtgttggccaggctggtctcgaactcctgacctcgtgatccacccacctgggcctcccaaagtgctgggattacagacgagaaccaccatgccctgtcgattcctttcttatacacagaaagataatatgtaatgtagaagtaatatttgttgtggatatgattcgaaattttaaattagatgcctgagaattttatttaattgacaggttatctttccaattggaagtctgtatttttttttataatttattatacagtttttgagaaagagcatgatgtagtagatgaaattgtaaaaatctgggtttgtttctttcttgctattgtgaccaaagtcactgctttgaacctttgtctcctcatctgttacattgacttgactgctgctgcccttgctacattattttaagggtcaagcaagacaatatgtatgaaattaattatagttaatattatattttacttaaaggattaaaagaaatatctgaatgtttaaagaatagtaatctctttaaatgtttattttcagagttcttatttttttttccccttctgaaattagtaccagccatcgctcagagaaaagtgagataagtattggtgaagagatagaagaagacctttctgtggaaatagatgacatcaataccagtgataaggtatggtgttctgcatttcccatagagtgctttttttttttaacctatttgtcgatttactgtaaagcttcaaaattcatactaattagtagaaaaacagttgaaaattatgaaaagtcatgacagagacctggctcgagtttataaagaatgtctttgatgaatgtgtaagattggttttggttgtcacttcctttggtatgcaagtctcgctgctgaaatgcctgaggattattcctggggcactgggattgctgtggattaagagggatcagggtgggtcagrcttagtgagaattgaccacctggtgccataggtggaagtcagtatagggtactgtgatcacaggaggaagctgagcctggagtgcagagagtgtggtcatcttggccagttgtgacatctgaacaggcaagccagactgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacawggtgggattctccaagcgctgtgattgtcacacagggagaaggcctttgagagaggtagcgtttacartgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggattctttaaatatgagggagaggactcgaagaaatgactgttaaactaggatttgtgaaatgacgtgggttgaagaggaggtgtggcatccctttgccattgggggccttggatggcgtccaggagtctgggctttgttagactgcttctcactgggtcctactcactgggtttggcacatcaatgttcctaggagttttcacttaaaagcttaaatttagataattttgccatttacatagattggattttgacagtcactgtacttcatcaggaagcattttctaaagccttctgtgtagagaattgctactgggcacctggggaacacaaaagcatttgtattctttgcagtaagaatacagcagacaatctggtcacctttcagccaaggtgaccaaaaccagtgtccattaagcacctactatttagagagcacagggctggggatgtgggggtgtgaggaaggagatagcccagtggaatgggcaagttctgtaagttcatcacatctgggtttgagttctggagctgctacttaccactcacaaatttggccaagttatttaacttttttttgttttttttttttttagacagagtcttgctctgttgcccaggctggagtgcagtggcgctatctcagctcactgcaagctccgcctcccgggttcatgccattctgctgcctcagcctcccgcgtagctgggactacaggcgcctgccaccacgcccagctgattttttgtatttttttatagagacaggacttcaccatgttagccaggatgatcttgatctcctgacctcgtgctctgcctgcctcggcctcccaaagtgctgggattacaggcgtgagccaccgcgcccagcaagttatttaacttttggggccttgggtctcacatctattttgcaagagagatggtggtagtgaaaattagagataagcgtgtaaagcatatagctcagtgcttagcagaacaggcattcaataaatggtatctratactattattcattgtagtcacaatagacatttctgtcgtaggcacagatatagacttcttccctcaaatttatgcaggatcagagagagaaaagccatgtacacaaacataggaaaatcaagataaaaagtgacaggtgccataaaatgccagtcattcatgggccatgaaaattcagaagcaggaactaatatttgaccgggattttgaaagatgactctgacttggttctgcgagggctgaggaggaacatggtaagctccatgagaacagaagggagatcccgggacrtgtcagtgctgccctgattccagagcttcactggagggtgctgtgtgaagagacagaatgttgggaggagcagggttgttagaaggtgactttgaaccagaaatgacagaggatgaactaggagcagaggccctggggagggtagtctctgcacgggagccagcacgagcaaagacataggtagatgttggaggaagagggccacacgttcctaagggacagaacataagtgtgcatcccaggtttctgttaatgcatagcaatctaattcagcaaacgtgaacatttacacttcataaaacttttcaaaatcttacaagttcccgtcgatttgtatgaagcttgctatcacagggatcctttgtttccctttcaagactcaaaatgtaygttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctgagattacaggcgtgagtcactgtacccggcggaaaggctttattaaatagccatttatttctagttagcttttgttcattcagttttctttcttggtaactactttaaatgaaactgttcttcttggaagtttctggttattattgtggtcttttctttgccttaaagcaaaactaaattaatgatctccaataactgaattatctagattaagatcgttttcagtccacgatttttcctgtattcactcttgtctgtagtttagcatttgtattaatataacactcwawyactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacytaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatrtagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaatatttcctttctccattatcatgagttgtttatacaaatgaatagatataagttggttaataggttaactttctagtttacaagtagtttaaacagaagtagaaatgagtcgtttcttacaacactttgtgaacccggggctgggagtctgagactccatgggcygtcctgtctgcccttctgttttcacttcatgatctggcttcaggtggcacagtgttaaagtgtgtcacaccatgtcgagtttgatgttagaaacttaacgttctataccgtcatatgaaaacataagaagggatcgtttccaaattatacattttaatgaattttcgtgaaatttaacgtgggtaaattatggttttagagttagcaattcatagagtgatacttcctgtgaacagaatcatacattgggactatgctcaggtaaagaagtttaatacagtttttcactaatttgtttcttagattaaattggaataatggctaagatgtgttttattttaaattttcacttgaaatatttgagaataatcataaaacattgggctctaaagattgtactaacttagtagacatgattttaggcaaatcgcttctcaacacagctttaaatatgagttggtttatgaagtataaagtaatactttacagcaacagtttttttaatttttagttttttatttcttatttccataggttttgggggaacaggtggtgtttggttgcatgaatgagttctttagtggtgatttgtgagattttggtgcacccatcaccctagcagtacacaccgggcccaatttgagccttttatccctcaccctcctctcattctttctctggagtccccaaagtccattgtatcattcttatgccattgcatcctcataacttagctcctgcttattaatgggaagatgtgatgtttggttttccattcctgagttacttcacttagaataatggtctccagttccatccaggttgctgcaaattccattattttgttactttttttttttgagtcggagtctcgctctgtcacccaagctggagtgcagtggtgcaatttcggctcactccaacctctgcctcctgggttcaagcgattctcccgcctcagcctcccaagtagctgggactacaggcacccgctatattgtctggctaatttttgtatttttgtagagacagggtttcaccatgttggccaggctggtcttgaactcctgacctcaggtgatccgcctgcctcagcttcccaaagggttgggattgcaggcatgagccactgcgcctggcctatttgttcctttttatggctgagtagtattccatggtatgtatataccacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcacygacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagmagtggttatgagttttaattcatagaattgtcaataacataacatttgcaatcgtcattcctcctgttatccatgtaagcagctttagtcgtaggttctcttcattataatttattatctgtaaagattccttgaaacttattcagtaccaaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacrgttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgyatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctcygtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgrtttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatrattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggttgtgcttttatactttatgttggataacaacctgtgggcagttgtgtagatgccattagtccctgcctcatgcttgcccacagctcttcctcccctccttacttccctctcctgcccatgcaccagagctgtgccagcccactgctgcacagcctctgcacctgagcttgccaaagcccttcctgtctcaaggtgtgatatttgcccctccttgtctggaatgtccttcccctagaactgcatgaagctggtttatttcagtctcatgttcaaagacgcttccagacctaagggagatgtccattctcctccctgtccctgccccaccacttgcatttaccccttttattttattcatctcagcatactctgaaatggtcttgcttattttgtgtgtgtgtgtgtgtgtgtgtgtgtgtgtgtgtgtgaactatgagctcgtgagaacagggattttcttttaaactgctgtgtacctggcacaacatttgtcccctagtatgagcttggcatctttggggctgtaaacaggcttgagcactgacatggggcctggagaatgtggtttctggctaggcagctggaacawtctacaaaatctgaggggaaagctgtccttaccctaaacctggggaggtccctaggttcaagtctgcaggaaggggatctggttcaggagaaggccgtcctgtgaatttgccccacccaccaagctcagctggagcagggcctctgaaggaggtgccctctgtgtggctctgctgtggtgttggttcatgaaggacatgggaggggggcaggacaggagaggcagctcttcctggagaaaaacacacccagcccaagttggagccctcctgtggcattgggtggggaggattcccgccatcagttctctgtccatgggtgctagtctcacccctgccctccgagcagtccgtgctcccagtgtccctgtcctcttttttttttttttttttttttgaggtggagttttgttcttgttgcccaggctggagtgccatggggcgacctcggctcactgcaacccctgccttctgggttcaagtgattctcctgcctcagcctcccaagtagctgagattacaggtgcctgccaccatgcccagctaatttttataatttttttgtagagacgggatttcaccatgttggccaggctggtctcaaactcctgacctcaggtgatccacccgcctcagcctcccaaagtgctgggaatacaggtgtgagtcacggtgcccggcctagtcttcctgctctaggaagggacgtgtttggggaggaaatccagggcagctacctttgtgagttgtcctaatgctgcgttcagagttccacacgttcaacaagcatctgacatttaaggaaagtgaatgtatgtcatgaaagacagatgaacaaagaactgatcttgaagaaaatgtaatcaggaaacgagataattcaagaacaaaaacctgtgaaggactgaatgtgtcccccaaaatgtgtatgtcgaaacctaatcccacataggatggaattaggtagggcctctggaagttgatgagatcattagcgcccttataggaggcccgggagagctgctttgccccttccagcgtgtgaggacacagtgaggaggtgttgcctatgaggaaacaggccctcccagatggtgaacctgccggtaccttgatcttggacttaagccatctgagctgtgagccctacacttccattctttataaattatccagtccaaggtactttaggaacctgaatggattaagacaaacctgattatgccactccgagatttgaggtaacatttgaatctaaaagaggctatatgaaagaggttataataaaaatgatttttgactaaaaaattgttggcctaagataattcagtagcagggctgaataatgggatgactcaaaatcagtaagctcaaaggcaatttcaaagaaatctttatgtttagcaagaagaccaagatgacaagatgcgccaggagacttggccagaggacctccaggctgacaaagtttccccgaggaagtcagattggaaaagtgtcctcaggttcaaggaaacctgggtgtgcaccgggtgaatgagagtggcagacagaaggaaacagcaaggcctctgaggtaggagggacagcgtttttgaatgtgaaatttattccctgatacatgtttttaaaaatgaatcttgctgcccttagaaaatgaacccccgaacaaggtaaggtcgagctggcccctcgtgtcatccgactttgcgttgtggccctgcctgcagaaacgtgtgctctgctacagccctgggaggaggggccgggctcccaactcctgccccgcttctagcacatgctgtgcttggccacttctctgcctcttagtttaacagcagcactgggcaaggtttgccctctgcacaccagaccggcttcccaagaaccggggaagaggagagggcatgcctggggcctgagcttagtgggccgggtggaggcaggaggtactgcatggaggagcatggacagtggcatgcaggaggccagtcattctgcggttttagctggaggtttgtttttggtagtttgtagaatcatcagatttgatgatgaaactttttttccataaatgttaaattttcagagcccacttgtatttttttttttctttttttttttttgagactgagtcactgtcgcccaggctggagtgcagtggtactagctcggctcactgcaacctctgcctcccaggttcaagcgattctcctgcctcagcctcctgagtagctgggattacagatgtgtttcaccatgcccggcgaattttttttgtatttttagtagacacgggatctcaccgtgttggccaggctggtcttgaactcctgacctatggtgatccgcacccctccccgccccccccgcggcccagcctcccaaagtgctgggattacaggcatgagccactgtacccagccctgtattttctttaaaaaccaattttgggccgggcacggtggctcacgcctgtaatcccagcactttgggaggccgaggcaggcggatcacgaggtcaggagatcgagaccatcctggctaacatggtgaaaacccatctctactaaaaatacagaaaaaaaatgagctgggtgcgatggtgggtgcctgcagtcccagctactcgggaggctgaggcaggagaatggcgtgaacccaggaggcggagcttgcagtgagcccagatcacgcccctgcactccagcctgggtgacagagcgagactccgtctcaaaaacaacaacaacaacgaaaaaacgattttggcatgttttgtaagttgccagactattggatatacctcttaatcatactttgtttgaaatcctttgtggtttctaaagcactagtagctttctgaaaggaaaatttttaatgaatgaagcatgcttcatcctgcacatcccctcctgccccagcacccctactgcccatgcgcctctcctgccccagcacccctactgccccagtgccaggccttttctagcagctctcatgggttcatccctgctgcgggcattgctccaccaaggggcagtgctctccctgccggtaagtgttggaacttcacgtttccctctagttttctctttacattttaacatatactattatgtgtcaatatattaattatatattaattacatttatagaggttaggtatatatggcagatcatatctgagcgtgaattacattctccaaatttttatttgtcatgatttattgcagggttcacttatttgatctaccccaacttaacacacatttccaagaaaatatccatcacactagaaagaaagaaagaggaaggaaggaagggagggagggagagaaggagaaaggaagaaagggaaggaaaatggaatggaggaagggaaaaatggaaggaggaaggaaggaagggaaagaatgaagaaagccatttgttcctgcaaacctaaacctctttgtagtaagttctggcagaaggtgtgtttctggagttaaactacaggcttggaaatggaatttcttagcctaatttctaaattagaactgcttatgcaaattaacactccgtacatttcaacaagcagttggctgatttcttctgtccactccacctgcagatgcagaggtggccccatcctgtgatgtgccaccacatcccttttcagtgaagggctttgttggctgctgtgggcattctcatggcctctccagggatggcctccactgtagagacctatgtcaccaaggccaggccctctcagggggctccatccaacgaccattctgcctcagggtaagaggcccggccctctcagcctgagtccattctggctccagagctccctgagagcttgcctggcaagttactcttgcaattctagcttccagcaggcgttgatttctggggcacttttgataaactcctggcaggaaactcaatctctgggggtcagagtccacttcctggggagcccaatctgtgacccctaggagtggggaccatggaagcacttggctctccagcatgtgctgaatagggggcgctgcctgcagtgtccacgtggaaacctggctgggagaatgcctgtgtgctctgcatggggatgtaaaggtgtgagcaaaccttcttcagagaggggatgttcaatgcgaaatttgaacattgggacctgaaaaactgatgggctgatggggtctgcccatgattggcagccttcatagaatcacgagggaagagcacaggccaccctagacaggaggggtcccctactgacagggaggtgctgtcggggcagcaggcacgtgcaggaaaacggaaaagcagagtaattgaatgtaaatcatgcaactccactacagtggctagaagcctggatgggcaacttggctgagtgatgttgggcaagtattctcagttttctcatctgtaaaggggattaaatacttccttcccttacagggctgccctggtcttaagtaatgcccacagagagcttagcattgttcttggcaagtcactagtactcagtaaatactatttttattaagaaggtaagattcacaggacttagtgtcttaactagatgttgagagtaaggagaagagagaatacttctcggatgattgttcagtttctgatgaatgtctgttcccctttcaaaacctaattcagatgtcacttcctcctcaaagctctcgccccgcgccgagctactgtgatgtatttttatgacctggcagcttttttctcatatccctgttagcggtatgtggtaagaacatgagacacagaatcagaaaccatggatttctggtcttgactccactaccactcagaggaac

SEQ ID NO: 12164 - DNA, 128294 bp, Homo sapiens
aacaaaacaaaacctcagataatccctggccttcataagctatccctcccctaacacacacgctgcctttagctttttaatatcatcacctcgctctccatttccttttgttttataatgcttgtgtttctttctttcttcgtcttcctcttttttccatttttctctttggctggtctctctgcttagcattcctttcatttccttttgcatctctcttcctctaggattttagttcctcgtttctgcttgttgtttccttttctggtcacagctgccccctaatggttttcaagatcattactgctttggactagaggaaagagggaggcaaagagctagagaaggaaagttagagagaaacataaaatgtgtctttgcttttaactttgccatatcgtctcaatatctctggaagaatatgcaaaacctgcatcaatggggaagaagtgaactggaaaactaagggacaggtgtgaagtttgtacaggatactttttcgtgtaatttgaatttttaaaagatgtgtaatacttattttcttttttatttaattttgaaataaataaatagtatctgagtctggagactgaaaaggagactgcctctataaatgatttcttggttgcagcaggaaagcaagcgccatgccagccccctccccatcagtgtgctcatccagatactaagggttgattggcagctcagtaaactatgtaggagtaaatatgacggaggagagtgggaactaatgactatggtgggtgtgaattaacccaccctggagtctcctcaatagcaaaaggtcagctccctgactactgcctttccatcaagactttcacgctcaaattagcagctattgccatcataatgtaacaatcacctgacatgtagatgtctaattaaggcaccataagtcacaggttacaaatttgaaaacagcaatagcaacaataaaaaaatcccttacaaatctgtgggggatttgatagggtacatatgcatgtgaatgaaggcaaggtaatgtgcactagtgggtggaagattcaagtttccaagaaaattcatctatgaatttagtaagagaatgggaattttctcttcaaaatatttctgaatgattaaaaatttcatatcgtagccctaaaatatccaattgcataacctataagtgctatgacgttacaaatacattcttggcctttggttgtgattgccaagtggaatctgtattttttatgataggctagaaaaagccttgttgaaaaatatctcctcaaaaagccctgccaagatgcctgacatactcattagcactcgctgtttgggaaaagtacccaatgcaaatactatgatgatggaatatccattgaagccccatccatgcattaacagtttaaggataaaagagcattaatttcaacttgcttaggttggcctacagaattcagactaaagccagttttaaatccatgagtgagaatgcgatcaggaaagagtcatagccaaaactcaaaaccagataaggttaaaaatcattcaagtcaacccatcattctgtaggtgagaaaagtggttccaaattggttaacagaattttcaaggacacccaagtagagactgaaggtccagctgccctgtcctcaaggcttctgctgcccccacctgcttctccgcggtggtctccactgacgagtggagttgaggcccgaagctgggagagcatcataaagaccctgactcctggtgagtgctctgggaaagtcatccaagagagcgtagaaagaacatgggatgatagacaataatatgaatataagctagctcttctcttccttaaccaaacagacagtgagcattttcaaatgctgccttggtaatcagaacttctgctgatactggggttcctttcttggcaaacaagtatggtaaccacagagattgataagggtgtgaatttctatgggtttctatgggaattattcagctctggtcttttgattctgaggctgagttgtccaacatggtagctggtaagcacatgcggcaatttacatttaaatgaataaaattaaatacaacctacagttcagtgactcactcacactagccacatttccagtgcgcagtagccatgtgaacagcacagagaccaccgtccttgcagaagatttaatggagagtgctgttttaagggagagggttgactgggtctttttgatacgcttattgcctcaaaggtagaaaaattaatgtagcataggaagatcagactcatgctaaagccaggcagactggaagaagcaatagggcttctttaggttctttttccaaggattccagggaggtctgaatgaattttgcacattttgctgctgctttttaaattttgtctcataagggcccctcctaccagatccagtgtttgtgtctgaggaagaaatgagatatacacccagtatggagtgaaggagatttcaatactttatggaaatctgtaaggattccagaaacccaccaaatagaatatactagaaatatcaatttagaatagaaatgtcaaatagaaactactgggcaatattcaagtgtgctggaaaaaaaaaaagttgattgtttaaaaggcgagtaagaaaaaaaaaaaaacccttagtgaccagaaacctggactttgacatcaaacaaaagagagaataataaattaggacctattccattttaactgaagctttgcttctgagacagatgtagctaaaccttaactagggcagtgtgttaaattacagattaagatgcaattatgccttagatctttccttttcagggtgagagcttattgatgttagggctccgataaggggaagcaccatgtgacacgtgatatctattgtggaagcatgaaacttctggagcttttagatcctgtgttcccgagaggcaagacctaaatctctgtcttgctcgcatacctctggcatagtcatgcatccatgaacatttcgtaagtacagtgggatgaacacagatggaaaagcatacctgaaacgaacctctagtaaccaccaatggttgagtgggctggtgatgaaaggtctggctccagctcataaacccatcagccgctactttgaacatgtccctgcaaagctcctgcctgcatgaggcgaggcttttggtgttttcaaattggctctctgcagttgctgctaaaggtcacaggtaaatctgggaattccaccactgcagcattttcgagaacttgttcttggtggtttttccaagaaacctgaaacatctgccccatattgaaaagtacccagagaggaaatgtgaaggaatacttgtccaggtttccttcaacggaagagcatttatggaaggctgtgtgtaaatagaacacatcagatcagaagttcccaactactggtctgtggaggctttgcatcagaatcacctaagatgtgtgttaaaaatacagattcccaaagaccactccagacccaaggaatttcacctgcaggaaaatggttcccaggratcagaatttttaacacttcctccaggtgatgctgatataccctaaggtttgggactgtctagctgggaacacttaactttccacaggggtgtggcttggtaacagctttctcttagcatcatttaccaacctgtttcatgttcccccacatcccttcccgtcaaaggaatggaatgtggagtggattatctagtattattttacaattaaggataatgacatgaaacatcctaggtgagtcagtgatgtggccaggaatctcagcttcgctaattagctgttatctagtcagctcagtgtttttgatcacaaacccgatttttgacactggcctttaggtaggcaggcttccctatgggccagggatgtggactcacaaaatactgaaaagcacggtgcctacctagctctttaccactatacctctggtggaaaccagaccaactgcagtcaaaccctgagatcccagtctagagggaaacaagactggcaggtctgagccagtcccagtgtgaagaatttccctaaagatttgttttccatgtggcacatgtgagatttgtgtttagttcccaagagtccttggaagtcttaggttaaaacaattctaagccctctctgggccggtggggtcttgttcagagtaggctggggagagatcggcctcactctgaatcttccctggtctgataaagcactttgaactccttggaattaaaagcaccaccagaagtgtgaccctgggtggtgttaccattatttattgagtgctgccccctagaggattgaaaaatggtctggccgcttgagtccccagggatggaaacstgagactcactctctgtccaactgcaggaaatgaggccttcactcaaggggagtgggaagtcttgcagccctggtacagaggactcccaggaagtaagtgagcgtcccctgtaggacaccgctgaaaaatgaaaagttacagtgtaggcaaccaggccaggaacaaaactgattcttacttttctctactctggaagcagcctgatggggaccttcatccctgagaccccaagaccagaagtccagggttgtcattcttatggttctccagtgggcttaggtttaccttttctctcttctttccccctttcacagtgcccttcacctaaaccctggctacattattctcacaaacaggagtctcccacattgggcactggcaaaaatggtttggcatgcctggtgagtggtggggagaggtgatattaaatggccctctctattcagggactgtcactacagatagcgttctttgtccttagattagcatcttggcartgacataaaccgggatctctgcttaaggttaataatccaaactactcttttactttgttaaatatttaaggcttggagtcattctttacaattgagctttaaagaggagaaatgtaaatctggagtttttaataatgtggatgtgctctcaagcctagaaaggaaggaagaaggaaggaaaggagggaggaagaggaaggagggaggcaaagagggaatgaaaggtagcatttaggctagccaagagacatgctccctggaagaactcagaggcctctgtgctgtgcctttcccaaccaggcatctgagattaacagtgtgatactcarcctgtggatttccactctaaaatcccgcsccaccccccaacacagcttggctcaactatttgcaaatcayttctgattcaattttgttttggttatctcagtgtaaataacagttaagtgggagttacagatttttcaaacactaaaagtgataaagctaatgggcaagtccagataaggagggaarccacccagaagaatccacaagtacaagccaagaagaaaatgggtagtcaggtgtgtgtttctcgtcaccgaaactgtatttttcttaatctacagaaaattttactttcttaatttaaaaaaaatcttaatctgtaaatatttttctgaattttcttatttttcatatacctcttttgtggcagaaaaggtgtacatgtgcagggtgtaatttaggctgtttctgttgcagtctttatgataatgtagtaataggtgtctggtgaagcaagacagtttggaatccacaaagccatcctcagaaacaaagatacaagtgtttccccaactgttagcttgcagttccctctaaayagttttcacgcctccatttaaaaatagttggcataatgatgttttctttctctaggctttgtgaccacgtttccatgggggaaaatgtgaatagacgtagttacagtascatttggatgagacgccttcaagcacctatactttttcgggggaacttgatggaatccaatttaattacctgaagaaattatttgctgaagaaagtctttcctctttttagggtagttacagttaaaggcgcaggggtaacgaaatcctaacccagagaggagcagagcatgtttgggacataacaaaggatctgagtagtaaacgcagcgagtgtttggggttttattcagaccgggctgacggtgtgtgtcgccgccacgcaccgctgcctgttcgaacgcatggctgagctgccgaccggctcgctaccccaaacaccgtacgccacccaactcctcttgtaacgccatcgcgcgtggcattgtgttgggttctgcgtgtgtggcatcggagtcgtggaatttagggggaacaaggcttttccccccgtccccccggggtctcccttgggtgggggcgacacggccaagggcggcgcgccctgggggtgcccgggggcgcttcttccccagggcgttacgcaccggcggcccggcgcggaggtgcgcgggggcgatcgggagatgcggggcgggcgaggggtggtgggatgggcgccgccttaacttcgatcctgcggcggcccgagagaagccgtcgccgccccgcccgagctgggtgccgcggcactctgctctgcgccgcgcgtctccgcggctgcctctttaatcaggaacacagaaggggcgggccctgagccggcgcgtaatcggatagctctgccgcggctctgacatccacatgctgctcggcctgaaaaggcagtggggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgygtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccacyttctccaaaatggatatgtttcctctcacctgggttttcttagccctctacttttcaagacaccaagtgagaggccaaccaggtaagccactgaaagtttttctatttattgcaacatggtttcccctttaaaagtgaccgctaaagcaggaaggccacgcagaacggcacagaagaaggctccctcagtactcaataatttaaagagagatcccagccggcccttcctacaccaccacggctgctaaaacccaactttcctctcctgctaggagtgtgtgtgtgtgtgtgtgtgtgtgtgtgtgagtgtgttttgaaacagaatttggcggtgttcatatgtcacatatggactgaatcaaaggtttaaaaatactacaaagcctttgcattacagtttttgggaattttttttccctgtcttgaagcagaacacayctcccttgagtttctccaactagccagtgaaatataaatcatttgcattccctccacttagctacattgagcaatgttaactgaagggcttgggaaagacaagagtttagttttggttttcagatgctgtagattctttggagaatgactggttatgcttcagaatcataaggctcaggctggtggagcaagttggcttgtggctgagataggggcttggggttgggtgctgctggcaaccaagacggttggtctcttctctcttcatccatgtgttgtctgggaaagtaaatcgtacgttcttttagaaattattattagctaaaacaaattgcaggccctcgaaggtctctcactcttgtgaagtggttagaaacttttgagtggaatttgttctcaaccactgccaaaaagggtgtgtggacaggctgctgtggagataagcatttcgaggcccagaacagtctggggaccgcatttgtggggagcggcaaggggtatgctctggaaaggggaatccatggggaatgcagtggggtttgtgcttccttctcggaccactctctagagtgagcctccctacccctctgagaacagtgtctggaatctaacaacaaaactcttagcagctgctacaggtgattggagatggagaaaccatctatggaggaaatgggtgaaagaaaggcgaaaaagccttcctgaagtgccctcacccaaggcacttgcaaggcgatggcggcagtggtagagctaactctgcagcctccttggcatccccagaacatcagctagtggatcctagccttgcatctggtactgtcacccttccttctcctcacgccccccaccagcacacacacsactttaagcttgggcatttatttgaggggggaagaaaattcaggaatgcctttgccacccagatccgcacgtttgcagctctttctttgccataagtggtcttcagggcagctgcaaatcctgccaaagggatgggtgggggtcccacttggggagattttytgggcctccsccgttcccccttgccttatttytaaattcccagcttgaagcggaattaaattaccactcacagacctggatgctgcgtaaattatgtatgtttgtgtgattcgctgtgtgtgtgtgcacacgcgcgcgcgccgtgaggatgcccacagtatattatgtattcagacacggactccagtaggccccagcgcgcgagcgcgcacacactggcactcacactggcgcgcacacacatgcaacttcaggttccgtgtgctgtgcggagcgggaggggtcgtgaagactcaggggccatctcctaccccagatgttcgcacatctgtccccgagcgctgcttggagtgtgtgtacgtgtgtgcgcgacacccgcttggacccactcccgctctgccacctgcctgccgcgctctctgcagaaccccctcccatcccaatccccagcagtgctgcgtcacttccagagaagcccagaggcgcggagttcggggcaacctcggacccggggtgggatctcagggtgggattcgaagctgggacctgccagggacctccagctccccaaaatgcgatctcaagccgtgagctgctcaggctttcaggcggagcaaagcactggcaccctgggagccggcagcgggtggccagggcgaggccaagcyacacctctgactcacccggtgtgcgccggccgggaagggggcctggttcagccgccgccgccggcgacgagaaccaattctgggaaggagcaagatggggcagaaggtgcgcgcgggggagcaactgagcaaataacamggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctycgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtgaagagcacgcggcgtgcggccatccacgtggtggggacgtgatagcccctcagctctcctcctagccctccctccccttccccgccccccagcgccttctctaacgccgcatcgatttgtttgggctacgcagcagaaacagagcccagcgatccataaacattctattaagcaaaaatattcccagcgaaagcaaaaccgaggctgaagcctccgcgaagttggccgcctccaactactccatgcttgtgccctcctcctcctcctcctcctaaggacacccccagggaaaagcctgcggcatttcttcaacgctgccctatgccggaaagttaggtctcggctgcagcgctggtctctggagaagcctctgcctgcagccgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttcccaccgggtcgcaggcgtccagcggctgggtggcgggcgccggtagccctagtgtttggaggtgggggagggatttggaatagacttgtcgcccctctgggaatcatctgggttggggaaccttcgggaatcagctttccagaccaagttttaggggatcttgcccatatgcgttgcggcttctgcggctccggctgaatttcttctaaaagataggagatccacgctcaggtttattggcgtgtgctccctgctcggctcccctccctccacttcctgttctttcggtttcagacagagaggagagccccctggcgctagccattcccgatcagcgcccactacgaacgtcccctttgctagagttaatcatgatctgcggggggactgggttttgctcagaaaatcattcaagtcctgacaatgggtttcttcaaatggtggcaactcccaggcctaatgtccccacctccgggacacatcgcttggggccaaaagaacccagaccccataaccatctacccctcccctcctcgtctggagagctttgatctatgcttgggttttaacgccattgccatggacacgcgcagattctcggtcaattcacccttccgtctggactggatgatcagataagaggtgtaaattggctgtgggagacaggtctgggttcagacaaatcctgaaagagaagcaatgayggtctaggcgccggataagggtttgaagtgtttcttttagcctgtctccccaaaatgtgagatggccattggcgagcataataatttgcaagtaaactgtaaactcctagattttaygcagacggcctgctctgggctctagggattggtctcatgcccacattaaatgggtacccagtaaacatttcccccgtgatcagctcctggaggtagggaagctgtggccagttgccagcagagcacacagtgcaagacagtggcaaraggagcactccccaaagggccccgggcaggcccctactcgtccaagcggtgcctggtggaattgtgaatgcgccagtgcacatcaggtttggagttttatgtcatcccatagagccctcagacattaagctacggagcactcaactggcaaaatgaaagattggaaggctgcagtgactggaacccaggctacccagacaggactcctgctgtctaccaaatggctctgatcccctgctgttgaatgtatcaagtccacgttctgcagcagaaaggccagttcctatcttccaggcatagaaaaagctaggaatccaaatgccaattcatatgcagtgaggcacgaatacaaatgacagtgagggaggggtctggggtcagtgaggagagacaycagggaccagatgattctggggaccctggtgtttttcatttcactcaagtcttccctaaagcaatcaggaaaatgaactgactcaggrtgacctgagtgtaagacaattctgagttgacagaattcaagagccaggtaaagaggtttccaaatatattctccaaaggtccagtttggaaagactttaggaacttgagctgagatcttcctttcttaaaagatagagcaaaagaagaatatctttttaatttcttgaactgacaagaaaggacttgaaaagtgtcatctgggcaatggcttgtagtgtyattaacatatttgaggtattttattatctgaccatcacttgcaactggataatctttgagataccttccttgagtggcagataagtatattgatcaccagaagttagtctttgtactgttccttccaggtaaggacttggctgtttgctgatttttgttttttaattaacccatttctggaagatgctgcagaagtttgtcctggagagctacagtatttttcaaagctttatctgccttgatgagaaatggtcagaggcttaatggtttcattgcctaacaggattcagtggagtaggattccaggacacagtggccttgtatcatggctggccytccaggagaaagcatcttctaaaggtttaggaagctgtcaagtttagataaggctgagctccgatcctctgggaccttggttgtattaataaggagaaattaatttttaaccactgggaacattgccaaattatgtgacctttggcagaccagctgtgctataaaaataaatyccccatttctgaaaatgctactcctatccagtagaacaataacaatgtggcatttaggatagagaagagtaggattgagaagaaaggagagaaataggagttggcaaaaaacaaaaaaacaaaacaaaacaaaaaaaacaaaaaaacccttcgatgttgtgatacatggtttcagacctgaacttcctatccatcacccgccctccccggccccatgcctagggtttccagaacacaggaaagagggccaggatgacaaggagctgagtgcctgtgtgtacagggagtggagaaggtgttaagtgcttccagcccactcacaccccagcctcaaacacatctctcattgttcacacagacagagtactggcacaggcagagaaaagggggttttcaaacaggcaaaatatttgtctttccctaaatgctaccaagtaggtttgccactgagaagttttgtggggatcatccctggccttcccagcttctgaaacatgggaactagactgcctgggtttagaatctagctcagccacttgctggctctgtgatcccagtatcctgtgtgatcagatacttagtctatgtgcctcggtttccttgtctgtaaatgtgtttggtaacaatacctacttcatagggttgttgggctatgtcarattatgtagaatactgtttggcacatatgaagcccattctgaagtcactgaatctttaaaactgtttcagtggggttagtggaatctcgtgatcgtagaaagcacactataaccattgtggtaagttgatttttatgagatttaaaaaataattcttattctcagttcttccaccaccaaacctctgtgttttgtaagcaccatattatctctcgccatgctcttcttcagagaatattctctgctgagttcttatcttagatttatgtctcccttgcattttttccctccttcttcctctgttttcagtattcttacctcctattttctttttaatctctcatttcctttccttttcctccccttccatccttcaacactgagagtgtgctcagcagrgaacaccgygtttaaggcgctctcccgaatrtgtaataacttctactctggcactaaggcccttcagcagctgaactcaaaaaagtcatcataaagacaaaatagcttttacccagcaagggtcttaataatcccatttccctctgggtcttcataaaggagtcattatctaatccagaaaaaaaggaggggctgggaataacaaaagagaagctctcggtagcacagagtgcacgaggctgccggccagctgagtgcacgtggccgtggtaccctgctcccgcctccacaaatcctgcgataaccagtaaccagttctggcragtctttcagcagagaagataatgggaattgcaaattactagaccgaatgctaataataattgtttggatacaggagaaaaaataaaacagatgttccccaaaggcattctaggggctacagaaaggaaaatgaggagggggttgagtaaagagaggtttgctgaaaccaagcacaagaaaatccaataccaacaaatggcttagtgatgaagtaatagtcagcatcttcctggtggtacagataaccaatatttaaagttgcctttggaagtgtgggggttggagtgaaggggacaaaacccctgagataaattaattttactagtattaaaawtaaaatggccragcatggtggctcatgcctgtaatcccagcactttgggagaaggaggtgggcagatcacctgaggtcaggagttcgagaccagcctggccaacatagcaagaccccatccctgctaaaaatacacacacacacacacacacacacacacacacacacacacacaatagctgggtatggtggtgggcgcctataatcccagctacttgggaggctaaggcaggaaaatcgcttaaacttgggaggcggaggttgcagtgggccgagattgtgccactgcactctagcctgggtgacagagtgagactctgtctcaaaaaataaaataaaataaaataaaatgtgaatgtgctttgaaatttatcattattatctgctttagggtgttctaggagacatagttcgcactaactctaccttgacctacttgtgactaggtattattatcccagacaagttattcaaactctcaattcaccactaagaaacatttgcacttaataacagctgggggtggggagggaagcgcagtagctgtggccgcagaataatttctgatagaactctcagagtctgtcctatctagtgatacctttgatgttcctttggtcacttmttaattggttaattcaccaaatcttgatgagtctgacttttgggaaaggttctggtttgatcctgtaagacttgccaaaratggatcagcaaggagtcatgacctcaagttgctggtggctcagtagactggatgaggccctccagaactctcacacatctcagaagatgctaaagagcttcagcctctcagatgcacagaggagaaagaccactcccagtatgggagaggagaaagggcagaggcagcctggagtgagagagtaggtgggatttagagcagggaagggcataccaggggaaggggaaggtgtgagtagagaaatggatgctgggttggtttggggaacactcagaagctgcagtttagaatgtatggtgggaaataattgcaaacaagattakaaataatagcttgggctcaattcaaggcccaaattgctaggcaaagaggtttgggtttcacttgctaaccaatggggagccattaatgtttcaacataagcttcagttaatcaaaataaatgaagacaatattatattacttttttttctcctttggtttttggagagacctcaaaattattcttctgtttccttccccaaatgtctcctaaaatggtcaggaattgtaatcccagatctctcatcaatggcatcaaaattgcatttgcaatgagggctggaaaagagaggacataaatataaactaatgacattatatcggctgccctattggaattgcatttgtttatgatataagatgacaaataataaggttaacacaggtggcatgattcgaggtcaggagaggtaatcgcatcaaacttacattttaccgattaaatgaggcttcatttttagaatctagattgaggggagagatgttcaaaaggcyccatttccagacccaatttccagttctctcctaagtgaattcattggaggtgttttaagagagggaatttgcttcattctttattcatttccaaactcatatgctggcttcctctcctgctctctgcttccctctctccttccctcctagatggcccttttattcagattttgaactttatcatttcaaaagttcagaaggatttccatttgctgtgccttcaggagtgcatcattcactgccaccagtctccataaattgagtagattgcatcccttcccagttgccttaggaagtggtcaaacagccacattcctgggctgatggattggctcatttcttcccagcttaagccaagatacagattttatgagactgtcttgtgacaggctgaagttgctttgaataaaacaaaatccagcctcagctcacagaaataattcttaaaacgcagcttatcccgggttggtgagcaaaatttggttaaaaccctgagccaacgacttagatgatctgggtgagggatttgaagaaactccttttggtttttcttttcatgcatcactgttgttgacatgctcacacacagaactgtgtatccataatatttataaatatgcagccacagactcagttacaaaaagaaactcgtgttagtagacctgatgtgattaaaggagacatttgaactctccgtaatgcaagacagacatgttttctgaagaatcctggagtttggtttcaggcttaccaagcagatagaacaggggtagcaccttgagtaaatgtcttattgtctaggagggtagagaatcttttgaattyttggctcaatctrtgggttataagatctattccccacctcactacatgggctttggattttagcactggaactgacctttagaatcacccctctcattctatagatgagaaaacaaaggctcagagttgtctactagcttacccaaggtcacacagcttgctagtggtgagactagacttgattactaggcttttaaatcctgctccaatgctatttctaataaacttcctggtggagtaagtggcaaggtgacaacctcctttctttttaagtagaagaaagagtttcttctttgccttgctaccaataattaaatgaaaacaatgctgtggaaatagggacaaagtgggattatgctgtagataagaaataaattataaagtagataaagtatattattttcagaggaaatgagaccgattgcttttctccactaagtgccctcaggtatacataggaaatagatgtctcctagtcatctgctctttctcttttccatagcattttaaagtaacagggaatggagatgccccatttagagggtttcaaaccatgttccaggaagccccagtggacttgcagagaagcccttctgagctgagggcaggaactaggaggcctggacactacaatgcttctggctacctccctcccagcatccaagaagagctcccttttatgttctttgtacatgggaggtctaggtagagttttgttcaagaaaaaaaaaaagtacttcaaaaaaarcaaataaatttgaaagctacacacctaattcagtccattctttgaattacagtttgtgaagctgagccccagaaaggtcaaattgagtgagttaagagttgggtgccatctcccatctttctgctaatgtcgatccctccctttcctggtaacccagtcccatcaccccagactcaccttttacaacaactgggccctctaatcccacattcagccaatggccaagtttccctggtttygccaaggactttttccttcagttcaactaaagcgagggatctgattggtcttttaccaagctgtcgtgaagtaagctatagtaatcagattatctgctacagtcaggcttcagtatttagcaaatattattgtcaagttcaggttatccagtgttcctttaaaacaatgccaactacatttttctagaaggcagaccagatttttaaaagatcttcttttcccattcttaatacttcttaaaaattaaatattcgcaaggaaagtgattgggttctgtaggaaggtgagttcctaagtgaaggggtacaacatccctttgccttttcagggctatgttacccctaggcagaggcagatggtacttagactaccagcaaaacaacaatacttaagaaggagaaaaagagcaagacagaaagagtttaaaacaatctgatattttacatttcaaataaaaacacctaagtagtacttataagaggaaaatcagaacttggtgacttcagaacttagtgttctctttatttccaattacatctggagctgtcactttattcctttcagccttgggcctttctcagacctgacctggctcatccctcagccttccctcccaggtataggagaaaatgctctaacagtccaagcctggattttgctatctctcttcgggtgatgaatttgccccaggtgaaaggtattcacaaaatagttgcagaatgaagtcttttgtcaactcacccagcgggctcagtagctcaaacagggtcaatttcccctctgtacatggagattggccttaagggttttgcccttgagttcaactctcctttggcttagcttgactcctctgaaacagaacagcaaccatgtataaagttcattgtggaacacaataaagacctacaaagtaatggatggtatagctcttcagaagaaattttagctaatttctattgggacatgtttgtatttaggaaatgatgtgtccccaaccctagaaaggaaagatcagttatcaagaggagaagtagaatgattaagtgtgttttctttacaatttttactgatatgtttcaagaattctgttctctccaagaaaaataaaaacagaaattctagtatttatctttgtggatatatgtttgtgcaaatgatgtgtgatattttatgagaaggtgtgaacgtatgtataggactaaagtgtgaattactgatatgtatatgtacttgaagtatgttcaatatctatgtttgtgtgtgtttctgggtgtgaatgcaagccaaacaagaatgtgaatttataaatttgtaagtattgaaaaggttaccaacacacaactgaagcagatgttctaatgagttctctgatacttcaataactgccctgattttctccaggtaaagaaaggatagaaaaaaagcaatggatgactcctttttcttttggtttaacagcagacagtacagactatcagctatgggatatatatatagtttaatttttttgtgtggtggtggtgaagaaatgatcacttctgctgtagatgagaaattaaaccttcctgcgaagaagtttcctgtctttattgctgatctgtgtgcctggtctaattactaaaagtttaaacctggggtgtggggaattgagggagaaaagttcccctttcaagagtaattggagagaagtagaggaagggatggggaaaggagggagasagtgtgggtagggagagtggagagtatgtggaaaccataacagttactaaacaggagctcagctcaggtttcctctgacgaattccaaggcaaaaaagtgtggtttggggtgagttggtggcagggctgcagttttctgcaaaatatctggcagaggagctggacccggtagaaaattcccccttctgctagttgagtaagagcagctggtgatctatgtcctcacacctctgccttctcagaggaccactccaccctatttcatgtgcataagccaggaccaacgggcctcaatttggctggctagatgacattaggttcccagcatgggtgagtggtgtgggcacctggaaagcctatgggtattggctgcagaggarctgggcctcatggctggcctcatgtggtctgggtgggagggatgagctcattgtcttcatgggctggggtgggtgcagggtcattaggtaagaagatgatgtgctgtgtaccagcctgaggaaayggctgcttttgttttccacccagtaggaaatggacctgaattcattccattctgggcagttcaatacggcacagtttgagctcgtggaggcttgatgccgaaaaggctacttgtgtggatttgtgtcccaaccacccgtgtgcagcgtgcccatcttttatgcatttaaagcctgtcaggccggtagtctaaagcagaggtctgggagatagtaatgccaacagacatggggaatagtaaagtgcacctgtagagttaaaaaatgcatgacctgttccctcaaagagtgaacacaggagaaagacccatcctggagggcggctgctgagtcgtaatacataattcacgggcccatgctgctccatgcagatggcgatattaaatcgtgattgatgctaagagacacacacatctcaggaaggtctccgagaggcttctgaatatttccatgtctcatgtgccttcccagcttctgttctactgtggtatttaagcaaaactccctatttcccaagaatccctgctggggattgcagaactttactcccgaatagatgagattcctcaaatgtcatcacccacctttggagcctttgaaggtggctcccttccctcccaggccacatgaagctgtctgcctccagccaggcactgcaggtacagggagccagcccttcctgcaaacrgcyagttatggctggacaaagcagcagcacactctggtggtggtgaccaggcaggagggacagtgggcagacagcgcagaagaaacagatgttcattcaacacaaagcacctttgtcgaaattccaaggctagagccagtagattctctaatacagatttttccattcggtgtataatgaaataataaatcaaatttgtggtatatatggaattaaatgtttggggggtttgcattttttttcttaaaaaaaaatttaaaaaggctgcaatcaccctccagggcctgttctggcccaaagctgaaagtgcttcctctgcaccacatgtaattgttaccaggctcgcttgtgggtcggcaccacaaaaccaccattgtcagttcccagagccctgactgctggctgcctgggctgggctgggagacaccgaataaaatgaaggatttatgagataaagatagagataggaggttgaatgaggagaggaagatgggccaaggaggggaggcaggaaaggcagggaggcatgttgagtttgcagtcctcttgtttttttaatcacagaccatgtaattgagaatatttatggccatgttctggaatactttcatctgtgtgtgtgtgtgtgtgtgtgtgtgtgtgtagttgggtgggtagggggagggatgagccggaataatctcttccaccgaatgagtaagtaggttagtcttctggactgccataaaaggtctgtaaaatagttttaatcagacactggtacagaagagaaggagggagtgtggggggaagaaagytgtaacatatttgaagttctttgggtygttgatttctctttcagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtaagcaccgtcctgtcccactgtgtatcccatccatgagatgcacacgccctgcccccacccctgctcttgtcacttctatcacccctcaccccaagacctgctgctaaccagtggtggatcctggccccagaggaaaacctcaaggggcattccctttccagggaaataaaggtgtggctgatcccacagtatggtggaaagagccttcttgagtgaaaagtagagaatattaacctacctccaaaggccggtagtggaggagaatttccatgtggtggcaggggctggactacaaaactctactcttgactttgggttaccttgcacttggagatctccccatttccacagctgctacatgtataaaccccacccacttccttaataagatagtagctgtatccccaagtggagacttccctcgcatccagccacgcaggatcagcctgttaccttatatagcggtaactggttttcttatagaaaaaaaaaagggtaaaaaaaaaaaaaatctaagtagttctaagattcacattggttcttgatagctgtgctacacaagtagagtctcaaartcagtgtcatggatttatttaacaaacactcttctaattgcattacaaatattaatccatttactttgcacagtgggccctgggaagttagtgccattatgatctccattttgcaaaagagagaaaaccgaagcacagagaggttaggtcagtcacccaaggtgactcagctggtcttacaacattggttctgccaccctggaaatgtgtggcttaggaactcccaagtggacayttagacacttgggagtactttagaaatgccatgttactaccgaggtccctaaaagttaaggttgggaagcaggcagcatgtctagaatgcagatgtgctttaagctgtctactgagctccatcttaaagtcttttctcattggaaataaagtgagagtttttgtgcagaaaagaatgtgccaacagtcatattctgccccaaatgagcgcctacggaatgctgttactctgataagtattcagtgctcccatgtgattcataaattgtctaagcattccttgctattaagcaaggaattgcaaatactgaaaaattaataagggggccagctggcaggacaggtaccaaggagaaggcaaaactcctacaggccaggtctgggccagcacttcctcatggaggaaacaaggcccctctttaactagtgctagactgtgaggctcagtgaattgatgtcattattatccccctagggctaatttgcacctacataatggttttctcctaacaagaggtagcctttgttgaaaaccaaagggtttcccggatgaatgcctcatgtgacgaagagtcataagatgaagtttctaatcccagatccactcttgactcaacggatgacatagggaaactcatcagttcctctttgtctaagttacatgagtaccctggatacatttgctcagcatcccaaggcttctgattccctgacagtgaactttatcaaagatttctgttagaagagcttctttataaggtgttttgggctctgattcctctggctggactgcagaaggttggcacaaatggaagcataatgtacagagagagcctgggtctaagctcagagaaatttgactaagcacctttctctactaagggccaaattctgttatgcttatgacagcaaatctcccaaggaaattgccaagaggtcatcctatgttgtattcatagtggcagagggagaaagcatggcttttggaaggaaaaacttaggagctagtaagcatggcttaaaacatgttgggaaggacgaaaggccagaaaggccctgctttgggttgcagggtaccccttccatggacaggactcagtcccagagatggggagaactgaaggttgccagagactctgacaaggggaagaagaaggcattgccccttgctggaggtggagtaggggaagccagcaatttacagggttatcttctggcttatcatcctcgctaaatcacttcctgtttttctccccattccatgacctcatgtgtctggtttgaacctaaaaagtgaaggaggtcagaaaaaaatctttctggggtctgtttctcccagtgccaaactgtcagagaggctctgttgggattaagcctcatccacttaaccttgtcattaattctctgttcctccccccatttctcccccactccccatttctctctctttctctctctcattaatttttgtatttagaaagactcatctggttttctcagcctctcactcttcaaggtatttttgacatttcccctggccatttgcatttgccataaatgggcttcccctccccactgccttgttttactttcttgtgaaaggaacaattaatctaattgaagtcctggaagttctgtcttgttccggctctccctctctcttccatactgcattttcgttccaagggagctcctgggtttggaaagcactcactctccaaggaaattagcctgctttctccttttattttgggtgcatgcttcaaattggatttggctctgcaggcccataaggtggatacttcccaaaagaaaactgcctgggctggtcttccgatcacagagcacagcagcaatgccccagcaaaaaggggaactgagcaagaaagtcaggagaagcagccaactcagctgtggagacagagcagtggtcagcacacccaacctcgtgtttgcccgggttcttcctacgtgcagggttaactgcaaagattgccccaaagcctggaaacagggccctgatatgaaagaatttatcctgggctgtggcccctgggcccttggctccctgtataccttgaactctacatcccaaaggttgagacggttgctgagtaaaccccagatagaccttttcccctaaccgttgcttattaactttgttccattgaagcttgctgtctgcttggaaaatttcactcacaagccgcagctttgcctgactcagtgcaatccaaggccaycatctctggtgaacttcccttgactcctccctccagccacttgcagaaatgcaaatcctgggcacccacaggctgtttgggggcctgtatagaagctgtgggcagaaaccagaggccactgtggtactgctggactcctgcagccaaaggacaaaagggcgagactacgggccgtctgggcaaacagagagaagccactttattccctgtggagtggaggatgctaggatgttgctgctccrgcagacagaggcctttcgcttgagtcatcagccaacagactgaatgttatggttttagaaacccatacacaaagttgagtggttttttccatttctaaaatttaaaatgtatgtatttttaaaacacccacctgcatgtaatacacagcttgttcaggagttctcaaacagccccagcacccaccccatcccagaggctcaaccaaataaaaccaaaaccaggaggctgggtccttttaagcactggtaatttctacctgtaattccagccctttgggaggccgaggcaggcaggtcacctgaggtcaggagttcgagaccagcctggtcaacatggtgaaaccccgtctctactaaaaatacaaaaaaaattagccaagcttggtggtgcgtgcctgtaatctcagctactctggaggctgaggcaggagaatcacttgaacctgggaggcagaggctgcagtgagctgagattgtgccactgcactccggcctgggtgaaagagtgagactctgtctcaaaaaaaaaaaaaaaaagaattggtaatttctagatgggtaccttgatgggtctcagaaagagcaaaacccactagcaagaaatgaaagaacatttcttaggctaaaatcctcaaggaagtctacataaatgattgtatgtgctatgttcagcccagcaatrtctcatataccacgtatcattgaagaatgacattccatttaggtgaagtgtccagatactgaaatatccacctttaaagttcttaaaagagaactttaaagagttccaagagttcttttttaaaggatttctgataaagaacattctaaatcatgtgctgcacttccctgtctttttaaaacctacattgagaggagtcaactttttctcaatgattcaggcttttaattctaagcttcacttttgtgacagcagccagtattgccataattggaacaggcagattaagatttgaatttttattgaccttttaaacttcccaggcctcagtttcctcatctgcaaagctgtcataataataaatatcttgcaagattgctctgcctttttatgtagatgcccaataagttagcaactgtgttagcatcattggactttgtcaggggacagtttgggactattttctatcaatcctcctgctttcacacatcctgttacgagtatgcctgtctcctgtagccttcccattctgacttgtttttgcttttttatggggttatcaattttgcttcaggagcccttgctgtctcttgggaagtttgagttctgggacctaagctttgctcaagccagtgcaatcccaaggccagcatttccagttggcttcagccagccaagcttgcagcagagttaggactggggagtgatccccaagtgacaaagcgtaagagcaacagaggatggagttctcaacatcagtgtagctgctcacaatctttttttctgaactcccccacaccgttatattctgcatatttaaggttttggatatttgcctctaagtgtcctagataaacaaggtgctcttgtgtttatttacagccagaggggccctctatatcttagaagatatgtctgtttctcccaaagtaagagatgatatcttagaaaggtagcagtttcccagttgataacctgatcatagtaaacagagagatcagaccagaccttagtcatctggcccctccccattcagccagcagtgtttccctgtgctcagtaaacaccctcgattccctgcaaacaaccaagcatagtcttgcatctgcatgagccccctgagttcccagggctccagccctcctttccctccctccacagtgtccagctgcaagctcccatcttcctcccctgagtttccttgcttcctgcagttcccttttatcaccctttcctctgaactcccagagcacttgatgttgcctgagtcccttgctttttgttcatatgtggtcatcttgagttctcagcaagtaaattctacaagggcacaaagcatgtacttcatatctaaactcccatggcgcctagtctaggagggtgctaggcaggtgtgtgcaggtgatttcgtgatattttttacattggaaatgccaggcaataggtcagcatgagctgaatctgtgttggaaggcagacagatctgtgttccctatttgtccctctgggaatatgacataatcttagggggtaggacacaggccaagaatgtcactaactgatttgggacatgagtctctcaccaacaaaatggtaatagaccattcattcattcatcaggaaatagctattaaacacctactatgtgctaagcacgttggtattattgggaatacagtgatgaataaatcatattcttttccctaaagtcactgttactctttccattttacagatgaagaaacttgggctcaaagaagttaagcaactggcccaaggttctactcccataagtggcagagaagggttttgaagccagataccctagttttcaatctctgctttactcttgtgctgtctgcctccccggcatcatgcatttggcaggggacatgatatggacctgttacgtgggcccacagcatccaggtccagcctaagctgggaagatcaaggaaggctccctggaggaggtgacgcctatackaattctaaagaatttggccaggcagcagggagtgtgtttggctggtgtcataggcagacagcagcatgcccaaagacaagaaggagggagggtttgatgccttcaggaaccaaaataattgaacatgcctgaacccaatttcttaaccagtgagcattgtaagggtagactaaaaggggctgtccttgtgacttgctgacacaaacccttttcccggtgaagaggtgcctgagcaatactatttaattgtatttcctggccagacaacttccaccatctccttaggagacagggtggtcaggaagcaggaaagactaagatgatggggactctctgctgtccccaccttccctgtccattgtagggtctctgcagcctcataccctatgtccagcgacctcccccaccccgccgccagtggaatgcctgaaagtggggtttggcctgggaaagtccaggtaacacttcagattaagctcctcttgtcaatttcctgctacacaagactttctgaatccaagtctctttcctatgaatagagggcgggaggccagattgcccagttggaggtgtggcttcagctggtctccgttgaagtctgaaaagccaacaaagcatagtgagaattctgtgtggttcaagagggtgccttgtgcttgttgaggagaggccgttggcttgatcactcacgacactattactgacgttattatttactgcctgcccaaccacagaaatattctgattcccctaaggagccagtgagcagtaataattttctgtattgcaacaatcctcctaatgacagaaacagatccacctccaggtacgtggtggacgaatgggagcagctggctgctggccccacacttaccaaccttgaccacagggtccacccagcaactccacctcacccatggatcrgggggaaaaacaactcacagactgttctcctcttaccaaggttaaaacgcagctggaattactttgggcagtttgtttttaaaaatgagtgttgcaattgtaactgtctcaatgcaagcttcgctgtagatgcccttcttaacaatatgctttatcttctgactgagaaaatcacttgagatgttatcatgcmcaatcccacttgttctgcctctccaccctggcaccttctccgaacccagagatcccagagggccagcatctcaccccatgtaactccatgtaattctcccatctaattacaccggctgagagtctgtcttaagaaattcagtgggagctccaggtgtggaggggataaagaagagatggaaatataccaagtgaaaacatcagatttttctaaaaagggatttgtgtattttcctggagtcatgagtcctatagaaaaaaatttatattctttttgttttgtcctttttactggcaagggatttaagcctttggattaagagaaactcaaaagataatttaattccattcttatacttctgcctggataaataattccagaaaaaaaaaaaaaaagatatcagctgcccttgtctttccttccagaaaagagcttctgtaatcgtccttcattatgggacatcgtgcctcacaactcatctcagttgattgcagagtagatggttgtatttaatttacataatcaaaatttttttcctagaaggagaatccctgaaaaatgttagctgggtcaaaataaaattttctaaaaagaagaaggaaaaggaaaaggagaaagaaatgtgagttgggcttaggtttgggagggcagcagaaaagcatgactttttttatgcctcttttcgagctttgtagccaagcatcttggcagtctctaatatttttctactttttcccactggggactcaactgtatgtttgtgggtcaygtggaggaactctcaaaattagacaacaatagcaaacatttattgaactcttgccagacatcaggtcctaccctaagttttctatgtttaaccgccacagctggtactggtactactattatcccatttaacagatgkagatactgaggccctgagagatcacacagatagtaatcgtggggctgggtttgaagccaggcagcccaaagctgcctttgtatacctgtgtcaatctgcttggagctgtcatctgctgtcccagtgcttaggtatttggggcctctctgatttctttagatatccttgacaagccttttcttttccttttctctttttattccttttctttgcctcttcctgccatgcagtcacctccggatgccagcggggcagtcaaggagagagatctctttctgtgtctttaaatacaagccagaggcctctcagtccatcgtctctctctgcctccctgtcacctacctcctactcccccaatccccccacagccccgctcaccatcctcttcaaattccctgccatcctcaccaccaccttcactctccatctggagtccaaagatgtgagggccagtaatagagtgtcagcggaagtaattgattcctcacaccgagagaattcgcctgcctttagtgtcaatggagctgaaccagagtcttggagggtgagcgagacatgtaaacagtccgtggccgagctgtcaggacgaagccagacacaccggagagtgaacgaggggggaaatggtggaacaaataattgttttattggaaaggaaaggaataaataatatttcagcccaggaactggcagtttgaaagrgatggttgagagcttggagcagaaggattcgtgatgcaggttttaatggaagagattttctttgtctcaaagtaggaggtttcgtccccacccgacccccctctcccattatcatcattattatcattaaaataattactgtaacaattacagttgatgagacctcaggtttatacagcacctttcatctaaaagttcaaagcgatttatctatgtgtcatcttttgagagtggtaggagggtaagaaactattattttggggggtcatctgctgggaaactgaggtccaagcagatacaagatttagtccaagcctcagggcaggctgctgggttaaatggtggggtactgagttatcttcttgggggccttttctgctgtactcttcactgcctgggcctttatacacacgtggctcttgaagctcatccccggcactgatgcctcctcccacactgccagggcctccactggtcgctacaatattgtggccaaccagccagaagctctgtgcgcaaaacaaacagcctgcttctggctgtgagatgaataaagatccttcaaggtctgactcacacagctcccatcctgcttagagacttcctgtaatctggttccctttcttgtagaagctcatgtcctttctaaacatctttcttcatggtcttatgaggctctagccaggagcacccaacattcctaaatgcttgcttcttccacccccaacaaaccccaacctgttctctcagaatggaaagggcatttctgggatggggagagaaggtgaatgctttaacatgcctcacatggcccgggctgcctgtgcagcatgatgcttcagaatgcagctgtcgaaagcatagtcacaaacggaagcggttccagctgactggcccctgagtgctagattcagaatctccgccctggcgtggcagcagccctttcctgcttggacattagtgcakgcccatcatttccacaccatggtgttttttgcacagtagtgacaagtttgcccctggagccaggagaagctccaagctctgtaatctgaagctccaagtaaatgaactctaaaagggaggcccatcacacctgccacctactcccaaactgtcccctacttggatttctgcatggcacgtttttcagatgagttttgcatcttccaagttttgttagggaggctggatgccagcaaagaggaatagaaaaatgatatggagcctaaatccctggaaaaacaaaaaggacttttctgttgctgtggtggattccctggtgcccagtacacttccgttcccagcaggctcccgttttttggacagacggggaagttatgatttgccctcacaattggatcccctgggagccagaattagtgtgaacacctattcsggagggaactgttcaccctgccgagtaaaggggcactgccagcacaccaggggccccagacgctgtgctctgattgcccttcagtgaccacccrtgcaggcagccccaccgggcacaaaggcatgattcctgttcccttttgtcaaatgaggccaactgaggcacacaagcatgattgatccaggccagcgtaggaaaatttagtaagtcctggccctgctgggattcacctttacacctgctagtgctgctgctgccgctgagaaaaacagaaatggaaagaaattgtggactactcttcctttgcactctggtatcattccagaatgctaccaaggggccctttaagttgactgcagagggtgaggattttatagacacagagcagaccaacgaaagacccaacactcatgctgaaagcagcctgcccccaaagccttaaacttcacattggcaccggttgcctagaaaaccattccttacataagcaaacatgtttcatccaagtggcctccagtgtgtgtgctggtccagaagcagagcagacccgtgaccacacggcctcaggaatgcgccttgctggccagccaggtcagcgagggaaatggtattcacccaaaggaccagtgcagaagttggggaggctttgttgcgtgcccttaattctctgaaagttcaccttcagagagacttatcagaygcgttgtctggagtggcctccttcctcacgtcaggaggcattcttggcagcctgctccatgaggaacaatgagattggcggggccctcaccatcatcgcagggcctttgcggaaaaagagccagcaattataaatagatgttatttgtcgtttccattttcttgccttcaaggttttttggaataattccttcagtttgttttgggttattctctccgtgtacttcctttggtgggtggtcagacttcctcctttctgaagagccatggtgaccctggttgtgaggggattgtggataagaagctcaaaatatcagcgatttgtggtgggaagaaatgaaggaagaaaatacaactgcaaacagccactattaaaaaggcgcttggtactgatgcagatacmcaaacaaatacagagtttggtaactgtttgagcccttggcgttaaatagcaaacaagaataacagcagcagtaacaacaaatggctattcatggagcatgtactgtgtgccatacactgtgctgacccattgatatgcattaactcaccagcctcttgggagcttgagcaccttgctatctaagacagcagatggaggacgggtggttttgaacatagcctgggctcagaaacacaagtttgaaataaaatctcgaaaactcaagtgtctgaaacactgttgatggatttgtgcagggggatgattttttagaaacccagccccaagaagcagggtattgagactgcctctaactgtgcttttcgtttcatcttctcctgtctggctcccaaggtgtcatgtgtgtgtaactcttctcttctccacatccaccatcctgttttgttttatgctggtaataataaaaatagccaggggctctcaggtgcttccttaaggcatctggcactgtgctgggcctgcatgtaccttcgcaatcctgccaccacccgcaaaggtggagactgttattatgtccattttgtagatgatgaaactgaaactcagagaggttaaataccttgtctgtaatcacaccatgagcaagtgccagaaagtaactgggtctgtccacaaagcccacatgctacacttcccaggttacacaacaccctcttaggtatgtttccgttaacagtaatttaacgtttcttttgtcacagaccttttccctagaaaaatgtgcctactcacaaacacaaaatttcggcaaacaaagatagagcttccccaacccacttacacttgtgtgtaggccctaggagaaatccccgcatttaagaatatgtgctctagatgataacttaagagcttataaatatatgggatgctgctttctcactccatgggccatatgttcacatatggatatatatgtgcttataaaaatactccacttacaaaaattaatatgttatcccatctgaactcttacaagctagatttctgctgggtgagtcttgaaatcatggattccaaatccgctcacttttcctgttggtgatttgtctattaattttggtaagtccttcagccttgtttaaacagaacaactcaaaagagcaagattctgttaagtctcttacatatcttacacccattttgtggaaacctaactgaggccctaaggattctttacacctggtacctgctaatgctattgtgctatggcaatccggtattttcattgccctcagatcttcctcccacaaggagacaaagggaggaagggaaggtctctgtgccctggagtttgactacttgggttcaatgcctgtctctgacctttcctcctcatgtaaccttgggcaggtcacttaactgctctgagcctcgatgtctgcatctgcaaatggatggtaattgtaacagggcctggtttggatgaaatgaggattaaatgaaataatatctgaatcaatggcctggcccatagtaaatgctcaataaaatgtgaacagtttgcagatataccagctttttagtaaatgggtggtacagatgcaaggcagaaattcaargaaatgaaatttactttaaaaagtctgacctgacagtgagctgacttctccataaaggctaggtgactgtactgagcctaaggagcaggtggcctggcttcaggcctgaaccraccagagacctcagcattgtgcagatctgccttgcrgcctttttagacatcgtgcagcttctttgttgggaagttgtatgtgacagtgctgttttttttcctcctaatttcctcacaggttttaatgtaaggattaataagacagtgtttgtagatgtctttgagcctcctggaagaaaggcactccaggaggtgataaattctctggcctggataatctactcatgaaatatggaactttgaaagtgtgagaaaaatctcaaatcactttgacagcattttaattatagttgatttgtttgccgctaatagtgaaaatgctgtcagcatgatttgagatgtttcttccactcaaaatgttatatttcatgtttttgagtcacaaggcaacattttggttttcagatacaaccagaatagctcagtaaatgtgttggggcacaaagacagagagtataaaatggatcaaactccacggaaagcatcatcgtagcacgcattcttctcaacatggaacaccagcctgaagtcccttattcatttacatttatttactcaacaaaaagtgaatgagacctcctacatgccaggcaccagggaagtgtcgtaaattcagcagtgaagaggcaaggtccttgccttcatggtgcttattgtctggtgcaggagacagatcataaacaaataggtatattgacaagacctttccagattataatcatagctatgaaagaagtaagatgatggtgagatagagaataagggcatgccatctgaaatagggtggtgacagcaggcttctctgtggaggtaamatttgtccttaagcctgaaggatgagcaacaaccagccctggaaagcaccaatgaggagtactgcaggcagaggaaagagcgcttgcaaaggccctggggttggaaagagctcaccatatacaaaatgtcttcaacatcttatgatcttatgatgagcagtgtgaaaggaggccttgcttggttggcaaaggttatgatgtcaggacttgggcagagatgttctgatacgtagacccaaaagaaggggcagagtattcttcctccgaagacctaagtactctatcttcgatacagaaatccccttccaagtggttctgtgtggcatccctaaagckggattctgacaagggccagacatttcggtgccctgagagaaggacctaagcttggtgaatcttccagcacaggctccgttgactaacccagcctttggtgccctgctgggaagtgtcaagcgtggagacagttatggaaactagaaagccctttttcatgtttgcctagtgatgagaggaagagatgagattgttgctttttcatatctctcccgtggactcttaaaattaacttcactgtcaaaatttcccatggcccaaatgtaggtttggggagagaaatgtaagactttgaagttgagaaasaaagtagagaaagcattctctagacaaatgctcaccatgcagacttcagaatctgtgaggagacaaataaaaaggcactcggggaaccgttttagagagaaaataaagaactgggagtagagatggctacttcagctcaggaaaaaaataaataaaacaatacaaggtagtgttaaagctttgaaaggaatttttcgtttaggagagattatggataatgaaatgcaaacactctagttaatatgtctgttagctggtttatgttgccttctggaaaacgagtgatacrttctaagaggagcagcttttcaagttatcctacttgactatcgttggggtgagctctgagtctgtaccccggattcctttaccaaacactggatattagacactagatgcaaagccgtatttattccaaagccagaaacttcctaagcctctgcctaactcttcacaaatgaacctgacaacactgaaatttctaaggagatttactccagctgtagcaaatccctcataataaaaaatttccccaaatgagtcagtcacacaggaggtaaatgagacattctgtatgaagtcagcrtgtcatttggagtgtgccctttatataaaaggcccagccagaagaccatgtggttaagtggggcttgtccacagggcagaaccagaagactggaagttggggggatttcagctgccsaactgtaactctgtgtcacttcccctcaagcaaaccttatagaaaaatcyagtttttctaagaagttcaagtaaggtttgttgattatttgcttcacaaaaggattcagcagaggggtcctttaactaacaagctcagagaaaaaatttatagtatgattgaattatatgaagctttttcaaaaatgcatcccttctctatatgtgtgttagatacataaggatgtatttgttgcaggcagcattacaagaagggatttggggtggtctgtatccgttgagtaaattgaggcaagcttgtaacagtggcatttgttgggcagccctgcttcattgctgattctgttaatcccctaaatgactccatgggtgattaggcaaccagataaaaccctctcacttctgatgaacaagccagtgggatggcagggcctctctttgtccttcctagagaaattggcaacacaaagactggaactatctggtgaagctttaaaaaaaaagtttaaaaaattatttattgaatgtgggtcatgtccttggcactgttccagatgtcccgacctactgtgtctcatttattcctcactccagttctgtgacatggatgatgatggtgatgatgatgaacttccttctacatctgctaaatcatgacagctggattcttttacaaagaagagagaaaaaattaccaattatcctaccacccatgtctgtcgccattgttcatattttagtagtctttcagacttcctctgtatgtttatgtgaggaaatgtatgtataccttttaaaacatacttttaaaaaatctcctttttaaaaagttaacagtatagcgtgaacatttttccataaaaacaaaaaattctagacctgcagactattgattgtagcaggagagtattccattttataaatatcccagatggattcaccctccctmtacggttgggctttgaaaccatttataagcaaaatatcctcccactttttatattttttcaaaatatatgcacaaagatgcatatgcatctttgcacaattgtctgattattttcttaggaaaaattcctagcagtaggattgctggattaaaggctatgtacatattaacttctgtcacatttcaccaaaatgcctttcagaatgtttgaacagatttccattcccgctgatactacacctctgctcatttgttccatttctgaaaacagggtcgcttctgctctgtggctcagcctccttgcctgtgaaatgggtgtgaaaatacaacaaatcacagttcacatttacttagcactcactgagtgccagactatggactaacactttagatagattagattttgtcatttaagtcccacatcaaccctaggagaagactgtaatatccctactttactctttttctccccatttctgaggctcagaaaggttcagtaacttgcctgaggtcacccagctaaaaagtggccaagctggggtgcaagcccagctctgtctgcttctgggattgggactcttgcgctctgggccatgcatttcttagtccagatgagttgtctgattaatgaacatgggtagcagagcctctcaacctttgtgcacattgccagggcatcaccattgctcacaggaatgtgtctgtccagcagtgcttgccttagtgtgaaaatagcacggaggggttttctggaaggtttgggagtttcccctgagaacaaatgaagcgtctttttacttttgttttggaaatgaggaagcatgttttcaaagtcagcaccatctcccacactgaaaycacagacctaaacagattccccaacctcacggycttctcaatctgtgaccatctctccatttctccctgggggttgaaactgccattttgacttctccagactctaaggagcttcagcggttctttttggactgtgggagtccagccctgtggggtctaagaatgaattaatcctggcccactccttagacttcctttacaggcctattatttgaaagtggctaagtaacatagctcctgggggctgaagtgaggcctcaggcctccccagctcacaccagccactccttccggcagccggcaaccccagatccttgtatgtgacaggatcctttggcaggcacatcccacagaagggtgcattcccagccctctccttacccgcaaggaagagatttcttaagtgttgctttaacaggttgatgcaaaataaataaacagaaagggagggagagggagatggatggttttcagtaaataatggtgcagcrgccagcagttggaagggagctggtgggaggaagtttcccacctaagcagttgtgacaggagtattaactgggagcccaaaagcagcacaaacgcagcacagtgaggactgccagagcacataccggggctggaaaatgtgtgtctgtcaagataaaatggtgcattatgtttgcaccttcccatgaacggagccaagggtatctttgaggtgcctgcttcccagccctggccagtttgactctgcttcaaatgagcacaggcctccacttcaggagggcagcctgccctgcctctcactgaggctaatagttgtgtgcacgtagacrgtgggcccctggagactcacccctgcttttggagaaaggtttttatcgccttatctaacatgaggctgattccttttaagaacacatgttgactagacactgctgatgggaacctcgcagagtcatcttagggaggcggtggcccacgggtggggagtctttgtcactaacaattaaagaagggatggcccaggggaaaattgaaacagggggctggagggagatgggaaaataaacaaatgtctctgaaacatcccccgtgtgcctggcacagtgcctagccccttacatatatattttttttymttctatcttctccccagccttgtggagtggatatttttatcctcatcttacagatgaagaaattgatgctcaaaggggttcagcagcttgcaatgtcacagagctaagaaggagagactaagattctgagagagcataatggaaataaaaatggtgctattgaaggaagaaaaaaatgtgttttgtgatatttgatagaacgatgctcctgctcttacgtgggcaagagataaggccttccagccatgtgtttatkcactctgtggctttcacaaagcacaacgacctgcagtatctctgtttgccagtctgtacaagcagacataagtgcccttcgcttatccatctgaaacaccttaacttctgcaaatgaatagagagacataagtgggagcgacacagtggtccttctcatgtccttsgagtgatcttttcttgtctgtgccatccccacccaggtatgactttatcgagattcgggatggggacagtgaatccgcagacctcctgggcaaacactgtgggaacatcgccccgcccaccatcatctcctcgggctccatgctctacatcargttcacctccgactaygcccggcagggggcaggcttctctctgcgctacgagatcttcaagacaggtcagtgtggtcacacgtaggggccgggagatgggcgtcttagagaagaaggagggacagcacccagtgggctgaggcactgggtaagggtgacagtgtcatccagcttgagcatggtgagaggttcaaggtgaacccacaaacatcatgagaagaagagccagctcagattatccaccagcttaagggggcgggctgtgggcgggggggtgggggtggggtcaaaacagccattgtttgtggtattagacaaacagaaaaacacttcttgaaagaattggatttttgtrtgttttttaaaatcaaaataatcttcatgggaaaaagcaaaactctgatgactttctcacgattacttcatggtctaatgatgtctttatttggaactacatggggctgaggacataatcttttcattgtttggagtctctaaagatcttgccatgacctcccaaatggggtcacaccatagcttttaaattaaaataaggttcctagaaattccccttggcagtccatgttaccacctctgtccattgaacccctactctctaaatgccaatgaacttgactccctgaaaagcaatcaaaaaatagcagaaaaagagtcagagggcactgcacttgctttaagttgactgcttgatttccatcaggtcccccttagattactttagggcctgagaatatgggccagtgctcatttccaaaactaaatacagcagacttttattcacaagaccccgcttcatcagctacactcaagctctcccagtggtgtgtcctcttctgtgatgtgtggagcttgttatctcgaggctaagggaagcatgtcctccagtcctccccacccaccacccactcccttcctcagaggctccccttccatctatgtgtgtgtctcccctctccccccagcagcccaagttttacaactcgtggatggagtctggttcgaggggaggttgtcagccttgtcatcaagaggcccaagaccggcgcctgttgagttcagtgtgaggggaactattcatatatattttctttttcactaaacagctcttgaaaggaagtggtagctgctgaaagcactttttatatccactctgtctaaatatttgtcggatttgtctgcccgagaacaagaacgtggaatcaaatgaaggggtggggcaaggggactgtgtcatgcaagagtggcagcccaggctgctgcagggcacaggtcccaagaaggtttctctgccttgggttttcatgctcctgactatgatgaggtcacaggggctgacaatctgtgtgtccagtggctcaagctgttgtgaggcccctgaatagcttgatccatattcccctgagtcttgtgcaaaattcagatcaatgccaccagcaccagtggagcatcctctgctgccgagcagtggggagaataaaagagaaagaaataaaaggggatgcttgctctcttcgggttggagaggcaggtgtgcaaaccctttgcacgtaacagattcgcaggtgatgttattggatgagtatgtatgtaaattgaaaggaaaactatgatatgaggcagaatgaataagtgcaaagtaaaggtacaattgacatgtggtggttatgaaaatgggggagcagtcaagtggcttagcaatcgaggggctccagagaatctattcaatagcaaggtccctagtgctaatgctgccactcggctgcactgtgctggccatgaaaggaaaacagctccaagcaagatcttccaggaagctggccaagggaagtcagaacaagggtgagcagggccatgaaaactcagccttggtctcacaccacccaacttagtatttcacaaggcatcatgctacattctccagaaagccacaggaaaagtcaatgttcactctatccatcatgcaaatttgaaaggaggatattaaaagataaaacatgtaagagggtatcataattcaatatcgctgtcttgaggacatgctgaagcaggatttcaaatgaagcaacaagtctgtgaactgcctagaaacaatggtgccagccaacggagctaggtggcttcagcttggagaaatggggtggcctgctttaaggattggggttgcctagtgaagagattgtaagagaaagccctgccaacaacagccacactcctggcaatgtaagagagcagatgagagcccatagacttctcagggccactcgtacctgccgtcatacccacctgctgctggaagagcaactgtccgcatgacagtcagtcttatatatgccgggcgcagtggctcacacctgtaatcccagcactttgggaggttgtggcaggcggatcacctgaggtcaggagtttgacaccagcctggccaacatggcgaaacctggtctctactgaaaatacaaaacttagccgggcatggtggcacgtgcctgtaatcccagctacttgggaggctgaggcaggagaatcacttgaacccagaaggaggaggtggcagtgagccgagatcatgccattgcactccagcctggacgacaagagcgaaattccatctcaaaaaaaaaaaaaaagtcaaccttgtataaagtgcagaaatgtgcaagggagcaaaattcaaaacagagaagtttagaaaaatgagcattcatgcaggtgccttgtcctatacccacatttccattgttggagtcaggagagaaaatatacaaagtttacgtcatccacagaacatgaaagaaatgggtggacatgctgaagaaatccaaacaaacacagctatgtttgctagtcggattcatagagaggaagaagcgggggaaactgtaaacacagatacgcaratagccatacagagggctctagaagccttcgatggtacattaccctggtgaggctctgctgtaggacccacagtgtgagtgcagaccagggcatgtggctggcgtggaaggttcatgtctgccctaagtgaagtggtgtataaaagattctatatgttaccagactgtctacatttaaaagggtaagccagaacaacttacatacttaaaagatctcaaatcaagataccatgagcagaacagaaacaaaaaaaaaaaaaaggaatttttaaacgtaaaatgtcacattgaaaacaaaatcagtggaaaatgtgtgtgtgtgtgtgtttggttttttccagaagctcctttaaccataagttcaagattaggttttctttcctgtttgcctgtgacacttcagaaactgacatttttggggtcattcacagaggtagagaaaactyggagtgcctactgcctccacttcctgaattcaggaactgaattcaccttctgcggggaaggcaaactcagctttgggtaaatccactgtgttttaaatgtcttgatacctatagattcttctacttgcagagttattgtaaaattcacagcggaaaaacagagtggacatttttcatagcagagtcttttcctatgaaatcattcgctgcaacccaaatcccccagcttctgtagacaatcttagccttgagtgggcttgagtatttgttgacttgagttcttcgtttaacctttaaaccttctaacacatctcagaaaaggatcttggataaggcagatgtctgcaagagccagccagcttctgcctccttttctgagatctcttcctggcatctgctattcagctgcttttgtgatgctgcaaacagtgagatggtacgattagagatgaatgcatgatgttaacagacaggttttatttttctgcataaaaatagataaaactggacaaaagtttttccaccgccttcaaaataagccaaaggatatacccatttatagccatatatcagaaatgcttttttctttctttttttttttttttttttttgccttaagtacctaaggttgaagtttcttttcagtcaaatgcaggagctcaggaccctgggaactatggatactttcaaatttcacattctccaagcctctcttagactcactagatgtccatcgtggaagcacttgtgccctaccaatgacaggaaccaaagaaagattccgccagaaaattccccactcccaggggggtggacattccccttgccttctaagggaatgacaatagagcaagctctaagagggcatgtcaggatgctctttctagctctcaagcaagaagtgaatagagagttaatttcctcacaaccatgtgtgaggctcagctgagtggcccgcatgaagaatgctgcacagcagccataaactctaaccttttcaaaattcctcttggccccctgaagacccgccagctggcttggctttgctgaattgcctcatcccgggccattgaggaggccctcaggagtcygaagcccaatcataaacaaagctgggggaggcagccccagctcatccctccaggactagctgcccattgaaaactcggcctgacctgctgctgccatgcatatgaatgatggggtgcagagcctctgagattcgctgcttagagcctccacagaacccatgcaaaggttagcccttgccctcgtgtgttcctagtccctaccctgccaaagcacagcacaaggtggaaagtaggaagtgatggatggataggtaggagatactggaattttctgtctggtgctgaagaaagttgcaactcctccatccgcatttatttgcatggcacttcttccaaatcagacatttgcctctttccagaatgctgtcatcaataaagagactcaatgagaggccccctacaggagctgcggataaaggcatcgctgcaggctcagatcagtgtattgacatcaccyagttatatttcagtgtgagccccagaggacacttcctgacagtaaacacccagtttatcgagtatttctggttggttgtgttttttatgcttasagtgtctattatcctcctcaaaaatcctgcttccttttcttcttttaaaatctgaacataacgagtgaaatcaattctaattgtccagcactttcattcattgcgtgaatgtgcatgagctcgtgcttcgtgggtccatgggtctgggttgcagtgctcccgggacccatctgtggtgctgccctggcaaatggtggctggttaaagcacaaggacccttttaatatgactccacctagaggcattaagagatagggtggctgtaatcctcttatgagctcctgttcctgctcctgctgccatccaagctcgcaccaggatgcgaatgtgtgccgcatttaatcaggatgcctccatgcgtcccaagaaagcaracgcaagagctcaggagagaaacaaggccatccacaccacaaaggagccagaagmcttccaaatgtcaatgcactgctgcatttttccaaacttgttgccggagcggcctttaacatccccaacggcctgctgtgatccaccagctaaaaacatcgattgttaattgtccgaccactacagagcagctcgttttaatatagtcatgacatgaatgagacccaagctcccctttgcccctcccctgaggcaccttggatcttggagggagaagggggcacttcgttggctgtggtacaataggggctagtgttgaggtcagcaacaaataaggggtaacattgttttccctgctggcaatcagcaaggcttccttaaggattgaaataacttacatttctggagtgagcagctgagtaattgagaaagaagactctgttcctcttttcaagagaatccctctctctctctctctctctctctctacacacacacacacacacacacacacacacacacacacacttctctgtacctccaccccactccccaattcctcaattgctgctctcactctaataattatgtagagcaagccagctgtgcctccctaatttatgagggcttgaaacgtgcatgtgaagagtatgttgcttcaagggccactccagtagcaacaaaaacctcaagagcagggggatttggggccaaacatttaaataacccatgtgacagaggccacaaagaaaggcatcttcttcttagtgctacagttctcttttacatacaggctctgaagattgctcaaaaaacttcacaagccccaacsggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatggtgagtgatgtcatgargcattcctcagtagcttggcctttgcctgttaattgctttagtgatgataaagaggaagaacaaagacttcaaagctcctatgagttcttatatgacccatggtgactttctcttcttccccttcactaaggatagcttgagagaaattacaggaaggctgtctactttcttggaaatatttctttagaaaaggataggagactaaatagatacttggaaargatgagaaaacttaaagtgttcatttctactccaaattgtcaggatagaaggtggctcagtggctaacccctgtgacaaaacagaaggactccagagccagactggccgggcttaactcccggctctgctactccccagctgtgcaaccttagacaaatcccttaccctatctgtgccttatctgtgttaagttagctgctatcatcatcattattactataattttaaaattgtyattaatatagtcataaatattgaaaaggtacatcacccaaggctaacagccaccagtacttcgcaggtraagaccaacatggatcttgggtctaattagtattggagaggaacaaatctttcacttttgtagtcattgtaagttttttctaatataaaggagacttgatgactaagcaaaaagagcaatttcatttcctgggtaaakcacaagacttagtcagaaaacttgggttgtaggcccagctctgctatttcctagcagtaagaataaagaaatcacatgcgctctccaaacttcagtttcttcctctgtagaacagacattgtaatgatacctttccagctcatcttccaggccactgagaacagaatgaagccagtgaaagtggcctgtacctttttaatgaaaaagtgaaagtgctttttgatgtgcaggaaaaatattagccattgttcttgaaacatatctttggtttttatggcaagatgtacaaagtgtgctccrctgaatgaaatgcaatgaggggaagggaaaacggagtgaaaaccaagtttgacattttgatttccactgacttctctttgtcttgaatgtccagttggccccctgattggcaagtactgtgggaccaaaacaccctctgaacttcgttcatcgacrgggatcctctccctgacctttcacacggacatggcggtggccaaggatggcttctctgcgcgttactacctggtccaccaagagccactagagagtgagttggccgattgggaacctctgtcctgtccttccgtcagggctgtgagggtgtacaggtgaaggggggctgagctcttatgagggaggagatgggaactctacggaatttatggtggcatctgagtttagaggtgcccacatcctcttgccaggaagaggttgatgagaaaagaacacatttcaatctgggtgcttctttctttaaaaaatatatatatgtgtgtaacaagaattagttattttcagggaaagtcatggtaccatctcatacctcagtttcctcatctatgaatgaaagagaggctagttaggatgatctatacagggcccctcctgtgctaacatttttttagtctgtggccatttttttccctctcaaaatctcaggggcaattgtcacaaaagtgaaccattttaaacctctctttctctggattttttgacattaaccrtctctgggcctgggtaatgttttcctgactagattggtacaactgcttagacttggacttcacccttccaccaaagatagtttgtggagcttctagtatgtgccaggcaccaagcaaggaattaaaaactatcactctgatcacagctgctgtgggacctgcagtccctcagcactgagcaacatcttcaaatcagctgctcttggacatgtgtttcaaatatgctgccatttctacttaaaaacccaaacgataacttttttttttttttttttttttttttgagacagagtctctctctgttgcccaggctggagtgcagtggctcaatctcactcttcccagtgcaacctccacctcccgggtttaagcaattctcgtgtctcagcctcccgagtagctggaactacaggcatgcgccaccatgcccagctaatttttgtatttttagcagaggtggggtttcaccatgttggctagactggtctcgaactcctgscctcaagtgatctgcctgccttggcctccccaaatgctgggattataggtgtgagccaccatgtccagccccacataactttaaagactgaagaagcacttttaagaaagattcaagctgtggaaatcctaccctgattgcagacaactcaccatatatataactacagacacggcagcctggcctgcaggaaggttgctgggttttgcatttgttttttcatcaaagagcttctgaagattgagtgacaaagaaacagtatggcaaattgcaccaggtcccgtgaatggtcagtgcagtcacagagtaaagaataggttgatacctgataaggattgctggccgatcttagacacatgcacacacacatatcgatcagtgttgatggcattcatagaaggacagcaatgcaactgacagcacagggccagagtaagtgacttctgggtctatttgtccagacaggtggtgcgggggaatagagagtgacatgcatgtgctcatggagagatttcccaaagacaagtatttatgctttgtaatgtctgtcttctgtgccagaactcacaagacagttgagtgaaaaaagaaagaagcaaaagtgcctcctgggtgtttattaataaagcaggcttcccacgatgtatgagctcacccaaatcgccacgagtctatctcacatttacctgtattgcagtaatggtgcatctggcatctgtagcctgcagcaataacagttcttgtgctttagattgtatttttaatctgtatgatgattctcttatttatccatagcctgatttcttttaggtcccatttagtttctctcagacccagaggggttgtcaagctccatgacttgatgtagttgtttttaaaatgtgagcatataattagggtcttttaaatgaggaagtgcctgcaaggacttgtccctagaagggaggcagcatttgggggatcccgaggtatgaggttggaaggcctaactgcatttgaccgtctgctttccccagactttcagtgcaatgttcctctgggcatggagtctggccggattgctaaygaacagatcagtgcctcatctacctactctgatgggaggtggacccctcaacaaagccggctccatggtgatgacaatggctggacccccaacttggattccaacaaggagtatctccaggtacttgtgcagataccagaggatgtgagagtgtgtatgtattgctggggtaggagggtagctcctcaaatayagtaggcagaggacacaaagaaaataaacacagcatacctgagaactccattcattcattcatccaaacagatgtgtatgccaggcactgggttacatgctggcatacactgatcagagggagcctgcccctgcccttgtggggattactgggcctggggagaagttgtttggccaggatgctgtttgccctatcactatagatatccaaggaacattatataagctgtttggatcttcctcattcttggcacagggaggcatcagggacatggggggcattctcctaaggggaggtttgttgaggtgctagctgcacatgacagcttctcatgatctttgctattggagagagccctgccaggaaggttttgcacagagctatcagaagaacacataggaaaatgtcactaccaggaacagaactcaaggtgccccagatgctcggcagcatctcttcagaccattgtttgctttattctgaataaaccttgcagctcatgttgagtaatcttcccgcactgcacactgctccaattctcatcccctgggaagaagtaaacagggggaaagcaagctactagttccacaccagagcagtgactgcttttatgacacacgtaagacagccttgtgacccactgacaagcctgtcctagctctgaggcgacacagtgacctctgctctaagaaggatattgcaaagcagacaacaggaaagggagaaasaccacttagaaactccagggagtccacagaggttctaacagtaagccctggggccatttgtcattgtctcttctctctgcctctccaaaaatccatctcctcgcagcctgcaaaacttccagaaagttctgtataactggcatcccctatctttgaccttaatcatatactttcgcctattgctatccacctgtttctcatacgtgtagacagcactatgtactacttattcaaatgtttagtaatgctgagcacattgtaggtcaccaataagtgcttactgaattgaatttagccagtgtgtgctagctacattttggtcatatggagactgccattaagaaacaccatggccatcaaaggaatgacatccagcaatttccaaatgggtttggcattgtgggaggggaagtaccttaaaatgttggccatcctcctcatagagcaaaaggtcaggactcggtgcataagcctaattgcttgggcagactctacatgccctttgaccccttagtgacctgagcaactaaatacacaatggagcgagagggtgtggggaggggatgcctctatgagtgtgacttttggaactagggcattataagtgagttggattgaactggacaggagtagagtggagtagattcaaccttgtttctttaaagcagcatctgcttccacagtccaaggcaggccatcatttactaagaagggattatagctctagatgttcaatgattgagaaaaatcgagtattgtcccttcatatttgcaaaagagagaaaaaagaaaaataacctaacttttcaaggtgtctgatttagtgtaagataatgtgagtttaatcgtccaatggaattgcaaactgatactaattacaagtatgtctcagtgaatcacagatacaggttggaagcraagtctaaygattgtgtcctttggaaaaaaacaagacactgccctgtrttgggaatggtggtctcttactccagccctctattccccaggtggacctgcgctttttaaccatgctcacggccatcgcaacacagggagcgatttccagggaaacacagaatggctactaygtcaaatcctacaagctggaagtcagcactaatggagaggactggatggtgtaccggcatggcaaaaaccacaaggtaaatccatgatcctaccttaaaggcacattggaccagggcaggagggatgggatcaggggagctttaagccgacctcctacaggagagagggccttgtgtagtcaggctcagataattgatggaggcaagggtcgtgctggccttgaaaatcttctctcttaggctaaagcgattggaaaacaccgtttctctgacagccagttgctgttgcatcttgcgcagcagagagagagagcttgcagagtgttctctgacttcaaatgaaggagaaaatatgtccccagtccacttctccccacccaggattcactgaacatttatggcctgagtcccttccacatgctgggttaacaatcacaaaaccacatgatactatagttcaggagttaccgagctctggaaatgaaagggcacaaatcctgagagggaatcacaatgtcctggagaagaaaaaggacaataaataaygaggagaaattcagtttgttggggatgggctctgaactggcaatcatgcttagcggcgaggcattgaattctctctgctggtgcctcccgcatctgcggctcccggaggtgtggtctgtgtgggtgatgtggggcttttgttgtatacatatggatgaatgtctggcactccactttcttaagacatgacattctgggtctgcagctggcacaggcgatgtgctggctctatgtgtatatacacagcacactcagcccatgggggcttattgcaaacagccaggggcttgtgtgggtaggattggggtatctgtgatgggaacacagggcacgatgccccctgcagagcaggagctggtgcagaggtctggaaggagagtgtgatgtcygggggattcctaggggctgcctgtccttccctaaaaaggaggtagggagggaggaagagggtctctcctgtagcattacagttccaccaagccctggtctgtcagagtgtgaattatcaaaatggggcacatgtggccaagcctagggaggccaaagatcttttccaaagggaatctcctcagcccctgtcactgccccgaggcagcttgctctgactggtgcagctggaaacctcagacccagaaaattctgaactgtgatgttggcagtctcacttgggaaaygggaaaaggagtagatttttaaaaaatcaaaatcaccatagtaacggggtaccactcatctgaaaaccatggcttctggatattaccaggtatctcacacacatgcacacaattgcccgatttccacgataaggaaagtgaggtacktagcaattgaaagatgtgccaggccaggtctggtttcccactgacttggtttcagaaagacttaccaagcatccgttgkgaatgcccagcctgaattggcactgggtgccaggagcttgggggctgagacctggttccaccccacccttttcaattataaaccggtagatctcggaagctyagctagcagacgagggccagaagccaggcaggggtggtccccggggagaggagyggggctcacctgattgtctccctgtccaggcgcaatgactaagcagcacaggcccagagggatactgtagcataagctgttttaaaagcatgcagatggaccaggatgctatttaaaacatcatttgtaggaaatctgcttttggaaataccttagcactgcacattttcatagaatgctgtcctccctggctttatccctggtattcattcttcaggaaagatattcctgaaattgaatttagctttctggttttcagaattatttttctcaactttttcataatggatatattctctctcttttgcctcctctttccccacttggctagatttagttccccagcagccaaggggtaacttgagagtttttttgtttttgtttttgtttttgttttactgaattagtcgtgcccaaataaatggagttggggcagaggaaaagcccattctcttccccattagaaattcatcctttgtgtacttagaaggaggcaggaaaatggagagcctgccaattaggcatcgccccactctccaagctccttcaccccactgcgggtgtggtggacgcccaggggctttccttgtctcccctgcaaggatggtctcagctgccccttcattagcagatctttcgttcagatatctgtatttaatgtgcagattccccctcattcacggtgcgtcagcgcagctctctgggctgttggggttgaagtagttgagtgaaccgtgccaaatagatttgtcaagtctgccgcagtttgatttgatgccatggggggaggtgggggttggggagggacttgggggcagtggaggaagaggcttcgtccatgccgagtgccaccactgagtttctctttgtagctgctggatggtgggcactgtgccaagctaactggtgctaagtggtgggcttgaaagtgaaattcagacaacaggagttagcagaaaagcaaagcagagatgaaggcaaccgcctgctctgctctgctctgctcagagcagagggaaggtttgcaaatgccttcccggygtgcagggaaggaagagggaatagtgacatttgggacagaaatgtgggaactcgatttcaactccctggtcactgtcaacagcaatgcagcataccaaagaccagggaattggggaagtcagagaaaaacaagtttaatgagtgctcaaggtggcgggggagggctgtcctatgtctttgcaaaacactgtttacaatgtggacccagacggggctgaggcaaggcctaggcctctgaaagaatgccttcctttttactgccagtgggtgagaaagactaaggaactcttttccagcctcccctagccaggcagcagcctgttcttggtctcttcccatccaacaggtcatcatgaggtcgcctatgagaaagtggtcagtcacactgttgctggggcattgcaagcctcctcctggcaaacgcagcctggttacacaggccacatgcacagcacatcccaaatctttatcyaattccacatgccataaatatggaacctatgattctcatacagggtgggcccgccttatgtatatttatggcataaccacaaggcagagagctcatctgcctgatggaatccatatccaacccacrtgctcctttagattatacaaattgctttgcatacatttcttcagaaaccacaagcagaaattactgcttttggtttccccagctatattaataacaccctagatgcagacatggcattgttaatacaacagtagaaggttcatgtatgtttacataattataggcacaattatgtacatacayaccaagaagggcgcrtggagagcaatgggaagagctcagaggcacaaggtcttggtctagttcctgccctcctgagatgctgattccatgattctgcactggggataggctgtgcctcgggaatggaaccacagctggtgacaggacacgggggagagagactactgcccttatttgtctaggcaaaagcccttatcttcagttccctctcattcggtaaacgtggggatctcccttgttgacacagctctagttagtcacagtgtttctgggctattctgatgcatttggaagaaatttgggctaaaagagaaagtctgtggggtgccaaatgcacgctattggccagatcgaggatggatgggtgaagatagggatgaggtaagacttgggtccaagaattttcagaattaccccaccaggagtggaaggaatgcactgagttcatcacattaatgtaaggatgacctccaagggactcagaaaatcctcaggcaccagcttattcactagagtatttcacagagtttcacaactgtggaaytgaagctcttagagattaagtgccttgctgcagggactaggaaactggagcctgcatggacggcgcctggtcaccagacttggatgtccagactggcgctctccacaatccgccctaggccttactcttcatcttgagggaaaktggcttcctacatgttcagtccaaggactgagaggtacacattttcctggaaagcctcctcttcagtgaagttctgcatgcaggatgagcctgtacatggcttaacccactaggctcattattgtggagctgggcttcaccacagaatcatgaggatggagagttgaaaggagttgccatttgtttgatttggccacatcccttcaaaacaaataaacactccacttcaaaaatcctctatcccatatttattttctaaattaaaacaaatcatttttaaatcagagacttgggaggagagaaagagtggtgtcagaaaaccaaaccctcaaatcagttggctaacagctagaggcacgtgatgtctattttcagatcttcttaaacagggcaccgtgtgatcttggaaacatctcttagtggctgcacgcctcagcgtttccacccagtccaaatggaatggcgctgcggctgctatcggcaaagcaccttgagatctgtagatggaaggctctccgcggatataattaatggagtagacccacaaagctcttcttgagcagaagcaagttatcaatttaaaaagtaagaaggccccatgggatatttatgggcctcttttaaaatcataggcctggaatggaccatgataagtcatccagacctttccctgcatctgatggggcctgcattgagctgcctcagataaatgtcatccatcccagcctcactgttctcttagggatgcaattatgcttctacttgatcatttaagttttcaggaaaaaccttttttttaaaaaaacctcctggcagatgatgggcttccccttattccttttgtggtagtaattttgtttgttgaatatgagatgaggacaatacctcacactgtaatgggcaccagccttcagaagtcatgttgygtgtgctctgaagggggctgataccccttccaagttcaagtccctcagtttatctgaccctctcaattataatggagaaggatccagtgccctaggtaattaagtttgtcccttatccatttgccatgggatgagstcagacctttagcctctccacttaggaagctcaggggaaaatttcattatacagaagcttgaaccttttctctatcaggctcccgcggccagcgtcacccagctcccgtgggtgctgaactgtctccagtagctgaggcgcgcctccctggcgctgatagccttgatgttaaactccaaggccccggctgtgcacagargccagtgacaaggagcacacagaggggatgtggaagggcgctgtgattctgcttgggctgtggaatcatgttccttgccccaaccccaactaatgtagatgagcactggagtgaagccctcacctggtagattgtcctgctctctgatgtcaccttgtccctgctccggtttgcagagcctccacctgaagaggcaggcaggtggcagaggtctctggaacctcactccctgttccctcaatctctccccacctgggagttaaaggcacctccttaagaaaacccaaacatctgtgttaggaggtttccaggggtggagggcccaccccacccagctagaatgtcctagaatgtccgagtttctccttccctcytcctaggacattgactgttccccccaagcccgctcattgctctgatcctgtgctcctcccccgcctgctcttctccagccccacccctgagctgccctcctccccgctcctccctgatgcgttcctgtctcaaatcctgaaaccctaatcctgttagtatgctgtgttccaggcctcagcgtctcgatgggggtaacataatcccgcagtaaatctagcgggccccgcaggcccacacagatggggatgcgcacatccccgccccccagaacgcagccgcccctgtgcctctgtctcctccttcatgtaggaaagctgcctgatgacaaaaacagcccgaaagtaaaggaggatgagagcagaggtcatcagagtcctaaatgtgcatttggttgttagacagcttctttgcctaccggcatccctaccttctcttaatctctctctgtgtttatatatatatatatatacatatatctatgtaaagtatacacgtgcacacacacacacacacatgcctctaactctatatctggctaagttcccacatccactagaatgaaacaagctttaaaacaagtttttaaattgtctttaaaggggagttttaaaggagaaagatcaggaccatgattcacaaacaacaaaaaaagcccattgccttcatatcatttcccaccgcccccccccaccccgcatcgcaacagttccctccccctacttgactgttttgtgcaacaaattaattaaacaggatggcattcattgattagcaatttatttttacgtgtagacccaatggctggtttcagagcagatgcaagggaagggggtgggagagggaggacacacagatctgcagtcagggtgagcggatgagtcagcacatttgttcctgacactagttttaaaaacatgcttctggcttcccccagcctctgtcctgcattcctgccacttttctcttctgcctgctttgttttccyccttcttgagtgtctgtgccaagtacattgaaagggagaactttggaggcaatgaaacatttattagtggagagaaatatttattttaaaaaagaagaggaacatctcgtgcacaatgtctaccccagggctccagcactgcgctgtcttggaaatatttccctgctttctttgcagtccctggagctggctgacttcagatatttacagcaaaatagaagtaaacagtagttcacaccataggtaatgaagagatgggagtgtgcaagctgagtgctgaagcgctactcacatgagaggtggtgcacgtgaagagagactgtttttgtaccccaaagggcccgcctcatttgggaagggtgaaacagccagccgtgtctctcctccaaggagctcaaagacttggacagaatcttcatcttaggccccagaggcaggcatgatgacaggtagcatctacactgtcctgggcacatgggtattgatagcaaagatgaatggtatataagaaaaggctttaggctgggcagaaaaattcctctgcctagaggcctagaaggtaggaaggctgcaaagctcactgtcctcagctatgtcagtcactgcatattcttcaaagacaacttaaggaggggtcagcaaagaagaggtgactgtgactagaaatggggtgggaagcagagaaaatgttctgagatggcctcagaaaccatcagtaatgcgttctggctggatgcttcttattagattttatatatatatataattatatatataatgtatattatagaatatattctatataatatatagaatgaatatattctataatatatattacattgaattatattgtccatgccttgtggactcacaggaatggtcaaaatgcactgattttctttgcctgggagtgtagataacaaccaaactgggatgctggatagcagctgatttaattggcaggtcccccactcccctagaggtgcaaatcagaaaatccaggaaatgctgatggttttcaggttctgggctactgaaaacaaatcagaggtctcaagaatcaattgaaaaatgctggattatattcagaattcagagaggcacccaatrgattatccagaccactttgtgccctgaatcgctttttaaacttggtttgcagagatgcacttgaagaaatctttatgttcaacttagctctttttaaatacgcacacacatatatttttaataattacaacataatcaacactagcatcagaaagctagggtcaccttgaacatacttgtgattttcctttgggtagtaaacaaccatactaagatctttcttttaaaacaaataaaaagtgggccaggcatggtggctcacacctgtaatcccagcactttgagaggtcaaggcaggtgtatcacttgaggtcaggagttcaagaccagcctggccaacgtggtgaaaccctgtctctactaaaaatataaaaattagccaggcttggtggcgcatacctgtaatcccagctactagggaggctgaggcaggagaattgcttgaaaccgggaggcagaggttgcagtgagccaagattgtgccactgcactccagcctgggtgacagagcaaaaccccatctcaaaaataaataaattaaattaaataaataaaaaatatatgtcctctgtgacatccagcttctaaagcagatgttaacattcctatctgagtataacatacaaggcaacccaccgatttttctcagatacctcactgcaaagttgtcatctgaaaattgttggcctgaaggtgggacttgggagtagtcgtggcttttggaacttaaactctcccacctgtgcaaagacccacttgttacttgtgacctggcttacacgctaacatttgtcctgggtgctatgcaagccttggagggagggccagtaaacttaagtgtctatctgcaagcctattatcgactttattttcctgaaggagaaaccaaggtatctaaggtttattgatttgcctataatgattcagtgagttgtcagggaatagggaataaaaccaatttcctggcgtcatttcccatgcacacaaccccttaccttgcaatgcctagactggaagccaagaatccatctcagtgaatttgatcagaaaacatatgaagggtgattctaaaaccacagaagcattgagaaagtcataaagatgtataatatatgatagcatttactagctataaataggggagatgcagggagaaaaatagagaccttgtaaamccattgggtcaggataaatagaaactgcttaatatttcattaaaaatggattttcataaattgcactttgatatctttgggcaaaagacaatatgtaaggactaaggcgttgttattcattactctttgttattaataatttgaactggtattgaaccaacacatcaacaaggtatagtcgccctgtgaatggggcactccccatgtgttctgggcactattcaaagtgtataaaaagtccacagccaccgtctgcaaaagcacttaggctgtaagggacaacgggtaactaaagtgccctgttgcaaaatggacactgttagagcagttcaaaccacaaaaagtcatgcgaagaaaggtttagaagcaggggaccagagagaaccctacaaatcaactcatacaatcccctcatttaacagaggaggaaattggggcccgagggaggtagagatatttgcccacacttatgagctaattagccgcagagcacagctcctggcttctgattcagtagtgttttgtrtgtgtgtgttgtttttcccactataccacactcagagtgagaggtgtgttaaaaaatctaataagatggtgttccttcaccatccaaagaacagaaggcagatgtgaacacaaagtcaagagcagacaagaaaacagttcaggaactaggcttggaaacgtgaagggtaatttgaagctaagttgaaaagatccttcatttgattcaagggtgggagaagagtgggcaaaatgaaagggcagactgaagttcaattgaagcagtcaggtagatrgcctaggggacamaaactgtgtgcttgcctcccttcctgagtggtgctactgtaagcagagattagggggttcacccagagcctgtggccacatgtatccatgggaagactgaccccctccctcagctcatacatgcgagtgcgtgcagcccatgcccatgtgagccacactcatgcacacaccgccatcccamagacagtccaaatacacaatcatttactcattgaggaaagaaaaggtctcttagygttgcctgccaaggctgagaaatgcaggggtcggataagataaaattggatattaacaacacataagacatgctgtgtttctaaacggtaccagcgtggtgtgtatgctgtggattagcggcagtgttaaagttcagatccactcaactttccaattatgcattcacgtgacaagtaaagcttttttcacccaatgtgaactccttagcgtctcctgatggcgaccacacacacagtccccatcaccatcttcagagagcaagccagtggaggcccccctgctgctgctcacaacacccatccgaaataagcaaagtgctgcatttgcttcttcctttccaaaacaaaacaaagcaaagcaaaacaaaacaaaacagaaagcctctgcctcatgctgaattctcagagaactgatgaatctcttttctttggatccagttccccatccctttcctgagagctgtggagccctttwtcagtacgaaggaagtagggtcagtcaccactccccttgggccttctccagggtgtctggccctaaccytctttccttccctttgcttggcttttctccttccctcgctaacttggtcttctcactccttctcatccacaatcgctatacaggaagcagcaaaatcaaacctgggagagaggcatgactaacaagttctttcccggtgctccctgctgtcaaccttaggacccgggtgggaggacttcccaggggaggagagggagcagcaggctgggtgckcagggggcacccccagatttggtggacttcgcaccagatcaatggtttaaactgaatatggtggaccagcgaaaatctgcttccctgtttgtcttcagccagccacttcccttcatttacttgcaaaaggtatggtgtcttcagtggtgtgttattaaatggctctaacttttaaccttagcaagcaggaaatagggctgttaaatgatggagttcacagttcatggggaagaaaggactgtgttgtcaattggctgtagacttctgtgctgctctttgccattactcaaagccattctaaggtgggattataaactcacactggaaacacatcactggacagtgactctacctccattcagcccatgcctggagactttaagggccccatgactcccagccaccagcataaacactgcaaatgtgttagaagaaactacaagcttaaaacctaaaaacttggcaaggatgttggatccagacaggcatctctgagcctcagtttccttatccaatgaagtggagataagaatatctaccttctggggtactatagatataattgtttatactcaaagatattttgttgcatctggctgaaaagtcttcaaatataccagtttccccagttctcttgtcccagccctgttggtgcccccaaacacttggcatggtctgaatatcaggagccgaaacatctagttctcctaagcaggagaagtcgctgatggttgcagagttggctgtaagtagatttacagagtcccttggttgttacagctatgacagaaatgatttagaagtgatgsttggttagttggtttttccctctacccttattcaggaaaaccaagggaaactcacatatactttgctctagttacttttttttttttttttttttgarcagagagcacaaaaaagcataaggtccatatggcagttattgatctgggccatctggaaagccaggacttgctcccaccatgtaggatcagaagctgttccaaaaagccttccctcccataagagatgtattggtcagatggggacagggatggatttcattacagggcrggactacagtgagaggaagctggagcaggactctgaaggactgtctgcaaccctgaccctgccacaaagatcagagagaaccaagaaagtgttgattgacacagggccattgtaggtagagggtgcccctcatcatcttgtccgctcatgggtgggatggcatcaagtaactaacaaaaacaaccgtgaagcactttgcaattagaaaatgctctgcaaatattcctaggtgcctgcaacatgaggaagagggagtgtcaagttcaagctagtgagtgaggtctggtagccctaaaagatgatatttttacttcattttaaacagatattctacttttctctttcttccttagcttctcaagtgttttccttcttctgcctgctctcagcctggaggcaaaattttccttccctctaaaagtttctgggaagaccactgataattttcaagtagaacagtgtgagaaattaattttttttacagtgtttctttaaaaagcccaaaacaacatacccactgattatttttaagcttgagggaaagaaaatttgacagaactttcccatccccttcaaagackgctcaagtggctgaactacaaacaggggtttcaataacatggytttgcatcttacgctacaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacaggtgaggtgggggctccaatgaggttggggtgctgattgagccctaggctctgctccctttcaactctctgcaaacagcatgactgcaccacatgaccttcccagaaagactggctcaaggactcaagtcctaccagagtttgtcttttcattcattcattcagtatacatttattaagcatctacgatttctattaatagctaacatttatggaatgctaactaggtacagatgccattctaagcacctaagatgtaacatattttattatcctcataaggactccatgggtattattctcctcactttacagatgaggaaaccaagacttaaagagctaggtcactcaccagtaagtggtagagccatgrtttgaatctaggcagttccagtccaaagcccttgctttcaaataacactctctgctgcctcaacygggggccaagagctgtgcatggtgctgtggacacaaaggtgggcacaacagactgttctgtgtgggcayatggacaagttgggcagacatactgataaactcataaataaatataaaatcaaaactatgatcaatgtctggacatagaggcttatggtccttggaagtacatcgtaggggatttgacccagcctaggagctcaaggaagacttctttraggaggtgatgattgaggtgaggttagaaggcaaataacagacattacctggtgaagaagggagggaaggtgcaccaggcaatggtcacagctttctcaatggcacggtggcaagagggaccaaaagaggaagtgaggagcatggacacagcttgtgggctgaaacccaaggcatgtagattggagaagaccagagtgggagttgggacattataggaggcaatgcagggggtgcagatgggagatgatgatggctggattagccccagaaatttatggacagaccaatcccctttatcttgtgggctcagcccagggcaggcaagttgcctctttgacctggaagtgtcttcagtgtacatccatccacgtgcctttcccctaatcattccagctctgacagggagtgctccaaggtctgaccctgtttgaggtttctagttaaaacaccttgtgtttgtacagtctctgcatctccacatgcctttcttgtttatcatcttgcctacactttctaacaaccctgtgaggtaaggtgggccagggactgataaggaaaccaagactcaaagaggctaaatagcttgcccaaagtcattcaactaggaggtgacagagccaggatctgaacccacgttttctcaattcaaattctctgctcttaccacatttacacaaagacccattttcttctaatgggatcagtttatgctaatcctgtctaggggactattttctgtcccttccctgttgctgttccaggataatcagcaaagatttaggtagaggtcattctctggaagattgaaaggagagaaccagtgattttgaagaaggggaacaacstggaggatctyttttatccatagctcagttwgcaagtatgaaatgcacattgactatagaccctgccttgcctgacatcatttattcatgcattctccactcaatcatttgttccacacatctgatgtgccaggcacacactgggaatgggacatagagacaggaacaaaatagatggggtctctgacatcgtagaactttcaggctactgagcaagatagataataaacaaatgcaagtactggataaactagaatgtgcacatgaaggaaaagaacagggtgctctgagggaaaccaatttagtgaggattgaaaatttgggaacagcttttctgtggatwtgacacttgagcttgggggtaagaaaatgttagtctgggggtgactgaagggaaaagcatttggggtaatgggaacagcatgtgggaaggatccaagrcagtaaagagcagttatttgggaagtaaagacctgatactgatgccaggaaggtttccttctacttggcaaaacaattactaggaaataattcaatgtttagctcagttcccctgttctcagtgtccctgatagggtcagtggggactagtgtcatcgacagggatgtgcagacacacattctgagagtccttggttagagctgtaagcacaaatagttaatggccattggatacttaaatatgccaggcaccatcctgtgagctcttagtaactaacagaatccttgcaacagccctcaagaggtaggcacctctattagctcccctttagatctaaggaaactgaggcaaagagcaattaaataatttgcccaaggccctctgactagtaagtggcagagtgaacatgaacacaggcagtctagctctgagtccaggctcttaaccacagtgctgtacacattcaccatgcaaagaaattagtgctgacttagtatttgacagttgggctcttttgcagctcccttcttatagcgggtggtccctggttagcaggtgtcagccatgacctcttgtatcttcctctcctctctgcagatgctccctgctccaacatgctggggatgctctcaggcctcattgcagactcccagatctccgcctcttccacccaggaatacctctggagccccagtgcagcccgcctggtyagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagagattactttgtgccaggcactgtgctaaataccttatttctgactcttttktttgtttgtttgtttgtttttgagatggagtctctgtcacccaggctggagtgcagtggcctgttctcggctcactgcaacctccgcctccagggttcaagcgattctccagcctcagcctcctgagtggctgggattacaggtgcccgccaccacacctagctaatttttgtatttctggtagagatggggtttcaccgtattggtcaggctggtctcgaactcctgacctcaagtgatccacttgccttggcctctcaaagtgctgggattataggcatgaaccaccgcgcccggcctggactcttttttaatcgttacaacatctgtgcaaagtagatctttttgtcactcccatttyagagatgataaactgacacttgatatcatgcccagggtcacacagttcacctgtgatagagccgattcagaaaccggaagtctgactccaaagtccagatgcctaacccctactgaacactgcctttttataaagttcaacactctttatacactctttcagataaagtttccttgaaattggccagacatctaaaggggatgtggtttttggaggccaagctatagaaactagaggatgacttccaaaaataacgatgtttttctgaatgtcgctgcattcctttgtattctcctagttttgactgcttagatctttccggcctctcagactgaggcaagggagaagcaagagaaactcaccccgagccagaagctcaggccagtacagcttactcccctgccaccagagtgaaggtcagccttcaacacagayacaaggagccccagaaggggaggagaygtcatacctctgtccctccccagatcagtctcctggcaggccaggctctctgattcttatctctagttaccccttgtttttctcaaaagaacaggtccctaaaaaaggagggagtttgcatgtctcggggccacctttgctaagcaaatgtctccattctgaatacagaggcaagagttgggttggaggttttgcgatgctgaggtaaactcccagctctcaactccagaggcttagaaaggctcagggcttggtaactggaaccttgcatcgatggagcagaagttggaccgcaggcttccccatggagagctgagcctggtttttcttgggaaagaagttgatctttgccattgtgggagacagccctatccgagacagtgcttctggttcagaattgtggacgcagggcatcctgaaaactggagcggtcctgctgaatttctgggggctaatcagctgcaggccctggccacccactcctgtccttcccccggatgagtgtctccaagtgtactctaggctggtcctccaaagcagccccctgctccccgcatcatcagttttatgtactggggctccrtgtgaggtttcttttgacaggagtgctttccctaaacaaaggtttgggaaacagtctaagactatcgatgtgtgaccagaagacagtgtcattggcctaggggtcattttcccrtaaggttctcagtgagctaggaactatcagtcagcttgggttacctcaatggaggctttcacrcattagaaaaagaagtgtycctttccctgtagaccaggaattcagaacggtcaaagatcgcccaaactgccttccccsctctctagccaaagtcagctgaaaacgcagttggagccaaattcttccccagatactccattttagtcaccaggtaaaagacacaacctggaaattgccacctttgtttacttcctattttccataattctgggtccataaccaccttccaaatgaataaaatccttggtctgaaaatgaagctcgcgtggatcagaatgtcccagtgaccaggaatcaactaggaagctgccttcctagcaggacgtgcggggcagggaggagaaggggaaggaaagggaagaaggtgatagggactgggtcccacaccagaagggctgagtggcctctctccctgcagctgttcgaagggaacatgcactatgacacccckgacatccgaaggtttgaccccattccggcacagtatgtgcgggtatacccggagaggtggtcgccggcggggattgggatgcggctggaggtgctgggctgtgactggacaggtaagatgacatttcctcctctttgcatctcacccacatggtcctctgaccctggcatcccaygaggccctgggagggctgtggagggggcagccatcccaggagctggaaatgctgcagacccctgccatgttctcctgcctcagaccacgggtactgcagcctctggacttgggacagtttctcaagggatgtactttgtcttttttaagggatcatttcagttctccaacccgagtctctcaaaaacaaatcataaccacacaccacccacccaaattcaattagaccctggctcttcaggccagagggctgtggctgttgatttagggaagaaaaaaacccctcatgataataaagtaatcggtttatgtctgaatctggcctccagatgtcagtggctaagagacttcattttcatttcggagccacatctgtaaaaggcatttatttgctcaggagggaccctgttgcagggagctgatgggggcaggactccttctcattgtcctgctcattcctgccaggtggcccaggccttggggaacacctctcatcattccaaatgagggtgaggcccacggagggtgcccagccttcctggtttccgagggagggccctgcccttctgagtcaggccctaccttcctttccttgggtcgccagccctcctccctcagcagagctggcaccagatcttacccagagctcactcactgcctgccaaaaggagttygtgggagccactggggctcagggactgagcctgatgccagcaggagcagccaccagcctgagctatcctgccctcctccgccagagccccaggtatccccattttcctgtctgtgccgtacctgtcacgggctcagccggcaggatggcatgagggattaataagggcatgtcggagaagtgcttttggctcccagggagaaaaatgctgcctgtatgctggctacagcagcgcagaggagccctgttgaggcacacgggctgggaattgggcccaaattagcctcctcacttttgaattgaaggcagccccagcgaacacatcttcataggaagacacttaactccccattacctggggatgaggccaaagttccctgcagcctgctaaacgtgtgtcacccgtcctctcacaggtgcagaaaacctccccccgatacaagctggcttcatttatgtgccctggaatcaggggctcagcgctgtagkggatccaggagcttgtaagccagtggctttcacacacttctgcccatgatacacaatttaaaataattttccttcacaacccgcttcacttataagcactcacacacagtggtgtatacggggtacagtgtatgggtaagtgcttggactctggagacagattgccaagttcaagtcctgcccctgccattggctggctgcataacctcagaaaagttagtctctcagcgccttggttatcttagctgaaaaatggagaggacaatagtctgtctaccccatagggtcattgtgaggattaaatgaatgaatggatgtgaaatacttagactactgcctgcacccagcaaacctgttatgataaataactgtaactgaaacaaaaggttcccaaagcaatggtcatcttaaccatggaagtgcwctccaaaatattatagtcggtatgttttaaaagctggtcatgacctattcgacggattccacaacccaatgatgagagtgatgcgtggtttgggaaatatcacagacctgggccaattcctctttcatagacaaggaaacagccccagaaggtagaagtcacttgccagaggtcactcagctggatgaagtccacctcattcttccccccatcccttgcccttcagtgccatgccctcccagtctggccagtgggacagttgctaatgacctctttccttcattgctccccaatcccaacatgccccaaattacactggtgayggtcagtgacaggtttcttatttcaaagccctgcctggccattccttggaagatcagagttgaggagcgttcccctctgcccagcctcctttcctttgaagtctctgacatctggtttcaatttcaggggtagcgttgctgtttgatgggcagttaccttggagcacccagtacaaacatagtacaaacagtataaacaccgaggcctcsgtgcccgccgttcctccactttcatttacacgccctgccctccggtgcctcattggcccctgggtttaacattctttacaccaatcagctgacccattttgctacctaacatttccagaaactgttctccataggtcacgtggctatgtttgctttycraatttccatctgtttctcacactcatcttcggttcacttcttcatccctatcccaaaggataacaggaaaaataatgggctgggctgagctgctgcagctaaatactttgacagggctgcttcacctgttagttggtttgtgtttcaaataattatgttttgccttactgccccatagtttgctttacaatcgagtttctatgacacagtgacaaacttgaacttacaaattaggacacttcgaggttatttgctatttactgtgagcaaaaggcagacacagcaaagggaagtatgaaaggttatgtgcgtagtatttaatagcagaaaggtgggaagccgaccgtgaaaaagctattcagcgtatttagcaatttcctccagctcctggctttattaaatggtatcctgaagggtgcctgacaaaggcgcctaatcacatacagtagtgcaaaggagcatgtatagaaatgagagggacaaggcactggcatcctgttggaggacagctctgggatgaagacaccaccccaaaacacatggacttgagcaccagtttccagaacccctttcaccccacccagggcctgactcatagctccattcactccctcaatagttgctgaatgaatgacgggcatgagcaaataagcaaatgaataggtgaatgaatcacctagagctgaggtcaaaaccccctgcctgcagccaggtttggcctagccagggttcattgtgtgctacttagtataacatttttaataagttgccaacatgtagagtctggagattttacttagggatttttgctttcttgttgggggaaggaaagggggaaagatttggaagacctggcctggccacactgggccacctcccctccaggccccagtctgctggagccagtcatggaggccacctttaaaccaggcatgtaagatcccagctttcaccacctcctctctctccaaccttcccctgccctcacaaccacgtctgctttcctcacttacagtaggtgtttggatccaggaaacacttgaacttgccacaccctgacctaaagacatagccccaaatcactttcaccatgtagggtctgagcckctttaaatccatattcccgtccatccagtkttgtgcaaacatgagccagagtgtgctttggtccttccttggagtcagcgtcgcctgtagccccctccrttattgtctcgtggccttttgtgctaaactcggggcctctgctgtggagtaaagaatgtgggtttgtgtccctacctctgtcactgctggttctgcaacccaggaccattctcattctactatggtgatgcccctgacttcgttgacagcacacagacatgacttcagagttccgtgcacatgtgtgcatcttctttcccttctctagagatgtttggcatcttcctcctgctgggttgcaacacaggctgctacagcattctcttatcttcctttgcccttacacagactccaagcccacggtagagacgctgggacccactgtgaagagcgaagagacaaccaccccctaccccaccgaagaggaggccacagagtgtggggagaactgcagctttgaggatggtaagcacaaattgcctccagatggcatgggtgcggactagtcagagtgggagctggcctgtggctggacagggacctagkggtcccccagatcagagatccaggggatctcaaagaagtggtaagagaggtgggggcacttaggggtttggggcagtggctgtttacaaccaatgtagaagcatttggatagtgtaacaaccagtacagccctactggtgtgaacccactagacatcaggtgagacaaggatgactccaaagagaactcctcttttgaggagtctcatttgttgagccctcactatcttgcttgtctgctaaaggagaaccattcttatccttagaattcacagctctgatagtttttcctgttaagctgtgtgtgtatgctacagcsaagtgaagatacggcagtcatctgggtgatggagcgcgatagttgggttaatccagcagttacctgtgacttaattgtgtttccctgtgtctttcaccgccrccaatttgagaaagtataacagtgatgattctataagatagtgcactgtatcctctataactggagtgcagatcagagacaaaggcggaaatgtaaaaaggcatcttcaaccgttccctcaaaactcaggggctccgcatttctggatgggtcccatcacatgggaaattcttttcatttatcttcggagtatatccaagttagataaaaacaataattggcagaatccaaaagtcagtcacattttaaatcatactgctaaagtcaccaagtatgaggacatttataagaaaccacaaattttggaacacctggcattttggctagaatgttaagcttgacagcctcaacttacagtaaattactgatcattattaaatgttcattaaacaaaatgagggaagattggcaaagagactagagaagtgatggagacataaagatataggtagatggcaaaatctgtggaaccygcaagcacagccgtttgacagttagaggaactacactgatggagtggatgactccagaaaatggctacaaagaagaatgggaggaaagccaagaataaatgctgaagttatgtgactgaaaaagcaataatttaatgcatatgctttggggattgtgctttcatattattgtgtgggtgggggacactgttggtcggggttagttgaatacagaattctgacattttaatgaacttgtttttgttttatggagagaagaaggagacttggagaatcttccaagacatgtttcagatagtttgagagccaaaagtggaatgcatagggagttaacatacgatattggatttacagagttagcttgttgggggacmtggagtgggggttctagctaaatgacaatcaaaggaaaaattaagggttctgctgcaaaatttcagaagtttatttttaatatgattttcccgtttcyagtggtttgtttcatttgaggtttctttgatggttcctcccttttctttttgcaaaagttttttttgtagaatttggttcctgagatacagtatacatgtaaacattacagaggatttatgctatattgaattacttcgtatttttgaagagaaaaatagaaattcagaaattgtcaggagaaggggtggtaaaggctaagggctgacttttccaagccacaggttgatgcttctgtaatagattccatgtgtctcttctaaactcaagctgactttggccaagggtgggcaaacattaaatatcctgtcctggaaagggaaggcatttacagggcctggtggcaatcttcctcctccctctgacgccagcagtgccctgccccccatgaggtgagccctcctcacccctagggtgagtaatttgtttctaccagtccgtggctccctttagacttcctaacctgcattctaagccttccccagggaaattcctctctaagaaccctgggaagggaagtgagaagggcagagaccccactttctccctgctaccaacattagccaacatttttccactgtctccgcaggcactgccggcaaacaaccaaatctgggttcccatttcctctttccccacgtccacaccacccccacttagtcacatatttggcattagctcatactggatttttggagctgggtggaacctcagaagaaactctcttggttctgtcttcaggctcaggcaggtgaaccatcaaagcagacaggacaccactgtgtcattagttcctggattcccatagggaaagcattctctacctcccggggtcgcagcctccagggattcagcatgatgggaaattatttttcctcctggccagcactgagctgagaagctggctggtctggtcccttcgatttgctcttaccatgccaaatttcccaccgggcatacctccccatggagatgctggactgtcccagtcttcagaaatagagacggatcacaaagaggtgaagtgtagcaaacaagccttccttgtttctgaggtcactttctcctcactgggcagaacctcccagggatttcagtctctctggatgctaatgggctgccccatctcctctgagagccaggttggcaggagatgagataatactttttttgggagccagccttccaccagggcactggggagacattcttctctggcatttagggaacagcaattttcacatttgtctgctctccgaggtggacagaagaggctgattagagcctgaagccatttggtagcctcattcataattgcttactatgggaaccactggcagacttggctttcatgcctgggaaggatgagaccaaagcctgacccgaaagccagcgatcgccaagatgagttaaatgaataagcaaaggaagccacttctttctctgctctccactcaggccttgccagccatttaaatagtaccactgtggctgttctctgaacccatttcatttgccttcctttgggttattgttttccccttttagacaaagatttgcagctcccttcgggattcaattgcaacttcgatttcctcgaggagccctgtggttggatgtatgaccatgccaagtggctccggaccacctgggccagcagctccagcccaaacgaccggacgtttccaggtaagccagctgtgagtgaagatatgaaagagttaaggccagcttgttccacatacttcaaccccagattcccttacaagcttcataacttcccaccgcacagcaatcctctattctttgcccacaaaccaccacagtctttgctcaagacgtcacctcaaagaatagccagttggtggttcccagcctctcttgtgattacagcacagcctggaagctgggagggagaagcggaagccaagatagaagaaagaggagaaagaaaaaagggacaattgggaggccctaggagatggggcacgagtcagtgtcctcttgttcccatagccagcacccactgctattatcacagagccccttgtcaacttcgagctgggtactgttcctaaaatggctcattgggagatgactggccttgagtttgatttatacgtctctgagggtgccactgcttctacaccaagtcaatttgagggaccaaaatgctgccacacccatgggtatctagcagagctgcctggcacttggcctctagaagagtattgctgtaagtcctggatacattgttaagcccaccattttagtttcagaargccagatttcagaagcttctcctggcactgctgacaagaaggggttgcctctatcccttctaaacaggtagcaagagttgtctgctatctctgctgttacgtgctttcacagcagtatgatggtaaatgtttaacaataggctttttagggattaaaaaataaactgctttttaacgtttgtcactttcagtggtgtaaatacccttaccatagctgagcttaagctaccaacacaacatcaatggagatggagttgagaagtcagtaagagagcattatatagtttttttttccattgtgcaaatacagtagacagaaatgactccagaagtatagctactgataaaatgtattaagataactagcaagtgttgagttttgaggatttgttacctttgttttttaatacaatttattgaattatagctttatataatttaatttttactaatgaatacatttaacaactggcttgcaaaacacttgacaagcagctctcacaagctggtacaccttggatctagcacagcactgagtgactttgaattctcctgtacttctggcctggacctgagacctccataagcactggagaggagaggggtgaattccggaaatttagtagatcastttgccagggtacaataggaaaaggctagaaaataaaagagggaaagggaccttcccttctgcaggcttccttagaactgcttctcaccccaagcactggcgtgtcccttcttcccggtgggggcagtgggacagatgctaggagaacacttggagctggcctcctgacacagtccacacttgcttccctggagggtcacagtgcctgatccggagaaaaacattttcatatttcaagtgtttatctcttcagcatttgagtgctcagagagattaatatctgaagatcaccacagcctcaggcaaaagaagagaacacttaccccagtccagccttaatcaccctcccttctctgttcactgcaataatgtttaattaatataatgagcctcctgcacgttgggaaaaaatacttatttttataacccagcctggatttttcatttcatttccactcctttgagactgcatccaattaattcatggttgttcccaacccccatgttttatctgaatgtaaagaaggtttgtggggtctgtgtaggtgtgggtattctagtgttaatgtgtgtgtgcatgagtgtgtttgtggtttctgtgcatgggtgtgtgtgtgtgtctgtgtggtatgtacctcagcagaggckcttggaataaaaggatatagccggggtcctctgcaggctggggaggttggctggctcttattcagtgtctgtcctcaggttcattctaatgattctggcctcctcccttgactcttctaagcatattttctctgggagtgtctgagggcagccctacccaggccacaaggccaccaattactgagtcacagctccaggggagcttaagtgacctccctttgaccctggcctggacctctgtttcttcacccgttcaccaccgcctcctcctcgtccagtcctggccttcacccgaaagcccctatggttgacctttgctactggttgggaattctagtctttgtcctccttccagttgattcattataccctgtggtttgggagggcttttcagagcaagctcacaaagtgggcagaattccaacctttggctgaatggatggggacagagagaaaattasggccataaggaactgctaaatctaatgttgttcctcccttaagatattgaaagggaaagtaattattttcctattccagaggaatcccgaagtttgggaaagtggcacttataacctgcctccaggaaacaaaatcataatattgttctcagagcccttccctctatcctctgatgactttatgaaccgttctctgtatttcccattttccttctccctacagagcttgatattgggctttaagcaggagaggagagaaagccctttctgttcagggtggtccttacttcttctccataggraaaaaaaaaaaaggagggggaggccctgaggggattggggagaagggaagcagctggcttggttgggggcagagcaactgctaatgggttcagagcggctggcgcccacagagtcagcctgaaagcctgttgtgtgccacactttgccatccacagaggggaccgtcccactcttcacgagcgtgtgccatatgcttcatcccctgatgagataggcaaacagaagtaatgaaatttaagaaaggaggtgtctctgtcaagtgtgaggggcgtcagggtgaagagaaaggtggatgggagaggagctagccgtgttgaagtacccaacacgggccctatgtggaaactgcttacattcctcggatattttctgatttcattattttctcatattttctttctttttttttcctttccttttccttttaagtaagcaattagttctgttctttttggccagtggttgcctaaggctgaaaagcacccactggtttcattccactgtttttgtttttcaagatagtctttcaagccagtcagaatttctgtttttagctctttgcttgtggcttagctgcctggagtgtgttcacaccagcctctggggaccctgttccaaattcagtgacccctgctagctgcggaggaacactcagtgttctctaagaggccactttggctttcctctgtagtgacaatgacataggaagcacccccttactaggagatggcatgtttcctacattctcaggtgctttgaacatagacagagttttgagaatgatcaaagcccagcctttaagaaccgagacaaaaactcatagggcgggcaggtatctaaagctgcagcattgaatattgtagccatgagccatgtgtggcaattttattttaattaattaaaatgattacagccaaaacttcggttctgctgtcccaccagccacattccaagggcacagtagctacactgtattggtcagtgcatagacagggcacgtcactgtatacacggcatcatcacagaatgtattggacaacactgctccagtgctttggacactcacaygagagcaaccaccaggggcccttgatgattctttagttccctggttttggtatgaaccaagaagcaagtaatggagggatgtgtcttctgtgggatcccttgatggagtgttcagtggctggtatctttatagctgtctcattctccctcactagataactacagtaaagtaagcaagtaacatggcattagatggtgtaggaactattgcgattaatcaaaaagagcattgtaagtaaatattaatactaagtaaggtcaataatcatcatcattgtgattgttgtgccatttttattgtcaggaatgagacaaagaagatgaggtaaagggtactaggccaggtcagcttcagaatcctccagtgtgtgttccccctaaatctgtgctcttttattcgtgggttggccttgtgaaatctgattacagtattacttcaatgactttcaatcatgaaagtgatagaaagaaaacaagcgaagctgatattgaacagagctttgactgcctggtcaaagcctatgggattgagggaacagaacctttactctaggctcaaaaacaagctcaaatgggagtaagtcragaatcttaatgttataaaatacccaaattttacaaacagtggctggctattccttcaaatgtaagaagtaagattgttaacacctcactggggctattttgatgcagactgagccattgaatgaattccgttagagtgggagaccttagccatgattcacggtggaggcgcacacaagaagattaagtgaagtgtggatgggtatggtgagtggatggttgcagagaaatcagaggaaataactgatgagtgaatttactcataatgggcttgattttagacagtgagcaagtggtgactgaattgaaaagcaactctgagttcaaaagatcaggtgggaccgatggcagcaaacaatccattgaattgctgttagattgaactgtcttcagaaagaggttgctgtggcttggctggggcacagacactgcaaatccagagacagaacttcctgggctctggaccatgatagataattaaagatcaggagcagcttggctaaaagaaagccaatagtcaaggaataatttcaactggaaaagaaaaggatagaggcccttctttaaggaaggtagaaaaacatcccgggctttgcagaaaaaaataacagcaggaagaagctttctttacccttttttttttttcctgcaaatcatgattggttgagtcccccagcagtgtgtggattgataacgaaggggcagaatgacaagacagcctcaatggcaaaaccttcatgaaagccggcagagtgaaaaaacagctctgggtagattcctgcaagggctaggactgaaaccttcatgtccacaaaatggtctattgtaaaccttgagaacatcttgctaagtttatccaaagtcagtgtttcccttaactggttgctaatttgaggaccttagcagagataggcagaccttggaaggccagctgagggctgactcatgttttaagcrtggactatgcaaagagactacatctcctacagcactaaatattctttcagatggtcgttctagtaggagggcaagatgctagccaggagatgtgcgtgttggacagatggtgtgtttggctttgtgatagccaggaggatcaagctggtgatttatttcagggtttggtgaggtgtagacacaactgattccattgctgttgggccagtcgcagtcacgtgttcacatgacacttaagcagctgaagccagatgcggccgtaaatcgccaggtgaaatatcaagagacctttccagagacagcagcaggttaaaatgctgaatggccctgtcctctgtacttcctcttcacccttttgaactcctgttgttcattcccagrcrattgttttccctgtatcattggcaacaacagatgttttgggtcaaggacccagcgaaatgcctcccaagtatgtcaggtccaggaggagaggaattgtatctctgggacattatttcttcaatctctttcagcaatggaacatatttcctttccattgtctttttcttggaagctgtccattgccggcatcatagccatcagctacaagaacaggcagggctggttcttagctggtcagttgtcacgttcaggcgacctcttgacaatccaaagggctttacctcaaggttcaagtaaataaaaaagtagccccccgcccccaccataccagctcttttgacggtccaagtaatcagtagccactgtataccyagaacatcttctgtgtctgacagtggtgggccataaatcgggagattccagaagaacaaacttcagttgcagcacgtgtttgatctcaatatctatgtgtgggtgccatgacttaaaagagctgaagcatttataatagcttggaagaagggtcagtggaaaaccaacactgccctagaaagtagacatttgaaccatgccctaggaagtagacatttgaaggggcaagggttcctagggaagcaaagactacgagtcttaattcttcacaagtgaaaatgtctctaagttggaaaacagaaattggctatgctccatcaggggtagaaggaggaaatgtctctaaatgacagcaggaaaactttaaactgaatttaagaagtttctgatggttagggttgtaacctagaaaacacactacagacgtggcctatggaaactccttctctggagaatttaaagcaaagggtggacagctgttcttggatgcttttggcacggttcctccgggaggcaggactggcctgccctaagatcacttgaggtcccactcttgttccaggatcatgtaatattttatttcatctactgtgaagcaacacaaaagacctgtggtgatggaaaacttggggccggctggtttctggagaaagagcagataaggggaaccagtctttgtccagagaacatctttactgccctcatgccaaacatacttctttttgagtcttggattggccttcctgggttattggtggtctttctatcctttttgtttcctagtaaaataaaggcaagcataggagggagtgtgtagagtgatattaatagtaacaacttttcctgagctcttaatgtgtccttgttactgtgcaaagcactttacatggctcattccatttactcttcccccaactctatgcagtaagactgtctttgtatccattttacagatggaaagactgaggctttaaaagcttagtgagttaggctgggagtccaatccagatgagaagctatgctgtggcaggtttactgagtccaatgaggattcaaatcctacgtcactccaattctctgagcctcagtttctttttggtgaaaatggagaagatggtatttattttgcagagctagatttcacagggaaggtgacatcaggggaggcaggtaaagcctcccgtgtgatcgcgcacaggcagcaggtgttcaatgtgttcattcctttccccctgctcttcttctcccttccttgggcttttcctggtctgagtcattccttcatgatgtccctggttctaatcaggcctctgtcagtgacaggcgctttgcagctcagcatctctctgactgatgtctactgctaattccttaaatttacatatcatctttcttccctggagctcatagcacttaacagacaagtggggcacraatgatttaacgaagtgaaatccagaggcctgctcgtctggagattctgcagactagtggattagctcagatgtcagcactgaattatgatccttcagctgcttgtgctaagcatgtcactagcattaastccctggtcttgcaatgttcccctaaatcatgcatagagattgtcattttatcgtgagagggagatgggagagaaggagaaaggagagaagaggggaaggggctacctggyggggtgggtcactggaaggggcagactgtgaaacctttggcctggctgtgcctggagtttcagtaacaggaagggtaagtagaacagacccagatacaatccattcagcccagttcttcacacttccacacacatttcacttaccaaattctaaccatgatgccatgatttccctgccgcttaagaatgtaaattcacacaagtgacagtatctctgccaaacaattttcaggcagcaagtgggtcttatttgtgaaactgtgaaggaagaaggctgaataataaatctctaaaatctggtttcctttatatatgaggtggcaacagtaagggcttggaaattaccggaagcgtgggagcatttaaagggttctcactggtgtctcggtacactgggtgcttccacaagccaccttgtcattactggtgcacctcacctttgaaagtggctgttggcttgggagggtagagggaattgtgaagggattatatctaagggattatgagaagctagctgattctcctgtcctcatttccaatgtatagcctcatatcattctttaaccgtgtatttatcattctccattcatccattcattcatagaaacaaaattttcttgaggagtggcatatatatagcactatctaggggtagagagaagaagcaatgttaaaccttattatttgtaagaycagcatttacaatataactggggtgataaaaaagacatgaaaaaaccagttaaattataatgccaggcagtgagtgattacctgctgaaatccatggaaaatggcctgcctgaagtccttttaaaaacataaaatcagcagtacagtcagtaaatgctagagttgttgagaaaagaagcggattaatgttgcatgtgccagaatagttaggagaagaactagccaaagggacggggtagatggagtggttcagggagtggagaattacagctaagaggagaaaaagcagcaacgggcccagtggggaagccagtttgcctcaaacagagtgtgattgattgcaaggacttggggcaagctacctgcagagcagctgaaataaagaacttattgcatgaaggtggaaaacctgcagtcaggggtctcggctctgccattgaagttgcctctctaccttggacaaatcactttaacctttctgagcagtttcttcatcatgtgcaaagtaaggttagtaagtcctatctcacaaggatatagaaaggatgacatgaaatattgcatgtaaatgtgcttgtaacctgtaaagcattatgcaagaatgagctttaattattatcattaacagcagtaatagtaagatctgataggggaagcataggtttagaagatctttgagggtctgatttggcatcagtgtatcctccctcagcagacaccattattaattctcttctgtagacagctgccttttagttatctgtgctgattttggccttgcagaggtcacaccttgtagggtatgtagacagatgtggctttggatggttgaagaggcacaaactggaatcccatatacgcatactaaactggtctcatttgacttcagggaagcatagcttctgaagcactaatcccagagagcctaaacaggaaggrgcttaggggagcagggaggtaggtgaggcagctggggagtcaagaaggaaagagctgtttctgggccactgatgggaggtccagcacaggctcagctctcacctagaaagttgaggtcagcaggattaacaacagcaaagcagtggtccagggagtattgcattgattctaggctctagaatcctagcccatctaccctgacaagtccaggatattcacagtccctgtggagtaagaaagctctgtgcatctgtcccaggttaacatgacctcacactaacatgatcctaaggcatctgacrtgcccacattccatgctgcatatgtggtagaaaagtggccctgccatcttgcagaagtattcagcctaagacgcccctatgtttcagggccaaaaagargtacygagatttcctcaccaaatgccaccttgttctctgtacaagtggccagaatggtcctgyacaagttggatttgaaggtgcaggtcacacctgtgttctgcaaggcacgtagtctgccaacagcaacaagaactcggtcttccacatgagtgtctgatgaatttgaaactaatcagccaaaaaggccattctccaaacatttggattggtaaacccttaatttcccagaacacatatattctctgctaaacacacagcctttgttaatgataatgacagcacctttatcactggagccatatgtgcctggctgtctcagaaaggccaagttcaagcctccctgaatcatccctttcagctcccaccctctgttctgtttgaaggtgacactgggcttctgagtcacagtcactagagcccaagcatcatctaggagcactgatggagacagaaggttttaaatgtcagccatttggacagtgcccagccaagatggccagggctggaagcatcaaccacctggtcatagtcaccctccaatctagcagccccccaccccctataatctgtccccttgtaattcagttcatcagattgcactggccctttgggtgagttaatgatgaataagatgtgggtctggcctctcagaatctagagggagaagaagggcacgcacacaaccagccaagacataaggcagctgtgccgggtgctccatgtgaaagagatggaaaggaaatgataccgagaaayaggcaggagggaccgatttgacttagagactcttaagaaaacacagcrtttgaatcaaggctctgaaggagccttaagaaagggtcacagagcctggagaacaaggacatgaataaaccaaagacaccgaaactcagtcccaactttcccttggagaggccacagcagcacactggtgtctttcccgagtgtttatggagaacctctgtttgggtttgtttctgccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccaggtggggtgagcaaaaagggaatcttgtgatccgtatttcaatatttcaagggccgagcccattcatcgttagggaacgtggttaagcgctactgttttcattgtgtttctcacgttgccatggcaactgaatgacactcttatttgttattcagaatatgcctatctctacacccagacttggttctttgttcctcctgttgccttttatattgctgaaatcttctccaacaaatgtttctcctctccattttattttagattgctatcaggtaggctgacaaagggacacagaagccagagaaataaacacaaacaaaccctccacacacaaggaaagaggcctgtggagccccttcagatctggggaggaaataggataatctcccagacctgtcccaggcagcaagaacacaggaaggggagcgggggctgttggcgctcagtggccggcagacatgagaggctccagagtgagtgctctctctctctcaccagctcccggaatggagttctgttatctctgccccacagagcaggagactgaggcacagatgggtatgttcagccgtggttgcaacttgggtaggagtagacacactgtggaagaggtgactgagaaccagccaaagcattaaccttctcctccccagacgaggagcagcaacagatggctggtgcrgcagccaactgctcacccagcttgccagaggacatgtgctagtttgcagagaggaacctggggagggcgagcatgagaaatgactgaagaccacagagccgaggggcttctgtgtacagcctgcagtccctgtcccttgaggttgcaaggcatcctgagaccttccccacccccatctgggttcccacttactcacctgagtgtgttgtattgtaactacctgtttgcatttgtgtctcagccattagatgggtgagcttctctgggcagagatcttgtcttactaggttttgttactatccttatgtccagggcatagtaggtgctcagtaaatggctggtgaaaaaacaaattcttttcctcctagttgtaataatgaagccctaaggcaacttataataaggagcacaaatcaaaacctatgtgctgtatttctcacattacccccacctacttgtgtcttctgagttttcaaatacctggattgggcatttgaaagatttatgagacaggaacctcgaaaatagtgagggaagtttcaacccccctttcaatagtctctgattatggcccttttaatcaatacattctagttactggacaacaatatccacccccttgttatattttcttatccccttaaatatgcgtttgatttgaacaaactcattttgaattaagatttcaagagctgtagccatgtggtcaacagatgtgtaccaggtgcaataacacacacacacacacacacatacacacacacgctttaagctgcagctaacagaaacttggaaatccttgcaccgtttggactaggagactcagttaaccatggctcttattcttccggcttctagattgtgttcgagggagtgatagggaaaggacgttccggagagattgccattgatgacattcggataagcactgatgtcccactggagaactgcatgggtatgtgaatatctgtctcttcatggttctttcaaataagaccccaagggctgggataagcaagaggaggcaggacaccattttccaatgcagtcgttacccagtgggtggggcagccacagtctctgcaaggtaaggtgtgggtgtagttgtgtcttargctgggttcagggtgggaaggggtgtgaggtaaggggacggcttatatccctgttcccaatcagaaatagacatgcactaagtacatagaggttcagggtgccaagaccccctcagcaaaccccagcttttagcaaagaaaatgctagaggacgagagcaactgccagtcaaaattatatgctggaaaggtttgatggatttaatggaagccttcactggtgagcaaaaatagtacatatgttatgtaagagtgataacacaattacctgagtagttattttacatgaatgaattgcagagcaaactgtggcatttgaagtaagatttcagatttttctttaaaacgaatacctctaatgcccaagatcccaaagttgttgtaggattaaacattgcaggccaggtgactggcacgagaaggatatcataacyatcatcttggtcaaaagcacctgaacagccagtccacctgagaggcacgcattttcttcagggtctcctgctgcagatgaggtcaccctggctgtgtcccatcagagccatggacatttcccaaaccaagaaaggaaccctgagaaggcatgagggttgctttcagtcagcagagtggctgcagtaactcaccaactgcctttcttggcacacgacccctggtgtgtgtgtgcttgatgatgtcagaagcacctgggaccaccccagtccctccgggcaactctcaggccccaggcatctaaaagtaatccaggctctgagaaagtaatcagcagtaagtaactgattacaatactttagggacccatttcttgatgaaggactttttgttccaaagcaactttgagaatcccccctcctccgccatcaccaccccatgatgatgatgtgttagagccagcctagaacatgtggaagatggggggccctctccatggagtggtacaaaaaaaccgagtgcagtcatgtttatcatcatattcatccaattattcactctatgttcacccaattgtttcttgcctttaactaagtccaattttttgtttgtttttttcagaacccatctcggcttttgcaggtgagaattttaaaggtaaaaaaaaattttttttttgcatgctttttccttcccccatgtgatgtgaatttgatggggggaatcaacctcmaaatttgtcaaatctcgcaagagaaaagagacgccacaccttcctgccgctagatggcactagcaacacctgtagatgcgggaaggggattgagagcctcactgtctcttgtttaattaaagtttagaaacctattaatagagacaaataggttacagataaacctttcagccttgcattgtccaacggggagcaatgaggctgaaaatgcaggggtggtgagaaaggagagactgtgggaagactgaaccaaaaaaaaaaaaaaatcagtataaattaaaagtgaaatgaggtggcaatgatttattttagcctgaagatggtttctttccagttccagggtaccaaggcagcggtttcagttaaccacagagccgaggggcttctgtgtacagcctgcagtcagtacctgcagtcaccatacctcagtgaggtacggtggcaggctgcttgtaagagaaggaagttaggaaagagacacagaagtggtggcctcaggagaaagagttgccacatttaggacccggtgtccagtcaagggaataaggaggtgcattcgatgactggagctagagcactttaaatgcaggactgaaaatcagaaaggacgtgttctcccccgagaaagcagagagagcagagcaaagtgagaagaattggggatgcttgcctcatccaggttataaaaaaaaaaaaaggcctccagccttgggtgatggcaatgttgtttgtgctgttacaatgcagcagattttacattttgccctctttgcaaacctattagcggacactgctgaagttcccacaccggtttctaatgccaaacatttaggagccactctaaatgcgtcactgcagttggcctgagtgtaaaagcacacacaaaaacaccctcaccaaatgatgggggttcttcatgacctgtttgatgccagcaattgtgaggattgctgtgccctctttgtactggctgggcttacccctacaagtggcagcattgcagagataagggcagccatttttatatctgccgtctagactcgttatcttcactctcattaatctgtccagctctgggctagaaagagatgaattcctggtttgccacctagatatgctccctgactccaaatcatctcacccaatttgccactcatcagctctaagacagccagtgaggaacaaagctgcagacgacaggggaatgacagaccgacatagaatatattgcctttcttacccttcctcgtgtccctgaaccccatgcccactccctgtaccacagttctaaaagtattaagagtattcatgtgcatacactggtgctctctgggggtgaggtttatgttaatgtaaatccaaagtattggaggaaagctgagagccaaactgaacgactttggattacagtcgaattcgagttctaaccttcaggacccaaggtaatgcttatgttggtgaagtgaaagctgtggatgttgtttcgcctgactctctttgggttgtggagactcacagctcccagaaaggctgggtaaagacgtgccagcagctgctgcagacactgttctgtgtgcacaccgtgtcgggccatgactgacaagtacagtggctaagtgctaagtgcttcacttccgtaagagaataagcagaccagggcacgtacactctccttgaaactgtgcttaccatgaggcttcacaggccagtcatgctctcttgtaaaaaatatatacataaaatctcatctgagcagcagtgctcatttagccaaaataaacacagggcttagtaacttgaaggtaagaatttccagggtgctcctggtgggccgctttgaggctaagcaaaggcagtgcacaagttgcatggattaggccatggctttcgtcctggaggatggcaagcatctttgggaagaagaaaccaaggcttggggagcagagacttggccaatggacacagtaaagagcagaatctgaattgggaatggagaatttcattcaccttggcacgttttacatggagatctgagttggtaaccagatgaacctagtgccatgggtctcttctttctggctgagacctgtttgaccacagcatgcaactctgccttgagcaaacttttctgtttgagagaggagaggactgtgtgttccatctaacctagtgactcatatactattcctcttatggtcaggacagcaggagtcctctcttgatcmgggcataaaatcagccttttcactcaaaaaatggaaacagagaaatcagggggcaggcaaggtatggaaagttgatgttgaaacactgccaaccataggcatttacattgttatacatttttcaaattagagtgtttttcttttcccttataaattaatcatgcaacaaaggtaatctcattctttgggagcaatcactgtacaggtaaatctttagtgaaatacaataaaagtggcctttggacctggagttattagatggtcgcaatcttttatatttggaagtatctttcattttccgcctcttactgatttcttgccatgcaatattattttaaatttaaatcatcctgtgttttctgctgtgtgtgtgtatatacatacatacacacacacacacacacacacacacacacacacagacacattgtgtgccaggatgtgagtcagtaatgaagaaaagcctggaagaaaaagagatctgtgttgagaagggagaaagagaagaaagaatgaataaactgtgttgtcatgtgattttttaaaaagacccttttttgtggttgttatgagtcacattttaaacaatgtagcctgggtgtgcattcttttcttttcttttttaaagcagtggctataaacatggtgccgtcatgtatctttttctaggatttgagctttaacaaatgaaaaaccgtgtgtataaaggggggaaaaagaaccgaaaagtggtgtaattaaggtgatggattatttcctcttacccaatactttcttttttcaataaaggaaacaagaacaataaagaagccagtaaaaatatatgaagcccataatcagagttctggggtttgttgaccaggtggttatttttagcagctcaccttggaggcaagagtttttgttcgtgttagaggctgtggtttctgagcagagcacgggcagagagacgatctggtgccctacctgttagagactcacggaaatcccagctgggtgcacctgtggaaggtggttgtcagaggraaggattcagaatgactgtcctacgctagtggatgctaaaaggaacatcaatgtctcccgtttcagctgggaatgtggggtttatgactcagaccattcctaaggtccaggggccccatttctcgggtctccctaggtgcctttctgcagttctccacagttctcatccagacaaaaccaggagaaagtgcacatccacagctgtctcttgggcatagaggggagcagtattaagagaggcccattttgggggtaatgctggctggcatttgactctattccttaggctttaagttctgtttctttggtgccaactggccaatctctgcattttgcacccccttctctcctttcccattcccaccctcaccctctattgcctgcctcccaaggctttgtccaccagggtaaggtcccccatcccagggcctggcctcacattccctttctccctggactcccttcctcccacgcctccttctcctagaagcacttctgagatgcagagagggttaaatggtgcttttgcacataaccgtctgatgaaaggcagagaagtgttcctaacccctgccggggttccagataggcagctgtagtgtgtgaatcctcctccttgcccccacccccttatgtctccagctgccagattaaggctaggtgttgctgagcaagaaagcatggagatcagatgtgtgaagcgggtaactgcttggcggccatccttccccaggggacacagaggtgttctttgtgaggttcgctggagcatgccacctctcctgctacagaggcctgacacgtcccctctccatcagtttaccactcatgtaaacaactgccgaggccagcttatctatgggtggaagaaaatgtttttcaccaacttttctctccaagaacacagggacaagactcagtttacagaaagtagcataagtgccaccaaagagtgtgaagcgtccgagacttcagccagtcagagatctgaattcggaggcatttaaaaatgcctctagatgtgggagcaatccacatggtttctgccaacttactgaaaacatcccggcgcctcccgccacaccatgctcataaggcagatggaaagagtcgtttctcagggatgcctttgtgcttgtgcgtcttttttccaaacacatcagagggcgtgaccacattcttctactatcttctgtaaacttctctagaggagccaacctttttcgtttgtttaatctcacaaattaaataaamctttatgtgaaatgttccttcaccagcacttcatttttaacctgtacagaaaggactgtgcagacaggccagtcctaaaacaattctgacatgcaatgagccttttttgaaagagaaagagagaaggcttacccttggtgtctttcaaaacacttcttctggaaacctgggtgactcccccaggtccagatgatatttcataaagcagctatagtatatgctttctcatttcagagattcagtgagaaactgacttgactgagacacgccaatcctcagacaggttcagacagaaataggaggcagaaaggaagaggactgtttcctcttccctccctacttggttagagcaaggaatctgcaaacttgttctgtaaaggccagatagtaaatatcttgggttttacaggacatacagtctctgttgcaagtattcagctctgccattgtggcataaaagcatccataagcaatatgtaaacaaatgagggtgtctgtgttccaacaaaaattgatttacacaaacaggcagtgggctggatttggccmataggccacagtgagctgacccctgggttagagcacaggctgggattttgtccacctggttctagccgtgactctgacacttgctagcagkgtacagttcctcaggggaccctgggccatctcttgggtttcactgaatgcttctctgcccttctccacaattatcctccaagtgaaaccaggagaaaatcacttgtcctctcaagtactcaggtctccctttggagggtcatgaggaataaacaaaattgattcatgtgaagcccgtagaccaatggttaatacacaggaaatgtccactcagggtggccgttgttacagacacgtttcccaattgcatagtgaccctatttgcagataggaatgaccggaacactacctcatgtgtaactgtttttcttattttctcccatgcctggtttctcaaactttattgtttctcaaaattcaaattctttgtgtttgcattgcttttctccagggggctcagaatttttacagatgggagcctgtgcaaccttgcaaatgcacttggagttcagttattgactatttaagtatctgtttctgattatctcacacaatgggaaaactttgtagagaatctggggtgggaattaatgaaaaatagttcaggaattgaaagtgttttccaggtgaaaaaagacatgtgagtaagcggtagaaattagatcaatcaaagggaaaattcaggtcaacagatcaaccaactccaggcaaggttgaattctcacctacactttcacccacctagcccaggctccttttttgtcaagcaatggctcgatcacccccagatggctgaaggggcaagtgaagctaaaattgcacaactcagcaattcgggcatctggtgcaggtgacatctgcctaaagtgggcacctttttctaatttcccatagaggtgccacatgagctagcaaaatctctagcactttctgaaaataactctccagggaagtaccagtaggtcatcaacattttccagggagtctgaacattggtccaaatatattcccctatgccatccgtccatttatccatccacctatctattcatccatccatctggcattcattggattgctgatgttgtctgggaaggtgctttgggtatggatttaacccctattgatttatcgtcttccttttctctagttggcaaaccacagcctcattagcatacagctctccaaggytggaacagggccagattctaaaccagcacactccacctgcctttggagttgagtctttttagctagtgaatgttctgagaaacttctagcccccagctgcaagtcaaccaagagttgcttgtaggggatcaggaagggtttgctagtcatatcctctcttttctaacattaacgttatttctaacctcttgacattaaaacatgaattcacatagtactatttctcatttctccaaacaaatgcccaaagaaaatgtttaaggagccagtataatgtcccccaagtagcttttgtcactgaagttttctacatgttgataatttcaggggagagaaggataagtagagaaggagaagagggtcttacttaaagtggagtttgtctttcaagtagagcaggattctgagagactatgtctgtgtctctgattctaaatatgtaatccatgtactaggatttcaccttcctccagcaggtccccttgattctctccattgtgccctaacattgtctcttatcgtaagaaacactgtaagagaaacatgaaggcttcatccttctccagcctgagcactttaagccataggttgtgtattttgtgttggaaaccagcattttggctgaaggaaagcagacttttgaacaaagatgatgtagtgatggagggaatgtgggtagttgtgaccatgttctgcttgacaaaaatttctgctcccacctctgtggtctggtcaggtacttctttagagggaaagctaatccctgaggatttatcacctcccttttcttgatgggtgagctgcagcctcattaggggatggccctcactgtggagccacatgaaaatcagagacaaaccccaggacaccctttggggagagaagggatgtctctgaggaactctgggggcatcccttaacactttgatgtttcctgtgcatttttgtaagctcatatcgaaaatccagcagcaggatggttgccaggcagcagatcctcttggtgacctgaataatgaattgacaccagttgactgtgacttgcaagctggccacttcaaggagccatttccagcaccttgctttctcttcctctctttctatgcataatttccaccatggccacaaatatgagagagagagaggcctttctcagctatggtaatgaaactagtaaaagacagaattagtttggggacaaagacaaagagggyaggcaataaggtgggagaagaggaagatgtataaagggacattcaggggatcctgggattctggggtcatttctaccccaggggttgtggatgtggctgtcaaggtgtgtgcagagcaacacatccttgtcaaagctctgccaatgttgtgggacttctggtcacccaagaggtgccaatgaacctgcaccctagcggaaggggattcatacagcaggagaaagcagtgattaagagctaagaagttgagcaggctttgaaatattttccaagaaaaatgttctcatttttctatcacttctgagaagacattagaaggtctgacccacctcccacctattccccagatcaaagagaggagttctgatgttcaggctgcaggaattagagaacacagactcagaaataggagtcttagcctcagttcagtgtttgattcaccaagcatttattgagtgccttctttgtataaacccttaggtatggatgagagcaagttcctcatgatgagagtgagttcctctgcttaaggagctctgaatcttagggtgggtagtgtaaggaggcatgaaaatagaaatgagccccgtttgcatcttgagcagagggggaccaccctctgctcacagggtaggaccactaatgcatgaaggagcccgcagcacttcccacccatggctcccctgctggggcaccccatgagtagagaggatgcatctttccrgcttaatgcaaacagctagggaggcatttttcataggagaagcatatatcatttttcagaagtaaagatcatgtctggttttggcaagctcaaaagctcctagtccctttctgggccagattctcatctgatgtaaatctttgggagaatcaagttgtaacactgctttgcatcaagtgggactccagccagtctttccccagagttaccctgggcttaaatctactacatcatctccatagcaaccggcagcggccagtgaacgtggttgccttctaaatactctgccagcttctcttccctgctctgtcttttctgtcattaagaatgatttccctccctctctctctcactcactcactctcgctctcacataccctctgtcattttgtgcccacattttttttgttgcaacttcccttccaatctgcttttaaaaatcctccatccaattaaaaaatgaggatgcattagtcatgacttaacagtggtgattgacctgtctaggcaagaccaggctaatttcaatgggcacagaagccttggcaagccaaagtggaatttaccttcaagtctagccagcttaattaatacattgttgctgagaatgctggccagccagaccaaatatggtgtttccaccactcaggaaatctgcctcactgaatcccggaagtcatgtcagcatcatttacttgtatgtatttgtgtatgtgtatgtgtgtgtgtgagagagagagggagatggagggagaaagaattagaacacttccatatattataaagtgattgtggttgaacagaaagagaagagatgtgtaattctaccattcttggttgaatcccatacttactatttaactagctgtataaccacttaacttaacctctctccacctctgtttcctcatctgtaaaatgggtctgacaatagctacctcccaagggggtaagtaggaaataatgcaatcgttgagaagtgcttggcaggtgctaaggactgagtaccaccttagtcccccagacccttccctgtatgtcccaaagcatgtgtgtgtttctttctttttttaaattagtcttttgattagtctgcatgctctcagcctagcaacactcttctgtgtctctccaccagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggkttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatctagctctggctgggtttctgttggctgtcattgtcatctccaggtacctaaagaaatagaggccacatgggatgcagtgtggcttctcccatccctatccccaacycacctgacccaagagaaggttcccctagcacactcaaacaagacccccttgtcttctggtgtctttgaaatgtcaagataacagccactgggtgtctgcggaaccacctctccagccctaaagcaaatctgtctcatgttgccttataaaagagaagctcataatgaatgtttagcctttatcagttacatccaatcttggaataagtcatagagaataacaagtctgggactgaygtaggaaaaacagtagtctgtttaagttgagaggaggaggaggtggacgagagaagggaggagagggaagaactgaaatgtctcctcacccagggtggttattgggcccaacttggratggggttgagtacgaaggttaaaaaacatatactttggtattatattggtcattgtaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatactgtacaaaggatggattaaataatgaagtcaatttcattgatagaaaatgcaaattttaagattctcagtgtatgaggtctcagcctcgggagcatttattttttactttcctgctaaaaatccactggggaggtataaaattcactccaaagaagtttgcctgggccaaaagcctccaggttccttctgagaacaaaatactaatgattttttttttttttttggctgcttgggasagactttcagcattctttcacgatatccagatatgtcccttcagcacacacactcaactttctcatctggttcgtttcatcctcccgaaagaayggtgctctcccactcttactctatttcaaagagctactctgtctcaaccacagcagccctgccaagaaaaggcaagatgaaaggctagagcatgtgctaccttgagatttcaagaagtgtcctacctcagctgargatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatatascctgatgattccccttctgtaacagaaggtgacaacaactttgtgaactttctatatctttatctgatgccccaagtggcatcwtctttatgtacatgccttagttgagaatatgagactgctctaatctttgtgaatgccttcacacttcagctgaggatgtcaccttctctgtcactccccatcctgcaacctctgcctttgctctgtctaccccagcaattttcatagtgttatccaggtactgtgctaaaaggtcagctcttctgtaaaatgccatgcttcgcagcttcaaaaagcaaaattctgtatttcatggagggagggaagggtcattctcttctaagaaaaatagactggacaggcgaatgcatgcatgcatgtgtttagagttgcttctcagaagacaaagagatgatagcaactattaaaatatgaatgaatgaatgagtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagttgatagccgatctttaagaagaccctgtctttaaaatgaaactagcaggcaaacacctaaataatcgaaaattaccaaagaacaacaacgaaacaagaaaacctaaagatttttacttcctattcttattcctttccttattactgtgacaccccttgcattgctcagttgcctgtgtgtcaaaataacttgtggacgttggaaattatttgaaaatgtattgtgtggaatgtaataaaatgatgatatttttatacaaacatgtgaggttttttttccctttgcctgtgagaacaaagttgaaatgtaggctttgagcaaactgatgcttccaaagtttacacatcaccttctgagctacagggcatttctgtgggaggtaggtgggttttctccttgaggctgaatgccaacttttccttctttttatttttattactgcttgttaggatttttatccaatttgtgcagctgagacaacttttatgattggtgtgggattttgcaaaagttgctaagtgctaaattgctaaatgagattccacgaaatttctcttgatgacaaatccctggagattagattctactttcaaagsgctccgggagagtggtaccagctaagctgaatcctgtacccagctctgcagagacagatcacttcctttgaagaarcagcagtgacatcttacccctcacctacccaattattacttccacagggatgtgaatctcccatttacgagcgctttcccagacaaaacgggaacttgtagcatgttcagggctgaaagatattctagacttcatttttgaacaggtaatgaagataattagatgatgactgtggacatagaactatcagagtggaacattttatgaaaggaacactataaaactttgaggagaggcacttggggaaacttactcagaaggccaggtctttcttgatgagtatttttctttggtcctcctctttagatggtgaccyagttatataaaatatttctatcagaagggaactgggttgggccaggtgggggaaaatctaggaaaggcagcctcccagcasttcatggtttctagatagtggtcaagaagaggtcacattaatcctatttgcagataggatttcccaccaaccccattcatgggatttatcagaggccttctgacaacctgggagccctcctcaggggtccgagaaccatccttaaaggtcctgagaaaatgtacatgttcagaagatcctatttctgtcagagtcctgcttttcatcctatccaaacctagatccaggaaggagtgctttttacagctgtaaaacctgtccaagtgctgctaaaaggagacaggcttccggtttttagatcttacaggaagttctgttagtacagatggttcagtatagatgtcactatctgtcccttgcaggagaataaagtagaatgtcagtgatcagagcattttttgtktccccagtgacaagctcaattaccccttttgtctaaataacatttggctttccttaaagccatttgttcccattagtaaagaatgaaataaaaatatctcaaaagtgttgatttcaaacaaagacccaggctcagtcaacatttccttgagctgacctgggaccaaacttgccggactgaactaaattagccatcacttatgctttgttggcattactgtttttggaaccatgtttgggaattttcccaccttggttctagtcccaagacttattttaagggtacttactccccctaaaagggcaaggactgttaggactccaatcttagatgtcaaacagggcactgttaccaccaaacactcctcagtgtggcatttcttatgtagcccaagcataaatgttcagaaattttgtttccatggatcataaataccagatgtcaaggcctaggccggtctgtttctgctcctacctggttctttgtgatggtttcagtgtgtgttctctcttcacccactgcccccctagctcagataaccgaaacccagccaagctgaggtggcacagtgtttattttccttgcccctcttcacggcctctgcagttgttctgcacaaacgtgtggcctttctgtaatctctgatgaaaagagctacatcctgaagttttgacttgcctgcattgtgggctacacatctgagccaaactgcagatctgtaggtgaaggcttgttttttctctttaattgtgcagatcactggggctctcacagctgtaatttgcctttcatacactttagtgacagcccaaagaaaacacaaaacaaatccaaccagagaaaaagggagggggcgaggggaacaccagctgatgatcttacaatcagcagggaaaagaattgcctcatacaaataaattagtagctaggaatagtgtaggatttaattaatcctgacacagatcaggtgcaccacagtatgtatagaggtcagatacaatcagaaacccacacccttaggggtcttcaggccacaagcctgggccagagtatgtttgccctgactgcttggaggtgttctgtttggacccaaacctaaacactgaagagcgacaagatttgggaaatcgccaagagcaaaaccttatttagcatggtatggaacagtggagaatctaggtgcttcagcacaaccaagccgaagccattctttccccaatcccagtggataacagacctagaatcatctcctctctactgggtaaaacagttgttcttggccttttctgccactgacccctgagagccccaaaaagctaaagtcccgtgggcattggaccaagaaataggaaagaccatttgaacagtcaacaacagaggtacttgagggaggactgagtgttatgtgggaaaacctcttttctcggagtttcattgcttgagagtgtattgatactgatgatacagggaggctgctggagggagactttatagtaactggctgggtttctttaactcacaagttaaacatgctcaaaaagtgcaataatacagaaaaagccaaagtcgatttcattgttgaccaatcccagtcacctccccagaggtaactgtgagggatggtttgaggagtatgtttccaggccttgttttatacctttacaaacatgtatgttcatgttgagttatgtggtttggttaagctggggtttagtttggtttcatttggttttgtgtaaatggtagcacagtgtttgcttactatattggatgacttgcttcttttcatttgacatcttgagggtaattcagtacatactaatgcatctaccccatcctttatatctgcagcatagcattccatattgtgttgatatgccagagtrtattaactgctcccctgttgatgagtgttcagactgtgtctagttttttttttttttactattataaacaatactgcaatgaacatccttgaaattgcttctttgggcacatgttttacaaaggatagaatttctgggtcaaacacatccctgttttcattttagtaggtgctataaaaggctgaggtttgccgtttaaaattaacctgtccctgcttgagagcatagcagaaactagtggacgtcctggctgtagagcccctgccacatctgcccaacccatgtgatctctatgcctatctctctttctctacagtgggtgtgttgcttgcaagagaagaccttgggcacttttagctgaagataattttaaactcagggagtgtttcttcagaacgttcttttttttaactgccaacttacggggaatatggacctggctctaagtgtcagctccccagagctgtggtggctgtgtcactggagttaattctgtccctgggttcatcaggcagagtcctgttctccatgattaatgagwtccacttgctttcttcaaagaatgcctgtgctgtgccatgctgttatttatttatgttttctactaaaaaatttaygtaaaaaacatcccttaaggtcagtatgcagtattgtgctgcagactaaactatcccagcagccagaggtaaacctacacaccaagaaaaagtctcaaatttgagaggccttggaccacaggcccccacactggccccaagaggggcagaccttgtgggcttccttctgaggaagttcagggctgcaatacccaaaggaaaggcactaggcagtgaggtggttttctagtgggatgtttataggcataggcaaagctactagcccccacaggggccagtagcaaggaatggcgggtggaggagaagcccagagacctgtcagtccaaacaccatttctagcaaaagcactgccctcatttctgtggtgtgctgagagaaaagtgtcataacaaagtggctttgactttgaacataatggagtgtgtgtggctatataggtccagtgtgtgctttccctgacctgccaaaaatccaggaccattgcctcctgggcatgaggtatgagtatttaactcaggaaagaaagcagcatgagttgagatctggatgaactagagtgcatctctctctgacacacacacacacacacacagtgccttgttttgtcttctctgtgtaattgcgcaaaattaaatcctttaaatatcacgaacattccccaaaacaaaggctctgctccagaattggaatgatagtataccatgccacggctttcagcaataccagtttctttctccagcagcaggactcattaacaggatgcctggactggacttccctgcaacttattaaagagcagccagctccagtaacgatgggtgtgcagaaagccttgagctagaggcagccttgaccaaagtctcattctccaaagcctgctagttattgaagcttcatttaagcacaaagaaactttttgtctctttgtgttttcttgctgccacccagggcctgcgagaacaggcatgaggatttcaggggctggtgtgggcctccccatggcttctctagggcagccccacagctggcattgagagtgagatggtagttattacaacctagatggggccaacatgggtgtgtgaaaggagccccagagatgcctcattcgccttggccaactgtggcctaagaggatgagccccatattagtgtttacaggggtcctgggcccacaaacccaycactgctttctggctctgcacctcctgatgtggctagggtctccacctctttctctgtggaggagctggtcaccactcatctgcctttgtgccaggtgcagtttgtctccaacctccaaaatcccctttctgcaccttccccttctcttgctgaccccttttcttctctggcatccttacactttctctttcccttcatccatcaatgccttcttcaaaaaagcatgggtcagattccttcacacaaatgccgcatggctacttcctccaataattgcatttttacaggggaccacacctgaagccaggtctcttagtaattacggtccttggccaccagcaagctrttgggggaaatcatctcttgaatgggcagagagaggtacatttttggtagctgtaaartgatatcacagagtcattcattctcattcattcttgtgttcagaagaagagcccatcttttaagtacagtgaattctgttagtgacatacaggtgtacagtttcttttcaaggacctacaaaataaaaggggctatctttcagaagatattcttcttcacattggaaatggatgcagttttgattcttcaactccattttctcacttgtccaaggttgtaccaaaccactccatctgagtgacatagtgatgtttctaacatccacacctcaaatattggaactagaggaggggagaaatttcaaagcccactggaaaaaaactccctgaaatatgaagatacatgactttttcccctagcatcccaggaaaaaaaataagactacacaagagggggaaaaaacagcaggttttccttgaaatgctctgtttttcccaccctcatgccctaagagaaggtagccaacaaaagaaatgaaaagagccaattgcttgttcacatatctacttacaacaatggagaatagctgatttttcaaagacttggggtaaaaaagaggttctagaattttctttcatcagctttgctgtgtttttccagtctgcacaattgtgaagcctatctttatagccaaacatgtctctggctgcatttttcttcttttcatgccattgttggggctcattggagacattctggcctcagctgctcatccgcctccacacttgaaagtattactaggtcatttcacagtcttcttgtttgcagtcagtatttccaattctttttagtgtttccttctagttattcaactaaaaataatagaaacgaatggctaaattcaagatcaaactcttccagtaatctcacaccaagccccctccttttttttccgcacttgaaaccatttgaaaaattccaaaaaatattttttccatgaccgtgcctagatttggctgtagcccaagagataaaagcctgtgataaaggctcttctgatggtgcttctaaactcaagccaaacccagcaaggaatgaatggctctcaagtagcccgacttcttaacagaggagatttggcaaagtttagatcaacacctgaatgtttggctccttattgcaacttggatgaacaaactgaattgggaaattaagtgtggtggggaaggcggaccttcagccaatactaaatattaaactgaattaaaccgaattttgaagtgccaagaagaatctccttagtcctttgttatttatcttttactgaggtctcagtgttgtatttcctgctgggattaaaagagaatggctgagagaagtttctggaggctactcatctgaaaaatccagcgatttaactggcccatggggttcagaaacttggaatcaagttcaacaaaggcactaagtggccaagagcttatcccaaataaatcacagcccccaaacaaggtgttgaaaatctatggcttactctcagttctactgctgatttattcaatgacttattgcacttctctaccctccctcctcaatttcatctctaaagtcaaagtgatgacacctggtacctgtgaaaatgaatgatttcagtggtttcctgtgtgtaagaggctcttcgatccttgccttcaaggctggttgaaatgtggtaggttaagtggatgtgctaagactggctttccatgaggttttctcagcccagcctcagttaacacagaggcttaaaactataggcacaatttacccactttgtcagttcctcagtcaccaattagcaggactaagtcctgagccaaacgggcaagtattgaacacatagaacctcatgggttctcttgacctgtcctttttgtggtcttctctttctgtgcacaccttaaaacaaatggtttcagggagtggccactcccaggagaggacagagttagggtgaagaatggggcagtgagcatcatggggcaatggagcccttttgttcagaagttgccttgtctccctcaaccatcaccctcttcaaagaaccctcatcagaaaggccctcgtacctttctcatttccttcctgtaaagacaagggaattctagaggagaggagagcatcagtgtttactttacagaggagcaaacagagacccagggaggtcaatgactggtcaaggctctgacacctgaggcagaaccacatgggaggtaggcattccgcccccagcctagggccctccacatcccacgccgcttccttcagtgcagggtgatgctgccactgaccaggcttctgagtgtctctgctgtacactccagatgacaagcctgtcatcagcttcaagcagacctcttaatccactgctcagggttggcatggaagggactcttcaaagaaaccagcacattagtgacctgaaatgatctgtgtcccagggctgtcttaaattatttacccaaaagtaaccagtggtttggggcagacttctcactttcctggccatattgtgaagctcctttacaatgcgggaagtaaacagtgtcgaggccaatatactcatacaatatgctstgtgtagacacagagcgaaggctgagaattttctgtaagaaactgcagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtcagagaaagagagagtgagaaagaatggaaagggccataagagagggccttcttatttgaggactaaatcattctcagtaggaatttccaggcagcaggttggagtgtcttgggggtgtttcccctgagcagcatgtgtggtcttacactaccaggcagtgttccagggaaaagcttatttcattagaagaggttgggtttgtgactggatatggcgttcaccctttgtgccgtagtgttgcaatgtattgacaagcacactagagaatatttgactcttccagggtggagggtgtttctggaacagtcttgtgggtgttttcataactagccaccctggtctctcattccaaaaaatcaggacagcaggagatcagtgagaccttgaatcatgcctcaccgtgtacctactctgtctctcgatgatgcagagagaagggacactgaccaaaataaggtgactttttggcctgagactgatctycatatgaaaatgaccagagttttgtgaagttgggttgtatttgtttttaagcagtagctactgtgcccacttgattactcaagctctgtaaaaccccttcccatcattcattcagagctgacctctttctctcactgtgctgatctgcaacagctggggaagggatgggtgttggagatcgggarggcagaggtctgactctcacatagatatatgcaaggtggaagatttgtggcaaagctaggtgatcgctttgaattccttgatgagcctgatacgaatgaatgcaagccaaaagacaagagatcaggtgccatgtttgaaagcatttctatcaatcagacagataaagggaacagaaatcccccgatgcccaacttgcagcagcctcaattccacagtatcctcctctacactcccacattttccttcctgatagtggcccaggctcatttgcccaatccctgccctggactccagcagcacttgggagtcctctccgcaatgcctcactttctttcatgctaatttggcatgggtgagtcttcacttcccaaccaccctgaagggccttgatggtagacacctggtcccttacatctttattttccaaagtcatcagtttgtttcctgggcatgcagtgagccctcttactaagtggtgttaggctggttagttggttaatgaaaactgccctttgaagaacaatgtaatttagtttcctgctctgggtgatgcctgtcatggaaagcatgaaaccccaaatttcagatccccacttcttcatgttcatgagaagcccctcaaagccctactctatcaaagtagtgagccagtgaaacaggcaaccaaagtgtgtatccagccaatccggatctgagataaggcagactcttttattttattagaagggggcagtagggatatggtggtagttacagtgtcccagccacacccaaagaacttgaatgcagactggggatccaccctggccctaatacagttatttgagagtcagtatttgtagtcaggctgacctgagactgaatccacatgggggcctagaaggaaacagggtcatgggagcacaaaggttgaaagcggaactcgtgtgggtggtaagatcccttcctgacctgcattcttctagaggtttggmccattccactctccctagcccatctcacactcaccaacacacccacccactaaaacagagtcctggaacttcctcttcaagttttccccattgaaaacaaaattctgagtccctggttcctttctcccactctctcctgatgtctgccctgacttcggcagctaggtctgccatcctgtggctgccatttcccctttccagggagctgtggcctctaccctctgccttgggctcctagctcatcattctcccctctgcctcccagaggccggtagctttacccgttggttctcctggtagcatcttacctgccacascttgcctattctttgctagaactacagggacctratgagagaaccacattccttcctgctggcctcctaaggaaacaggctgcagtttacctaccaggctcaacagaaaaggaaagtggctggtaaagggcaaagatgcttttgagagagagaaagctcttaatcaaacacagatatcaagaatattagcaaggggactagagaaaattgctatcaaagtaaatggttttttgtacaaatgttccctttatttgtgttttccccagtgtgccattctttctttaaggcttggtgaacagatgtgcttttgaaaatgttgattaacttatcctttttttgacccccttcccactcactcaaactcaggggagcagtgattatataaaaagccaagtcaagccactaaagtgttcttcttcaccttaagtagcctttgattctccaggtgcagaaatctcagctgcatctgggcaattgatttcattgagtcttagaaatgggccaattcttaggaaatcatctcatccagtcctcaacctccagagacaagaggccgtgatctcctgtgataaaatgttctcaaaatcattagcatcattttaccctttttcctttaagatcaatgccacattcacccctttccagccagtgatctatggtatcctaagacttcttccctgagggtgtgagatggagcaagatggcattctagcctccaagaattcatcacatcctkggcagaaacaagatccctaaaagcaagcataggatttggcccagaagtcactggcaggagccccgtggttctcatcctaggctgattcacatattcttatccagtgttctgcctcttttactggtgaagatgttaagacatatgagcagcccatcaaaccaattaattgttggaaatgtgayggttttcttccatgttttttttttttttcatatggaaaaaaaccctgtgggttgactttcacaagctcgatttgatccctgtgacaaacaccaccttcctcttgttgattcatgttcacatctcccttccaaggaaacaacctgctctgttggggcctggaggagaatgcagggaatgggcgttgaggtggggaggctggcgtggcctgcaggtgccacttgctgtgctttaaacatgcaaggaatgggctggagttatggaggattagtgccatgtggcatcaatcttttaagtggggtcttggcaagttgttttgtgcatcccttactagsgaccgagggggatgagaatgtgctttagcactttggccagaaatgagraagacttctaacatgattgaaaccatggcctccaggaaaagactgaatttcaaatgtgacagtgatggatcaatgctcagttcrgatcatggtcaagtagatcttccccgagatgtagtgctgatgaaggaagctttcgggatggtctaaagttctttttctccctcttgtctgatacttcagccgtttgggattttgattttcttttaagccttgatttttggatttcaatttatagtagtgacttcaagattgtttatctgacttggtggaacaaaactctgagagggccatacacattcactggggctgtcttgagctgacagcttggaaaggcataattagcttgtgagataggaagaaatgataagatgttgctctttgccatgcatttgatgttctctattaatgttttaccattttagacagataactttcagtggttstgatttctataagttggacagcacagtgaatagagagacctgtattatcaccctcccaaattatcatgaaaaagaaaaagatagacagtgataatactggagaaaactcatagtaaattaacttagcctggctagtcagattggatgcccatctttgatctattctaaaccacgaagaaagctaataggaaaaatagacttgggaaggatgagaaatattagcacagatatgtgaaggtcaacaggcattatgacatgccttccatttctgctcttaaattaaaacatataatgatgaaacaagacttccttaaactaccatatgtttacatgaaatccagaggagaaagactctgatgcttttgtgcccactgagatgcgtgcctatgaagaggtgcagcatgatacactaaatggacatcccagtaaaggcagctgctgttgggcataagatgccattgaaggtgccttaaatgaawcctgtgttcctaatgaatgccagtcattaaaaaggcacagtggcaggggttgcttggcactgaagacccagagtttcttcttagttctgtgttactggttgtggttggaggaagacacaggtcatctgaaggagaacaatccagtaatgtccataatgaatgatctagaagtagaggtgattctctagctgcctgccagaatggggagtcattctcgtaaagattgcctccctgccttttagccatggtgayagwacttgttattaacttgtttttattttctttatattatagtggacatcccagaaatacatgagagagaaggatatgaagatgaaattgatggtgagtactgttatgatttagcaggtaatcgtaaaattcaagtttggttataaaggtgtcaacaaaaataatgctctgggtatcggagggcccaaatctagaactatcagtcagaaatatataaaagaatctggagaaaaatgagggaaccatcaatggatctgtcagggtcaactttagaggtttagaaagtttattgagttcctctgcctaatctgaaacagatcccctctttccagtaactttttacctggatggactttgaatctgaataaaccctttacaagtgaaagatcagctcctccatacgtgtcatagtctgaatcttttgaccttctcccaaaaatggcctgagtgaatgagcataatgtgaatattctcccagacctgctgtggtttctggttccctggcttgggggaaaccttcctcacactattcaagattccaatttggagcttcttgcaagatttcggtttctttttcacactgaccatctcgtatctttatatttattccaagttctatttttccactgcaaacacatatacttcaagaggctagagggctgctgagcaaatatgtagatgtaatttcttccctcaactcagaatagcacaggtctctctctgggcttctctgagtaccagagttgatctccaacagactcaacagcaagattccacttaaagaataactgtagactaagattgatgaatttaagaggaacagtttatagagcagctgcttttaacctgcctttaatcagaaacttcatgcgtagttatagaaactggagtgactaacccaaacagcaccttgttaactgactgcagactctccctgcaaaacccagtccaacactccttttatgggcaaaagtgcatgaccaacctacatggagagaccgcagtagatcaggcagaggcgcactggaatggagtagaaagggcaatgggtaaggaggcagaaagcctgatctccattcctgctttaactgcttgctaagcctgtgacctggagtgagttacctagttgcctaatttctttaaacctcagtttcctcacctattaaaatatatataatatcctgccttcttcatgggattattaggatatttcaaaaaatgatgcccagatgtgggcatgccttggccacagtgtagaaacgtaattagattagtctgctagggcttccagaacagagcaccactgactgggtggcttacaacagacatatattttctcacagttctggaggctagaaatgtaagatcaacatgtggacagggttggttccttctgagggctgtaagaaaggatctattctagctctgtctccttggcttggagatggccattctcctgttcatacgatgttctctcatgtgtgtgtctcagaatttcccctttttctaaggataccacttttatcggataaaggtccaccctcatgaccttattttaacttgataacatctgtaaaggccttatctccaaataaggtggtgagggttaggacttcaatatgaatttaagtgtctgggagggggatacagttcaaccagtaacaataaggcacgatgccttattattaaaggaggtctgatggctgggaaaaatctgctgcttatatggccaggaataccaaattaggaaactcatcatgtgcaaatagtcccagactgtcctttcattagcttgaggaggttggaaaggagggatgtagaggttgccttgaacacaaggccatcctaggtgctgtaaagccaccccaaaggtgctgttaaaatcagagcttacctaatgtaagtcaaattatttatttatttatttatttttttggagacggagtctcgctctgtcacccaggctggagtgcagtggcgcaatctcggctcactgcaagctctgcctcccaggttcacgccattctcctgcctcagcctcccaagtagctgggactacaggcgcccgccaccacgcccggctaattttttgtatttttagtagagacggggtttcaccgtgttagccaggatggtctcgatctcttgacctcgtgatctgcccgcctcggcctcccaaagtgctgggattacaggcgtgagccaccgcgcccggcctcaaattatttaaatatcggatacttagtacttactatgttgcagacaccaagcactttacaaatattagttcatgtaatcctcctaacaacccagttgaggcagattttactattatccccatttcaaagaggagaaaactgaagcaaagagaggttcaatagcttgcccaaagttacacagctaggatgcggccaggctgggctttgaacccaggcagtctaattccagagctgctgctgctaactactgtgctctgaagagcctctgggctggggaggctcagtcacttcaccctgacataggcagtgcctgcaatctctcatgaattttatgtatcrcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagytcccgaagctgcaccacactggagaactacaacttcgagctctaygatggccttaagcacaaggtcaagatgaaccaccaraagtgctgctccgaggcatgacrgattgcacctgaatcctatctgacgtttcattccagcaagaggggctggggaagattacatttttttttcctttggaaactgaatgccataatctcgatcaaaccratccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgwattattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgsagggctacatgtagataccacaccaaggctggaggctgstctgtcrtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagatatttttctgcatcgtggtttttttttttttttttttctctgcattgtctttattggagacaaacagatccgggataagggtgaccaaattgtcccactttgcctgagactttttcaggtttttagcactgaatgtcctgttgaaataggatagttccctcaacccattcacaggactcatgatagggtggcttgcttactcagcctgcagctctcaaccccttgtgggagggggagaacacaggagagcaggcgcagaggccaggatgagcacttttgggcaaccggcaggagcagaaccctgtgcgggcctgcggcagagtctaggggtcgcccatgacccctggagccccagagggcctgtgttacagtgcgctcttctagctttgccatccacggatggcttaagtgttaaacagctcagtgtagggtcatgatgacagcctcttgcacccacactcaggttcttgtctagcatccaggaggaatgaggtttcacaaatttgaggttggtgaatgtggaggattttatttagtggtggaagtggctctcaatggaatggggagctggaaaggggatggagtgggaaggtggtcttcccctggagtttgggcatccctggccaaactcttctccgaggtcccgctaccaagttgtccctctgaagtcaagctgcttctctccaacatctggctgctgcttctctccttctctgccactctgccactctgctgctctgctgctctgctggtggggcctggggttttctttgggtacaggatgggggacagggcaggccagggtggttttagaaaaggtaacattcaggcaggaaaacaagaatgtatgttctcactttgggccgcagtaccaaagaagagggtggtacccttaccagataccaccctcttctacccagtatttccttgcctcctgtccctatcactgtgtcctggaaaaccctttgtctgagtgagcttggtataacagactaccacagacttggtggcttaaacgacagacatacatttctgacagttctgatggctgggaagtccaagatcaaggcaccaacagattcagtgtctgacgagggctctcttcctagcttttagatggctgccttctctctgtgtgctcacctggcctttccatagagagagatctttctgtcttcttcttctaataagagcactaatcccatcatgagggtgggacataatgacccacctcatgacctaatctaaacataattacctcccaaaggccccaaatcctaataccatcaaaatggtagttgaggctttgatgtatgaattttagaaggacacaaacattcagtccataatacccctcgatcctgggcaaactgagatggtaagtcatcctcttgggataatgtttcttctcagcatttgaagcagtaggctaatgggcaggttggcttcttataaaatgaagatagtgtgggaatgggtgatgggccatctggccagatgggctactttaactcagagtcctacctggtagacttcagaggctgtgacctgtacaaactcttcctccctggacatcaccaggccctgcaactttagattgtttgctccttcctttgtggtcaaacccttgattgtcaatatctctggtggtttcagcatctgtgatggtgcttctcaaagtgtggttcttggccagcagtgttagcatcattggggaacttgtcagaggagatgtatatgcttaggttccatcccagatctactgaatcagaagctctgggggtggggtctagggatttgtgcttcagcaaagcccaccaggggaatctgctgctctttcaaatttaagaaccactgatccagtagaaatgaaaatgtttgtatcctcctaaaattcctacatcaaagcttcaatccccatcacgatggtattagaccgtgcggtctttgggaggtgattaagtcatgagctgggtcattaggtcccaccctcatgatgggattagtgcctttagtggaagaactatcctggcctcaggtgactgaggtgattgaggaccttttcacctattggttattggattcaaaactacctaggtagtacaataagttccctggcaagggggagggagacacttcattatgaacctccctccccatggaagctctgaacctgagccaaatttgccrccatcctggggctctgtttaccctgaaaaggaaatttgtttcggtctcttatttaagaaatgtttttgagcagttcctgattttgtaagctcttagagcttccactcagggaggggacgggaagcaaacagccaaatgcaagaacatgatcaacaaaggagaagggctggagatggggctgggaaggtaaagggccaggacacactgcaccttaaggccccagtgaggaagtgctctctcttctgtatcattcttctgctctttttaattgataaaaaagggcagcccccactaccacccattcctcactgaccaataatgtcaccatagtcaaatctctgcaatttccctctttgaccctcctgtgatcttacgatatcttgtgtatcctgggatgcctgcttctattgtattactgaccctagcaacaataacagaggttaaaatgaaaacaaatttcttctctcctttagttgagcttttgggtatttttaaagccctaataaactaataatatctcctggtccctagccagcaagtgtttacataagacctttttttttttttttctaatctacatccttctggaaatgtttacatgaaactcaggggaggcaggctggccagtgaaaygaggttggaacaggaccatggttgaagaaaacaggacccatctggatgcagaggccgcctttgcccctgtgacgttggtggtgttgatgggggtgtgggagggaacctgaagaggttgaaagatgactcaatttcagttctcacagccttcaggctctaatcccaggctgagctaaacaaaactcttgggaaaaagatctctccaccgggggataaagggtgtgagatggggagtggggtggtgggagggggtgatggtcagaacagcaaatgcaaccagtggtgggggctgagagctacctcaccatccaccctaggggctcacagtaacttaacagtcattcccatcaacacaatgggaagagtcctggaagcttacaggtcgccccaggctgaggcaaaggcagggcttgcccctgaattcctatctctcagaactcttgagccaccttcgcctgctgcccaccccatcttccaaggctggtcctcttccttcctgagttttctcagtgaccctcagaggcagttcctggtggaaagacaatgcctctcatgttctctctggaggcccaagcaagagacctccaagggaactaagaaccagattacttctgcagctcatccagagaataacacctgtttcctcacccttccttgtcagaaaaccctataggacaagtgtgtgtgcgtttgtgtgtgtgtgtgtgtgtgtgtgtgtgtgtgtgtgtgtgagtgctgttcctgtcatcacagttttacaagtgctgtaagaaaaggaggccttctcactaagaaaacatatcccacctggccacagtgagtctgagccctccctcaacccctctcctacacagtggcaccagtgcaggagggtgccctctctgcagaggacacagcccagcccaagcagggcccacacagtgttcaaaccctgacctgaggccctgtcaggctcacgtgcacactgaggtgcctaggcctctgcagaacgcccttcaccagtggagaggcaaagccctggggtctgggcattcaacatgtgaggatttggggtgcttggttctaggtcccttagcaaacccctcactagaccagcaggccctggcagctgtgttcaggcatggacccttctttacccttgagactctaacagcctccccagaaacagtgccgttcagtctgcaaggtgcaggctgcagcctccacagcccctcaggcttctcagaactgtctgcagggccaggatgccgtggtttggagcatagccccactaattaatctcatcctgaagcccttgactgcctccactgggaattgaagcacagccttgctgcacctccgccttgccaagcctcaggcagaactgcccgacagggccttgactccagagagggtggcaggcggcctttctagatttgccttctgtcttcaccttttttcctcctctcacccctcatctcatctcgccttgaacattcgtgtttctattcccagctgactatttttaatgcctgtgggagttcgaagaaagctttgtagggttttgaaatcccccagtgctcctttccccttgaatgtggacatgacgaggaggcggagagcactgtctcagggcttgggagaccagggttcaagattcggttctgcctctgcctgtgtgaccttgggaaggccacaacacatcttggctttcccatctgtaaagtggatgtttgggctacatggattttgagccctcagctatgctatgacatcctagtccatggggtggttctggctggttgtctgtatgtgtgttgcacagcccagcaaggcaaagctctccggatgctcccttcccaacattgtctcaggcgcccttctgcacagacggtggggatggcatctttgggcttgacttgatgttatcgtggagctggaccccaatcccagctccccagaggcagaactgctcttttccccagagcccttcattcctgtctactgacatagaaactgacatgcatattcatcccccatgacctcttgagggaagaactgatgtatccattcatttatataataagcctattttagattaaatgcctaaactgtgcctcgctaggtgctaggagacatgatcagcaaaacaacctggttctgtcttcggggacttacagtctggaaacacacaagtgaatcaggaaaccacacaaatataacgatatggcaagagctccaaagcaaagtgcagagagctgcgcgtgtgtaagcagggacctgagcattgtgtcttatgggagctgaaatcctaggatgagtcaggtgagcagggggagaaggcaaagatgctgaagccaaaggaaacttggctagagcgaagtagggggtgaggaggaatgtctcattcacctttgcatcaggatccccggctcacacctggcacctactgcctgtgcataataagtatttgttgaatgaatgaatgaatgacttgtataaattcccctctgacaggcatcaagctgcccagtttgtacagactaaaagataagtgtttttgttcttgcttcttgctacctgttcttcactgtagtagaaaatgtgcaagtaaccttccaggagtctgtatggagagattatgccataagtttcagcatggaaatgggcactattagtytctgcttaaatatgataatttaggctaaatataatattcagattaaaattctgttgaaacagttggaaagttgccagatttagcacataaaaatgtcccacgcagccacagtatagcagttcctcaaaatgttaaacatagaattaccatatgatccaacaattccacttctaggtatatacaccaaaaataattgaaagcagggactgaaacagatatctgtgcactgatattcatagacacattattcacaatagccaaaaggttgaaacagcacaaatacctatcaacagatgaatgaacaaaatatggtgtgcacatacaatgaaatattattcatcctgaaaatgaatgacattctgatacatgttaccacagagatggacttcgaaaatatcatgctaagtggaataaaccgacacaaaaggacaaatatgatatgattacacttatagaaagtacctagaataggaaaatttctagagacaaagagtagattagaagttaccatgggctgggg

SEQ ID NO: 12165 - DNA, 59832 bp, Homo sapiens
aataaataaaaaaaatagtgtaatactctgcctattttttaaaacgaactatttgtatccaaggaatgcaacttaattttaataaatcaaattgtgtttaacactcaccatcatacagcactccactgtctcaccatcctctctctgcaatattgtttcaagcatctttaaacagacaagtaggtttaccatttctggttgcagggaactagtgggtgcacctctgaatcacccacaagttgatcttatccatagatcaagtcttaacaccatcttggaamaaagccctacaattttgtttgtgcgattacagtgtgtccagcatagtgtggcctcagactctgtgctgtttatttaagatgctgaaaaaaaatgcgtgaccagatcagtttccatactgagttgagctcttcacaattactattagagatttacagatcaaaacaagaattctgggcagatacatcaggctcttgctgtgacattgcacgtaattctgtcagtagacaaggctagagagggtatacttttatattatattaccacataaaacaagctgtaattatatctctgctactgagcaatgcaaaaccaactcctaataagcaccatattaagactaacagtaaagctgctgaatgaaattcacaatttcttttgtggtagtttttgttctttgtttgcatctcactattgttatayagtcacgtcattttgaagttcttcacaacttaagaagaaagtgtaacaattgaattaattattcaaagttcactttggttgcaatattttggtttgtttttattctgagggaactggccatttaatattggagagttctaagttcttttttgttttttttagacggagtttctctcttgttgccaagctggagtgcaatggcgcgatctcaggttcaagcaattctcccgtctcagcctcctgagtagctgggattacaggcatgtgccaccacacctggctaattttgtatttttagtagagacagggtttctccatgttgctcaggctggtcttgaactcccgacctcaggtgatctgcctgccttggcctcccaaagttctgggattacagacgtgagccatcgtgcccagtctgagagttctaagttcttagaaggtggttgtgtttacctactaaaattttattggtagcaataatcatctaatggaaattcagagaagtgattttaaagatttgaattccaaaaccctatacaaacgttttattttaccaccaatgaatttatctgcaacacctgagttgtggggcggaaagccacccaggtgccgaggcgagagaccgagggcacgagctgttccagtataataaagaaaatatagaaaataagaatagttatactagatctagatcatagatatgattatatatgaatatcattaatcattagtttgtagcaattaccctttattccaatgttataataatcctcgctctacaatcataacctaggaaaaaccaggccatacagagataggagctgaaggggcacggtgagaagtgactagaagacgagagtgcgagccttctgtcacacccagacatggccactagagggctccctggtctagcggtaatgccggcgtctgggaaggcacctgttacttagcggaccttggtctagcggtagcgtcagtgcctagaaaaggcacccgttacttagtgggccaggaaagggagtctctctttccccgggggagttagagaagactctgctccaccgtctcttgtggaaggcctgacatcagtcaggcccgcccgcagttatccggaggcctaaccggctccctgtgatgctgtgcttcagcggtcacgctcctgtttcactttcatgttccactctgtacacctggctccgccctctagatagcagtagcaaaatcagtaaaagtactaaaagtctctgaaatgcagaaataatggcataagctgtctcctctctctctccaccagggctgccaaacagggaggggccccctgtccggtggaaacgtgactcatgtgaccttatcaatcattagagatgactcacactccttaccctgccccttttgccttgtatccaataaatatcagcacagccaggcattcggggccactgctggtctccgcatcttggtggtagtggtcccccgggcccagttgtcttttcttctatttctttgtcttgtgtctttatttctacgatctctcatctccgcacaaggggagaaagacccacagaccctgtagggctggcccctacactgaatgtctgtttatttatatgcataataatcaactcacatgttccaactgaacaaaccaaatatttctatccaattttcaataaaaatataaaaatctacatatttcatgtgtttatgtttgttatgtctctcacagcctgcaacagatttaatttagctatcctctgaactacaagcttccctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacaaaatggaatcttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataacgaggagacagatagaattcacagatccacatgtttctcactggctgacaaaactgtgttaagtcagggtgaagcatggcggaggaacagggaggaagtgcagagtgagaaaacataaagaagycaggaagtgccagaagagtaatttcctgtgagtaaagcctcatactcggtgatttatcgatagagtttgaatacaagagctgtgaggtctgggcagttggagtggaggctgagcaggagataaatgtggtagaggcggtgtggttgggagatccttgaaaacagagaaatgccctagtgtgacagagtacagaaatactacaaaaactcacttgtagaaagaacattctgcatataatcaggcatggaacggtcccatgcattccataataattaagaaaaagatattggcagagcattgcttaaaggcactgcaagaaaataggtgagaagaccaggaagttttatttattttattattttattatttattttcgagatgaagaacaatcaaaggaaaatgatggacggaaattaacaatcattcttgggcggggggaaaaactccacccacaattcctaagtaaaaagggttacacacattctcggcataataagtctctctcaggccaaatgtgttcatgtgaacactatgaaggcattccagctgaggtcaggaaaataccaagtatgaccttccctatttaagttaaaatattggaagcttattccaaaatattggaataaatttgaaatacagtgattgaatggaaggacattaaattataactcattagacatgttattttactctatagacaaacacaacaaatcacctgaaataagctacaaaagataaaccagtaagttagagaaataatcttttttttttttttgagatggagtctccctctgttgcttaggccagagtgcagtggcgcagtcttggctcactgcaacctctgcttcctgagttctagtgagtctcctcctcagcctcccaagtagctgggattacaggcatgcgccaccatgcctggctaattttttttgtatttttagtagagatggggtttcaccatgttggacatgctggtcttgaactcctgacctcaggtgatctgcctgcctcaggttcccaagtactgggattataggcttgagccattgcacctggccagaagaatcttaatgtacaaaaatgaataggtttttaatacaacagactatcccaattccttgaaagaagaaaatacacccattaaaacagaaactatggtgcctagaattaaactgcacaaaaaactacatgacccatataatttttttatgttgaaataattttaaacatgcaaaattagcaaagattcatataaatcctcaaccagcctatcctgatgttagctatatatataattgtattatatgtataatagttgttatatataaaactgtatatatacatttattgtattataatcatatatatacatttattgtattatatataatatacaactgtatatgtaattgtaatataataattatatacataatagtatatgtaatacaattatccaaccaggaaattgatgtcaacgtatcttaccattacctaatgtgcagaccttatttgaattttgtcaatatttctcttaacgtcctctttcttctccaagatcgaattgaggatctcacattgcactcagttgttatgtccttagattcctccaggctgtgaccgtttcttattcttcccttgtcttttgtgattgtgacacttttgctgagcatggccaattattttacagaatgtttatcaatttggatttctttgatgttttctcacgattaggctgaggtcatgcatgtttgtcttctgtgttcagtcaacatgccccatcctttttgaaatatttcttcatgttctggcgtcacaatttgttccaatgttatcttatatattcctgccccagccctcgaagtaaccatttctccacagatacttcaaaatagtatttagaaaccaaggccgggcacagtggctcacgcctgtaatcccagcactttgggaggccgaggcgggctgatctcgaggtcaagagacggagaccatcctgaccaacatggtgaaactccgtctttactaaaaatacaaaaaattagccgagcgtggtggcatgcgcctgtaattccagctactcgggaggctgaggcaagagaatcgcttgaacctggaaggcagaggttgcagtgagccgagattgctccattacactccagcctgggtgacagacggagacttcatctcaaaaaaaaaaaaaagtaatattgattaaaaatcaaattgcatgagaatgcatagcaggataccaagcaaatacaacttttaaatattacagaaaatgatatttaaaatacaaaccaaatacataaatcatgcaggcggattaagacgtttctggatagtggtaacagctgagagtggctggatgaattccagagaaatttcatatattgcttcaattttatttaaaatatactattaccaatgtcttagatattttattttaaataatgaacaaggatattataaactctgcagaagtaagtgtaatcgtgtttttttcctgcccacattaaagatggcccagatgcttgcactgaccccattgactgcccacagccatcatggcgaccggaagtcctgagagtttacttccctcagttttcagaaagcccgcctcctctgcgagcgttatttcaaaagaagttgagacccagagaaaccgacctaaggggattctcccatttggcccgtcctcccctaaagtcaccacctgctgcttttctggagcgcttaccaggtgagtttcaggagccctagygtacaggaaggagaaacggaggcttgtaggtaggacaccgccaggctgctctgtgttctgttcctcttggtcagcaaggaaggagtacgacaaagtgagaagttcatatgagcgtgtcagaaggggaaatagggcccctcccttgttaaaaacaaaaccctctggaagctcggcatcctgtcataacttaaatttatgacttcagtgacttggcttggacagtcttaataatctctctcacactcaatttgttttaatttctgtaataataatttttataccaatgtttatgttgttaatactaataattttacactgtaaytgtataactttaattattagaagtgttaacctaactaacaaacatatgaaagcttcctaagggaaacaatttttttttctttttgagatggagtctcgctctgtggctaggctggagtacagtggcatgatcttggctcactgcaacctctgcctcccaggttcaagcgattctcgtgcctcagtctcccaagtagctgggactacaggcgtgcaccaccacatccagctaattttttattttttagtagagacggggtttcaccatgttggccaggatggtctccgtctcttgacctcgagatcagcccgcctcggcctcccaaagtgttgggattacaggcgtgagccactgcgcccagccggaaacaatgtttatttgggaatagagcattgcaattgggaatagacatgccgtattaaactatgtgtatattcagggagataaaggaagacagaaatggggaggattgcatattgttttaacagaattttccttggctacaaagatcagtaacaagggtgacattagtcctaggttggaccagcagttgctgggcagcattccttgcagaaatatatatttttttaaggttgtgaagacctttatgyaaggttgtgggttttgtagagtctttttcatcttcaggcatgcaaggataagagccctctcttcatggccttcctggctctatttgtcagggttatcttaacataagtgactccattttgttctgacaactttcagatttccccttgtgatcaagaagtttctctgaaagcactctcctgcctcagcctcccgagtagctgcgactacaggtgcccaccaccacacccagctaattgtttttgtgtttttagtagagacggggtttcactatgttggccaggctggtctcgaacccctgacttgtgatctgcccacttcggcctcccraagtgctgggattacagggatgagccaccgcaccaggcctgcatttcttttttcaaagaattactgtggcattttttccaatgtcattgtgttctgtggttcttatctagtcttcacatttatttacataatgaactttcaatgatggatttckacagratttttgtcactaagtggttgcctagaagtatatatmctaagattgaacatattgaaatatgagctaacttttctcattcaattattgattacttagttagtttatttattatttgggggatgggatcttgcaatgctgcccagaccrgactcaaactcctgggctcaaactcctacctcagcctcccaagtaggtgggattacaggcatgtactacttcacctggctcaattatttattatttataactcattrtacatatattcagataacttaatctgtgcattaaactcttccactttgttgatagtcatttctgtgtttgctatgtggctacatatgtatgctatgtgtttcctctatgcttgagataggatgatggggattcttcaatggctgtgtgagttgttattctagggcacttaagtcaagaatatgaattgctttggtcaattttttatatctttactgatactctgttattctgttaattgctgaaagactattgawcagatttcccacaagagtggaggattattctatatctgtttatcattctacccgtgtatactatatacatattgaaagtgtgaatatgtatacacaaaattaaaattgttattcttattgaagtgatctactttatacttagtaatgctgtttaggtaaaatatattttgtctaatattattggaggtgcacctgctccccattgattacatttttacacagatagtcatcttgcattcttttattggaatcttaatataacttctttgggtttatcccctgtaagatggagggaaatgctcttgaagcctaatttgtctgacattcatattgttgctccagattctttttaataaccatgtatatggtatatcactgccactgtcatatgaggggtggggaagtggccccacttggaaacatttttgcagatgagtatttaaaatgataaatgttggccaggcacggtggctcacacctgtaattacagcactttgggaggctgaggcaggtggatcacgtgaggccaggagttcgagaccagcctggccaaattggtgaaaccccgtctctacaaaaatacaaaaattagccaggcatggtgatgcatacctgtaatcccagtcactgcagctccctgcacctgtactctcacacaccacattctcttaaccagtcctattctttttagctcctatcatgtgtacatatacgttttcctgtaccacaaacattctgtataatctcttgtgctattatgttttatctgtttagatcatggatgtatgtccaacccattaaatagtaccaagaataaggaacatgtgcaaaatgtatttgtggaatgaatacaagaagtgccatagagcagtgcagtttaacagaaatataatccaagccccaaatgtatattaaattttctagcaactgcatttaaaaaagcaaaaacaagcagatacagttagtttaaaaatacctatgtagttgtatatgtatacacatatgtgtgtgtgtgtgtgtgtgtgtgtgtgatatatatatactgataaggccagtgcggtggctcacacctacaatcctagcacttttggaggctgacacaggcggttcacttgaggtcaggagttctagaccagcctggccaacgtggggaaactctgtctctactaaaaaatacaaaaaaattagccaggcatggtggtgcacacctataatcctagctactcggaaggctgaagtgggaggattgcttgaatccaggaggtgggggccgcagtgagctgagatcacaccactgcatactccagcctgggtgacagagcaagactctgtctcaaaaaaaaaaaattatatatattatatatattcttacatatgttttacttacatatttgtgtatatgtattttatttaaatatgcatatatatgtaaacataacaaaacatatacatacgttttacccaaaatgtcataatttaaacttgtcagcaatgtgaaagttattaagataatatttatatactgttatttatattgacttcaaaacctgaatgctttttaaatttatgatacacctcaattcaaactagccctaattcaattgctcaataactgcatgactttttctccacaaaagtcatcatggagacttcccagctgcagaagaaagtatggggtttgagatcagccattgaatgctccctgagagctgatcattcttgtcttagagaggaagaggtaaattaggaaataattttattattttttattagcacaaaagggcagatggttgggtagcatgatgaaataattccagtgatcatctctagtcttgrttttttctcagatttataaaagaaataaagagtgatgaagttgtttgagcaataaaagcacacaaagcaaccaagcagcaggaggatggtatgggtggctctgtgttcaggagatggctgggaagagaggctagggctgtgcagacgctgggctctccgccggtgtctgcagaggagactggccatgttgatgctggtccagaccatgaggaacacaaacaggacatggcgaatcaccatgacatttataaatgatccttgggggagttttatctgtttagatcacggatgtatgccaaatccattaaatagtaccaagaataaggaacatgtgcaaaatatatttgtggaatgaataaaataagtcccatagagcagtgcaatttaacagaaatataatccaagccccaaatgtatattaaattattgtatgtatggcctagtttgacaacagtcttgcaaatatccaggaccagaaatggtgaaattggtattggcctctacggtttcagtgatgtgaacgtagattagcatgttggtgatccagaggaaaatgaaagagggaacaaacctcaaggctgatatgcggatcacacaatagtttaccaaactgcccaatatcataaccagagacgttcacactacaaaccaggagaaaaagttggtgttttcacactgtataactttctgcaagatgctgaaacaagactctatatcataatgagactttcatctcacttaattcgaccttttctacttagcagaataatggtgtaacttaaattttatgatcaattccttctgcttataacttaacagaacccaacctacaaaattctttagtatccattggttaagcaagaaattgtctgtgatgttgctaatacgacatgctatacctgaataaattcctctgagaaaagttgaggctcctatacacaaaataagaaagcaggccatgtggttaccccaggtctcacctaactccctgctgtctcgaataactgtttgagttcttcaattagttgtctttaaacctaggtttatggctcaaaaccatatgcaaactgaaaatctcatattgctcttaatttgtatttccccttactttgtatttctcctttttaaactttgtatgtgttacttgttaaattttttcagaggtgcagctcctaacaaaataatactgaatcagcactttaaagggatagcaaaagactgtagaacagacaaaattgaacttactaatggactccagggagacttagcctgagagccacatccttcaaatctcttttgttgctcaaatgtgcttttgacatcgattcctagtcaccagtcactccccacaacatgggatgagaccagcaaactgggagaggtccatgctggcatcaggggacatcaaatcttaattacagaatgattgatcaataatgcttttagagaaagttcttgatcacaaggagaaatctgaaagttgtcagaacaaaatggagccactaatgttaagatgaccctgacaaataaagccaggaaagccatgaagagggggggtcttatccttgtatgcttgaaaatgaaaaagactctacaaaacccacaaccttgcataaaggtcattgcaaccttaaacaaaaaatatttctgcaaggaatgctgcccagcaactgcctgtccaacctcagactaatgtcacctttgtgcctgatcctgtggccaaggaaaatcctgtcaaaacaatatgcaatcctccccatttctgtcttcctttatcttcctgaatatatacatagtttaatatggcatatctattcccaattgcaatgctctaktcccaaataaacactgtttcctttaggaagctttcatatgtttgttatttaggttaacacttgtaataattaaaggattacagttacaatgtaaaattattagtattaacaacacaaacattggtataaaaattattattacagaaattaaaacaacttgagtatggagagattattaagactgtcccagccaagtcattgaagtcataaatttaagctatgactaacaggatgcaaagcttcctgagggttttgttttgttttcaacaagcggagggccccatttccctttccgacagcctcataggaacttctccctttcttctcaagtgaccaagaggaacagaacacagagcagcctggcagtgtccaagcarcaagcctccgctcctccttcctgcaccctggggctcctgaaactcacatggtaagcgctgcagaaacgcagcaggtggtgactttaggggaggacaggccaaatgggagaatccccttaagcttcggtttctctagttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatgtgagtaggaaaaaacacgactacacttacttctgcagagtttataatatccttgcccattatttacaataaaatatctaaaacataggtaataatatattttaaataaaattgaagcaatatatgaaatttctctgaaattcatccagccactctcggctgttgccactatccagaaacgtcttaatccccctgcatgatttatgtatttggtttgtattttaaatattattttctgtaatatttaaaacttgtatttgcttggtatcgtgctgtgcagtctcatgcaatttgatttttaatcaatattacttttttttttttttgagacggagtctcgttctgtcatccaggctggagtccagtggtgtgatctcggctcactgcaacctccacctctcgggttcaagcgattcttctgcctcagcctcccgagtagctggggtgacaggcgcccgccaccacgcacgactaatttttgtatttttagtagagacggagtttcactatgttgccagtctggcttcgaactcctgatctcaggtgatccgcccgcctcggcctcccaaagtgttgggattacaggcgtgagccaccgtgcccggcccaatagtacattttaaatatttatccatgtttacatgtggttttaataatttatgttaactgcgctacagtattaatgcaatgatgatattataatcaatgtatccattctttgatgatggacattcartttgttaccctgttttctgatagcaaaccataatacaatggactttttatatgcattttcttgtccacacataatttcaagggtaggtgtgtcttgaagtctagatacagccagtttattctccaaagcggctgtgttttcagtcatstccactactggtttacgagtttccattgctacacattcatattcacacttgattttgtcagcttttcttatttccatcagtattgtgggtgagaatgataactgatagtggttgtcatgcacattcccctgattactagtgaattttaacatcttttcaggacatttgtgttttatccttttgattccttatttatatcattaattcatttctctgttgtttgtttcttcaatatgtcaaggaataatgaattttattccaatttttggaagtttaggaattttttttaaatgacagggcttcgctgtgtggcacagactggtctcagccatttggacccaagtgatcctcccacctcggcctccgggtggctggggctacaggcaatacgtgcaggcaaggctataacttcatgcgtgactgggatttttattacatgttttttaaaatttccaatgtcacataaaatactatacaagaattttagtatttgaactttaaagaatgtaattttgcatttttttcttgtgaagatgaatacagattttcrtgggagtaaaaaagacaatttaaggtgaagagtatttggttttcatgaaataatttgatttctaaaataaaagtaaaccgtcaaaactttttaaatgcaatatgaaaatgttttcagttgaaatagtcatagtaaaatttgatgagtggtaactgaattttaattgaaatttcaattgagaatacatatgatacaatgtgtatcacaaatggtaaaaatcatgtgtattttaatgttaaaatttaaaatttagtgtaatttaattttgcttgtgtgacatcaaaacaaatggaagcattgtgtgtgtgttrtrtatatatatatatatatacaataacatagtgtcatgaaagtatagtatatatatrtaaaattttgcgtgtgaaaattttaggtggaggtttttaaaccatttrtttactttataaagggtaataaattcacatagtctgctccccaaacacagttgaatatgtactgtggtgttactgtatatatatatatccagagtttctttatgcatatacaaatttttactctttacttgaagagtagaaastttacatgttgtttactatgcctttcttcattaacaatagatcttagtgataattcagtatcagtttttagtgaactttgacattcttttaaaattgcatattatttcatcatcggatgtatcatgatgtctttattcattcccctattgaaaaacatttcagttgtttcaaattttagtttattttattttacttttaatttttgagatggagtcttgctgtgtcacccaggctggagtgcagtggcaccattttggctcactgcaacctatgacttcttggttcaagcgattctcctgcctcaccctcccgagtagctgaaattacaggcccatgccaccacacccaggtaatttttgtatttttcgtagagacggggtttcaccttgttggccaggctggtctcgaactcctgacctcaagtgatctacccggcttggcctctcaaggtgtggwgattacaggcttgagccatagcgcctggcctcaattgtatttatraagagtgccacagtgagtaaacatgtgagcatgagttcatacataggtaagtatatttgtataggagtatatcaattcctcaaaattgatttaccattccaaatgggatgtcatttatgcgttcaaagatgtccataaagttgccatccatataatgaatagcaggtgacactcccatcagcaatatcagaatgtcagatttcccacagccttgtcagtagatgagttttcagactttcgcatgatttccaaattcatggagaaaaaatattcaagagtagctttaatcttcattcagcatggtgttttttcattcagcacgtgcttgggaaccatttatttttccatttctgtgaatttcatgttcatatcctttgtctacctatttctagagcaatgtttttttttattattgatttyctatttcatgtatcagaatagctctttgctctgctctatttgtctatctgtttgtcagtctatctatcgagaagtaaatacaggcatgtgtaggcacagttcggtatacatgcatggattccccaggtctttccactgagagagattaggacaaagatatcttagtagctgtaaacacacatagtttccagatcttggtttctaaatactgtttttgaatacaagggagccaaggatccgtggagaagtggttacttccagggctggggcaggagtatataggataacattggaacaaattgtgactccagaacatgaagaaatattccaaaaaggacggggcatgttgactgaacacagaagacaaacatgcatgacctcagcctaatcgtgagaaaacatcaaagaaatccaaattgataaacattctgtaaaatagttgaccatgttccgcaaaaatgtcacaatcacaaaagacaagggaagaataagaaacggtcacagactggaggaatctaaggagggataacaagtaagtgcaatgtgagatcctcgattagatcttggagaacaaagaggacattcagacaaatgttgataaaattcaaataaggtctgcacattaagtaatggtatgatatgctaacatcaatttcctggttggataattgtattatatatactattatatatgtaattatcatattacaattgcatatacaattgtatattatatataatatattaaatgtagatatgcaattatttatatataatacaataaatgtatatataatacaatatacaatacaataaattagttattttatatataacaattattttatatataatacaattatatatagctaacattcagataagctggttgaggatttatgtgaatctttgctatttttcaatgtttaaaattatttcaaaataaaagcattatatgggtcatgtagtttttttgtatagtttagttctaggtaccatagttgctattttaatgagtgtattttcttytttcatggaattgggatagtctgttatattaagaagctattcacttttgtatattaagattcttctggctggtgcggtggctgacacctgtaatcccagcactttgggaggctgaggtgggyggatcacctgaggtcagaagtttgagaccagcctatccaacatggtgaaaccccatctctactaaaaatacaaaaaaaattagccaggcatggtggtgcatgtctgtaatcgcagctacttgggaggctaaggcaggagaatcacttgaacccaggatgcagaggttgcagtgagccgagattgtgccacttctctacagcctgagcgacagagggaggccccgtctcaaagaaaaaaaaagattctttctctaacttactggtttatcttacttttgtagcttatttcaggtgattcrttatgtttctctatagaggaaaataacgtgtagtgagttatagtttaatctccttcctttcaatcactgtatttggaatttgtccaatattttggaataagcttccgatattttaacttaaatagggaaggtcttggtattttcctgacttcagctggaatgatttcatagtgtccacatgaagcacaaggttatcctttggcctgagagagacatattatgccgagaatgtgtgtaatcctttttacttaggaattgtgggtggagtttttttccccccaagagtgattgttaacttgggtccatcattttcctttgattgttctttatctaaaacaaaacaaaacaaaaaacaacaacttcctggtcttctcacctattttcttgtagtgcctttaagcaatgctctggtaatatctttttcttaattattatggaatgcatgggaccgttccatgcctgattatatgcagaatgttctttctacaagtgtgtttttgtagtatttctgtactctgtcacattagggcatttctctgttttcaaggatccacaccgcctctaccacatttatctcctgctcagcctccactctacctgcccagacctcacagctcttgtattcaaactctatagataaatcaccgagtatgaggctttactcacaggaaattactcctctggcacttcctgacttctttatgttttctcactctgcacttcctccctgttcctccgccatgcttcaccctgacttaacacagttttgtcagccggtgagaaacatttggatctgtgaattaaatctgtctcctcattattctgaaaatggagttttcatggacttttccgttcaccttattgctttcattgatactcagtaatagacaagataaactgttatttctcattgccttgttcatttcagaagtaccaggtagaattttacaattcttgccttgatacatattcccagtaattgttgagtgatttaattgtatgttgtcttgatattactttggtcatatattacattatttctcatttttgaatatctggatttacataaattctgtgtaattcaggtttgtatttatccaagttctcagaaactacaactgctgtaattgatcataactctcctaatacaggtgtaactaaagtgagagatgctttttgactcatgaaaaaaagaagactgtagaccaagtctcaataacttctacttaatcctatagaaagttagccaagataatgtacaccttctttaagattcttataaggaaaaaattccatttcgtttcttgaaatgaggtattgctttgtcgcccagactggaatgcagcggygccatcatagctcactgcgaccttaatctcctgggatcaagggatcctgtcacttcagcctcctgagtagctgggactacaggcacaaaccactgtgcctggcttcatgagaaaaaattaaatatataatggtactaggtaaaataatactaaataagaagtaatttgaatgcatactatattaactctggaataacgatacttaagtaaaagaaaagtgttcgttataacaaaggaaaagcttgtagttcagaggatagctaaattaaatttttcgcaggctgtgagaagcataataattaaacatgaataaattaaatatgcagattttaatatttttattgaaaattggatagaaatatttgtttagttggaacctgtgartgattattatgcatataaatagacattcagttattgcagataaattcaktggtggtaaaataaaacatttgtatagggttttggaattcaaatctttagattatttctctgggccaggggcaatggctcacgtctgtaatcccagcactttgagaggctgaggcgggaggatcaccaggtcaggagatcgagaccatcctggctaacacggtgaaaccccgtctctactaaaaatacaaaaaaattagccaggcgtcatggctcacgcatgtagtcccagctyctcaggaggctgaggcaggaaaatcgcttgaacctgggaggtggagcagcctggtgactaattacaaattartgatttgtatttcactaattatcttttctgttatccagagtctctgaaatgctattaataatatgtatttttattattatataaaagttaatcttcaaaaatcacaataacttatcactttacatgtactagaatggccattttcaaaaggcccataataacaattataggtgaggatatggagaagctggccccctcctacactgctggtgggaatggagattggcgctttggtatatgtgctgccgaagcgagcacggaaattggcgctttggaaaacagtctggcagttccttgaagggtaaacatagagttaccatatgacccagcaactccactcctaagtatgtacccaagagaaggaaataatctgtccacatggaaattcgtacctgaatattcacagtatcatttttcataacagccccaaagtggaactcacccaaatgtctatcgtctgctgaatggataagagaatatgtgatgtctccatacggtggaatattattcagccatgaaagcaaaggaggtgctgttatgcggtataatatggatggaccttgaaaacatacgggaagtgaaagaatccatcacaaaggacaatatattgtttgatgcctgtcttagtcactttgggcttctttaacaaaagtatcatagactatgtggcttaaacaacagaatttatttctcacagttctggaggctgggaagtccamgatcaaggcactggtacattcagtgcctggagaggacctgcttccttgttcatagayggctgacttcttgctgcgccctcccacggtagaaagcrggagcgaggtctctggggtctctttgctaagggcgttgagaccattcatgaggattccaccctcatgacctcatcacctcccgaaggccccatctcctcctatcatcacatttggagttaggatttcaacacatgaacttgagggtggacacatayattcggtccataacaactcctattaaatcaaatgtccagaatgagtmaacctatggagacagaaggtggatgcgtgggtgcctgtggctgggtgtgcgtgcctgtggggaatggggagtgccgcttaatgagtttctttttgaggtgatgacgctgtcctaaaactgattgtggtggtggttgtacaacttcattactatatatacaacattgaattgtagacttatgtgggtgaattgtgtggtttstgaactrtatatccataaagccattattttaaaaatctaatctttaaaaaatgtcatagcagagccggtgaaggtaatggattagacaacggttcctaaacccaagtattttaaagaaatcaaggtgacaatttaggcaagaaaaacgattagagttgtacgagagaagaatggaaggcaaggaaaataatcacacttttgcctctgtcaggttggaatctttagaagttcctgttctgcataacttaacttgcagacccagggccacatcaaaaataaaagaatttgaaaaatccggcagggcacggtggctcacgcctgcaatccggcactttgggaggccgagacgggccgatcacctgaggttgggagtttgagaccagcctgaccaacatggagaaaccctgtctatactaaaaatagaaaaattagccgggtatggtggcgcatgcctgtaatcccagctactcaggaggctgaggcaggagaatcgcttgaacccgggaggtggaggttgctgtgagtcaagmtctcgccattgcactccagcctgggtgacagagctagactccatctaaaaaaaaaggaagtttctagtttctgttttacaactctcctgtttcggcctctgtcccaagtacctaccactactaggagcaattccactgatgcatctcttgtgaatgagcaataagcgcttttgtcaacctttgagagacacagaagctaagatttatctgatggttcttcccaagtacctaaatacaacctccttttattttttcagggtaaaaaagatacagtaaagacataaataccacatttgacaaatggaaaaaaaggagtgtccagaaaagagtagcagcagtgaggaagagctgccgagacggtgagtgactttgcgctctgtgagggctcctgatggctgattcttctgtgtttcgttatagttcatgagatacagaggaccatggatgttttctggaagaaaggttctgctcacattttattcattcacccatctctgcatgaatgaagggaaaactcccatgggcacccaggtgtactttttttttttttttgacacagagtcttgttttgttgcccaggccagagtgcgctggtaccatctcagctcactacaacctctgcctcctgggttcaagcgattcttctgcctcagcctcccaagtagctgggattacaggcatgcaccaccacgcctggctactttttgtatttttagtagagacggggtttcatcatgttgaccaggctggtctggacctcctgacctcaggtgatccacccacctcggcctcccaaagtgctgggattacaggagtgagccactgcgcctggcccaggtgtactttttagaccttctctctccttccctgtttctgacctttttagaccttctctctccttccttgattctgaccatggcaacttcatacctgagcaaaagcgagtctagggctgttcttccagctctttccttgatgcatgggcctatggccttgaccaygctcttgacaatcccatagcatggcgcccagatcagagcagaaccaagcagcctgactcactaagccctccctctgtgtgtttcagtggctcctcatcagcaccaggyttatgtctcatttgtagaaaatgaatgcactgttttacattgtcttggaactcaaaacaaattaatctgaccaaatatttcatgtatgcaattcagacactgctgcagaatgaatgtttgtgttcttccaatattaatatgttgaaatcctaacttccaatgtgatgttgttaggagatggggcctttgagaggtgtcaggtgataaaggtagcgccctcatgaatggaattagttccctcatgaaggaaccctggagagctcctttctctttccccatgcttggacagaacaagaagtctgycctctatgaatcaggagcagacactgatctaccagcaccttgatcctgggctttccagcatccagagctgtgacaaatacatttatattgttcacaagcttctcagtccataggttttaaaaatagcaaccttggccaggcatggtgactcacgcctgtaatccgagcactttgggaggcggaggcgggcagatcacctgatgtcaggagttcgagaccagtctggccaacatggtgaaaccccatctctactacaaatataaaaattagctgggcatggtggcgggcacttgtaatcccagctactcgggaggctgaggcacgagaatcgcttgaacctgggaggtggaggttgcagtgagccaagatcgctccattgcactccagcctgggcgacaacagtgaaactctgtctcaaaaaaaaaaaaaaaaaaaagtctgaaatgactgagacagatgatctggcatgcataaaagaccacggactaggacgaattgtttgctttgggaacccagtgtttccaactcttgcgctaagtaattttagccttctatgattaatcaccacaaggatttgtgacgagagtactgtatccttattttacaaattagaaagctgatactcagagaggttaagcaacaactttgacaggtctgtcactgctgagtgatgtctgtgaaaggcagtgaatgcagatcactctagtgtccatcatccctgacacgctcacactaaataaagagatcctaccttcaaataagctcagtccattcagtgttgtgcaaacaacttcatctggttaacattccctcctgtttaggaccaacgaaggatagaagagtggggcccttgttatgctcctatagtttacaaaaacacagtatcctttcagaagccagtagcgagcatcaccaagtgtgacagaccgtgatgaacatcagggattgagaatcaaaggaggcatgcctcctgagataagatcattgtctacgaagtggtaacagcaatgcagttagttcaataaaaatgtggaggaatggtattttattctagcatgggcatcgaagaaggtgtctctaagaatgggcatctctaagrcatctctgaggatggcatctctaaggatrgtatctctaaggatggcatctctatggatgggcatgtctaaggatggatgtctctaaggatggcatctctatggatgggcatgtctaaggatggatatctctaaggatggcatctctatggatgggcatgtctaaggatggatatctctaaggatcgggctactttcgctacatcacagtgaggagattgtcccaccatcgagctcctctgacatgctcacattccaattccatttgtgttttcccagggacagtggatccagtaggaacatagatgcatccaaactcattagactacaaggaycacggaaactgttggttgacaatagcatacgggaactgcaatacacaaaaactggaattttttttcaggctgaggcctgtgtgacaaatgatacgtaagggacatctatttgttgggraaaaattaaagatttggaattttgctccattggtttatgtacattcataagaagcaaagacatgcaggttatttgcataaaaattagtatatatgttacttttcttctttgttatcttaagtttttatttcaaaagagtttgtatctcataagaagtagggaaaaaaggtcygagcccagtggctcacacctgtaatctcagcacactgggaggcgagggcaggtggatcgcctgaggtcaaaagtttgagaccagcctggcctacatggtgaaaccccatctctactaaaaatacaaaaatyagctgggcatagtggcccacacctgtaatcccagctactcaggaggctgaggcaggagaattgctcaaacctgggaggcggaggttgcagtgagccgagatcgtgcaactgcactccagcctgggagacagagtgaggcttygtctcaaaaaaaataataacaatattaatgataaagtagttgggagagaagggcagagttcccatgtagccttcaccaagtttcccctcacgataatactttttttcttytttttttgagacgaagtcttgctctgttgcccaggctggagtgcagtggcacgatcttggctcactacaacctctgcttctggggttcaagcgattcttttgcctcagcctcccaagtagctggaattacaggtgcccactaccacacctggctaatttttgtatttttagtagatacggggtttcaccatgttggccaggctggtctcaaactcctgacctcaagtgatcctcctgcctcagcctcccaaagtgctgggattacaggcgtgagtcgctgcacccagccgataatacttcctgtaacaatagcgatatgatttggatgtttgtcccttccaaatctcatgctgaaatgtgatggagtgttggaggtggggcctggagggaggtgaatggatcaagggggcatatccctcataaatggtttagcaccattcctttggtgataagtggcttcttactctgagttcatgcaagatctggttctttaaaagtgtgtggcacctcccccttcactgtcttgctcctgctgacatcatatgacaggcctgttccacttcaccttccaccatgagttaaacgtccctgaggcctcccagaaaccaagcagaagctggtcccatgatgtacatcctgcagcaccatgagccaattaaacctcttttctttgtaaattgcctagtctcagacagtcctctatagcaatgcaagaatgacccaatacaggccaggcgcggtgtctcactcctgtaatcccagcactttgggaggctgagaggggcggaccacctgatgtcgggagtttgaaaccagcctgaccaacatggaggaacccccatctctactaaaaatacagaattagccgggcttggtggcgcatgcctgtaatcccagctactcaggaggcttgaggcaggataattgcttgaactcgggaggcagaggttgcagtgagccaagatcacgccattgcactctagcctgggcaacaagagcaaaactccatcaaaaaaacaaaaaacaaaaaaaccagaatgacccaatacaaacagtcattgctaataccaggaaactgatgttgatacagtactgttaactcaggtatagattttatttcagggtgatatttcacaggctgaaaagcactgctaatgaggacaggaattcctcagtcttgcttggtccatgcacccatttaacatgggatattttaaaagcagtgctgcaygccggggaccatggatggtagagcttaaagaactactttgtttaataaaacctatcccagactgggtgcggtggctcacaggtgtaatcccaggactttgggaggccagggcgggtggttcacttgaggtcaggagttggagaccagcctggccaacatgatgaaaccctgtctctaccaaaaatataaaaaattaaccgggtgtgctggtgcatgcctgtaatcccagctattggggacgctgaggcaggagaatagcttgaacccgggaggcagaggttgcagtgagccaagatcatgccactgcactccagcctgggcaacagagccagactctgtctcaatttaaaaaataaaaataaaaatagaaatgaaaccaatggcagatagcccaaggcaggaccctctggtcaactggactacagcagaggttctaaagtcaatgctgtccaayagagttctcacccaggatggaaatgttccctgtctgtggtgtccagtgtgaaagccactggcctcacatggctttttctttttttaacatacatactttaatcagaattgctgaaaaaatattcaggatttttgctcttgttgttgatgtttttaacaggcttaattttccagctgaaacccgattttacattgcaaacaaatgttcttttttttttttagacaaaagttgtcttcagtaataattcctcagttattttctttctttttttttgctttccttttttgtcaatgatttttttctacagtttggttttgaacttacttcaaaatctctcaacaattgctttcacagatattcagctgatggaagtgttcactgttgtaaccttttgtggagagtgatttgggaatatctatcaaacagtaatgctcaggctgggtgcggtggctcatgactgtaatcccagtgctttgggatgccaaggtggaaggatttcttggggccgggaattcaagaccagcctgagacctcatctctattccctggagtcctcttcaaagcagattttgttgccagacgtcctatgcctatgtccattacccagaaaaattcttttagtttcacgtggctggggaggcctcaccatcatggcagaagtcaaaggaggagcaaasgcatgtcttacatggtggcaggcaagagccacgtgtggcttttgagcacttgaaatatggctacttcaaaggaggaactgattttcacatttaacaatttaaaactaaatgtaaataggcaggtgtggctagtggctgtcatattggccattgaatatcttggcataaaggacactccatcactcctaacctcaatcttgattcctgccagccataggaggacagcaccaagccttcaaaaatgaagaagagaaaaggatctagcataggactctcatgttccatatctgaataaggatccttgatgggaaaagaaagtgtgtacaatatccataattttctttttctgtgagcatttttgttgctttatgcaacccctctcaccatttgcaggcagaagggagaagaggagataactgttccatgggttcttataaaacatgcccaatctcactaatgccctgcaatcccaatcattttagggtcctattctctygggcaccaattatggatgaagggagactacaaattaggaatctcatcctttccctaaaattcttagcaaggttatataggtcaacatacttgttgacctattatgaaaccaatgtttgtggcaaatgctagatgttgagaactgactgaygtctgcttcctaggatggaaagagcagcatrtagtgggaaacagagagccagttaaatttaacataatgagatgtaagaaagagtcatgggagtctgagaggtgagatggagtcgtaggggcctgaggaatgacttccctaagataaaatattgagtctatggctattaacataaaatcttcctgcacagcctatgctatcatcaggcacctaccttatattcatagtaaaaattctgttsttgttttccagggtatacagggagctaccctgtgtttctgagaccctytgtgacatctcacmttttttccaagaagatgatgagacagaggcagagccattattgwtccgtgctgttcctgagtgtcaactatctgggggggacattcccaggtaagaaaagctattccgttggaaaactattggacgctgtgtctcaatatcacagaggaacatgagaattagaggaatttgggtgtttttcatcgaactcaggrgagartgaatgagcttatgcaatactagcaatgaatccagaaatttttgaaacaaaccttaagcaatgaggttttcttccatggaggtgtctagagaacctatacasaaaaaggcaatgagcaatgcaatcgaagaccagtgggttattggttaagctgttactcaatacataaaaccaacctaattctctaggaaactggctgatgatgaggctgaaggccacagtggggtcctgaggtttaacaccggggaggggagaatgcgtctatttgtagggtatgccaatttccaagggttgaatatccccatcatggcagatttcaaactaccaacgtgaagcccctgatgagggagttgaaagaacacatgcagaagtctgtcatcctgctttcaccacacagatacaagagacataaataacctcaagggcatagactgctgaaaagtgtagaaaaatgactggaaattggtatgttttaatatgtattacttttgtttttaatatgatttatttaaatgttagcttrtatcatttaatttagactaatggttgtgttgaacaacttggttgcaaaagccctgaaaatggaaccgtcagctctcatgatctgggatgcgctgtctgcagttcarcgctgggttcctcccactttctaaacccctcctcagcaggcagactccagcatgcacatgcaccaggaaagagaatataaaatggcatgtttactcttgctgctttgcctgtagctacccgaatccatagcaaaatgtgtagccgcagacagcaaccagtcttaggatgtcagcccaggggtctctccatgcttggcttgcccacagaatccttcygagaaaagcgctgtaaagcctttctcttcatcccacttctctaggtacctgttctttttaaacctaatccacgtgtcagtttctctgctggtctctttcacgtcgaaataaacagatatctcaaggaatggatcaaaggcagagaatttgatggagttggttgccttgctccagaaggtatcacctgtgttagggcaggtttctctccagaggcatgacgaaccattggctcacgctgtatgtcatagaacccatattggctaatattggaatcacctgtgaggctttgaaagcgccgatgctttggtgccacctccagacttctgattcaattgatgtgggctgtgacctggtattgggtggtttttaaagcttcccaggtgtggtcaagtttggaattaccttggaatataaatgcatacattttacgcattggtgaattactgcttcagtctttgattccgacatcgtatgataccaatcggagcaatcaatttaagccagagaatctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggtaatgggctaatagggagaggagtgaagggcgtgtggattgatggaaatgttctgtgattttatgtgaagaagacaatttagagtcttttgtgcagatcaggagtgctttcccttacctttgccacagtgcactgtgcagtttaaatggggacatgtaagcctgtcactgctggggcatggaaatgctcaggggagtcagtgggtggtcctggtggctggggacagcagcagggcctaggaaggatgcacgctctttcgcctctgcatctttggagttcgatacttttctgacctggactttcctcaccagcagaaagtgtcttctgctatttcggaccagtagaaatgtaggtgcattggttccagtcctcagcaaatggtgcctcccaccaaagctgtccagcctggcttcccagaaagycttatggaatttggtgtatacgtttagtcatgacaaggaacattcttgtgcctttctttgtctggattcaaagaagcgaaactgcatattctggtcactctcagctctcattcgatatctgtatcccaacagcacctgtgcaattcagcctccaggagtccttcaggccatgcctcttccaaccctttacctcttacatgtctagtattttcttttcaggagacatttgctcagaagagaatcaaatagtttcctcttatgcttctaaagtctgttttgagatcgaagaagattataaaaatcgtcagtttctggggcctgaaggaaatgtggatgttgagttgrttgataagagcacaaacagatacaggtaagaatggaagatgctgatgatttgaaaaccactctgatataaaggaagtgtgtaggccaggcgtggtggctcasgcctgtaatctcggcactttgggaggtggaggagggcggatcacaaggtcaggagttcgagaccagcctggccaacatgacgaaaccctgtctctactaaaaatacaaaaattagtcaggcgtggtggcacccgcgtgtagtcccagctaatcaggaggctragaaaggagaatctcttgaacccagggggcagaggttgcagtgagatgagatctcgccactgcactgcagcctaggagacagagcgagactttgtctcaaaataaataaataaataaaaatataaatacaaaaggaagcgtatcggttccatcccttatgatagctaaaatttcatcaataatatgtttatttcatgcactgtgaagttggtattttaatttcaacatatatagaatgcagagaaattggggcccagagaggttaatgaactccccagcgttttctaatgtagtgaaagtcgcagatgggtcctgaaccttgcctcacttcaaatcccacctccctctgcacatcgctgcttaaatccaagtcctggggttctcccgtcatgacatcactctggctcctttcagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccraggtaatgtggggtgagyggaggctgtgggggccgytggggtgcgtgccgtctcactgctgttgtggttctcctgcagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggtaagctgagtgatttaggagaccagagaagatgacgattatatttccaggttatccccttggcccctccagttcctcgtggaacagaaagggcaaggcatggttttcatggacagaagcaggagtcacccttcctgaggttcatccaaggtgctgactctggagctatgtgcttccctaaccatcttcagtagtgattcagtgctactgaaaaaggaaattcccttttctggctctcaagaaggagaaagttagtgattttgggggaccagctgacagagaagatgcagagattttttcaccaggttgtttttttctttttttagagacagagtcttactctgtcacccaggctggagtgaactggcgcaatcttggctcactgcaacatccacttctcgggttcaagcgattctcctgcctcagcctcttragtagctgggattgcaggtgcccgccactatgcctggctaatttttgtatttgtagtagagacggggtttcaccatgttggccaggctggttttgaactcctgacctcaggtgatccacctgccttggcctcccgaagtgttgggattacaggcgtgagccaccacccctggcctctcaccaaattttaaatggataatatgtgaattacactgacaggcacactcacatctctggagtaaccctcctcctgttcagtagcatctccctctaatgcacttattaaaggctcatattcccacactctcttctgagttagtgatgaagcagaygtgctggttgctgtagctgctgtgcacctggataaagtcccacttctgtccttccagcctaggtggggcgattatgccagaaagattacattaaattgtatcgtccccccgtckaatgctccaacatcccaagaatgagaggcaggtgcctgcctgtcaggacttagggtggtgagtaactgtgggtacttaaatacaggagaaaacattttaatctgaatgataaagatgactattcctagagtgggccagaaatacatacattccagtgaattcttgcataayttctgttttcattctgagcccacccttttcctatccttcacttagtgcctcttctttcatcattcccaaatctcatatgcttacttgcttcataccttattgatatactrgaaacaaaatgggatggaaaaacctcattgtttcactgtcagcyctgtgagcctgtttctggcccgtcttcacctatttctttcctctgaaacccaagaagcctccttgttctttttcttttcttttctttttttcttttttgagacagagtcttgttctgttgcccrggctagaatgcagtggcaattgcrgctcactgaaacctccgcctcccgggttcaagcgattctcctgcctcagcctcccgagtagctgggattacggatgtgtgccaccacgtcctggtaatttttgtattttcagtagaggtgaggtttcaccatgttggccaggctagccttgaactcctgacctaaagtgatgcacccacctcagcctcccgaagttctgggattacaggcatgagccaccgcgcccggccgcctccctcttcgtacacaaggacactacttaacatgagtcttgggtccctttccctcttcccttatgtgggagccacacccgaggcatcctctttcccctccaccgtcaatctctcctaccctagggcatcactcccttccacccgccaaaatctagaatggcccccacattggaaatgctgtccttgactgctctccctcctgcagtcatacttccaatttttcccttatgcttctcaatgaatggatcaacagctccatgtacccgaagtctccatattcctcagttctcactctgttcccagatctctctgtgtggatgaccttgccacccttccttagaatggctctgtttagcgtcacccagtcagtgactttgtgtcaactcattcttacctggggtctcagtggaatgctattccactgaccacgctcttccttggaaacactcttctataacagcagttcccaaccttttaggcaccaggaagtagttttgcagaagaccatttttccacagaccagggtggtgaatggttttgggatgattcaagcacattaaagttattgtgcactttatttcgattattattacattgtaatatatgatgaaataattacacaactcaccataatgtaaaatcagtgggagccctgagctkctttttctgcagctagatggttccatctgggggtaatgggagacacttacagatcatcaggcattagattctcataaagggcgtgcaacctagatcccttgcatgggcagttcacagcagggttcacgctcgtatgagaatctgatgccactgctgatctgacaggaggagctcaggcggtaatgtgagtgatggggagtggctgtaaatacagatgaaggtttgctccctcactgctcctytcctgctgtgcagcccgattcctaacagctcacacactggtactggtctgcggcccgggtgttggggatctctgctctatatgatcctgcgacaccatattatcccaatttccctgtgacttttcttttctttcctttttttttttttgtgatggagtctagccctctcrcccaggctggagtgcagtggtgtgatctcggcccactgcaacctctgcttcctgggttcaagtgattctcctgcctcagtctcctgagtagttgggattacaggcacacaccaccacacctggctaattcttgtatttttaatagagatggggtttcacagtgttggacaggctggtcttgaactcctgaccttgtgatctgcyygcctyggcctcccaaagtgttgggattacaagcatggaccactgctcctggcatctccgtgacttttctgagtctctcctcaaatcgcctctgcaggttcttgctctgaaaccttctctgaatattgagtttccagggctgaatcttggactctcctttctcttttctgtcttcactgacggacttgatgaattcttcgtctcgtaactgaattccccacaagcagaggatttctcagtctatatctccagtcctgaacattctccagagctccaacttggaaccgccaacctcccctctccatatgagtgtttatttggcatatctaattgtatatattgactcaactttctccctttaagcgatttattcaactctcttccccattcagggtagagactaaatttcattgagtcattcaagccatactctagtgttcatctttaattcctccacttattttcttttctttctttttttttttttttgagacggagtcttgctgtgtcaccaggctggagtgcagtggtgcaatctcagctcactgcaacctctgcctcccaggttcaagtgaagtgattctcatgcctcaccgggattatggtgtctgccaccacgcccagctatttgtatttttttattttatttatgtatttattttttagtagagacagggttcaccgtgtttgccaggctggtcttgaactcttgacctcaagtgatctgcccccctcggcctcgatttcttttctttcccacatccagcatctcatcaattttgattcttttcattttcatagcataacttgaaccagttttactccgttcagcttcactgccagctttagtgccatccactgccatttttgctagaaatatggataaagtcttcaagcttatctcactggttccattgtttttcatttaccacctatttttaaaatctaggaacagggagattttttgcaaaataagtaatacccccattacatgcaattggcccatacaacaaatctgcacatgtacttcttgaacctaaaataaatgatggggctgggcatggtggctcatgcctataatctcagcactttgggaggccgaggcaagcagatcacttgaggccaggagttcgagaccagcctggccaatatggtgaaaccccatctgtactaaaaatacaaaaaattagctggatgtgatggcacatgcctgtaatcccagctacttgggaggtggaggcatgagaattgcttgaacccaggaggcagaggttgcagtgagccaagattttgccactgcactccaggcaacagaacgaaactctgtcttaaataaatcaataaataaaataaatgttggaaagaaaaaaaattaaaattttttaattctaatacacttaaaaaatacattactacatcacactttggccaaagattctttaatggattcacgttacacttagaacatgaatcaaataatttactatggcctagaggccatggcttttttttttttttttttttgagacggagtcttgctgtgtcccccaggctggagtgcagtgggcgtgatctcagctcactgcaacctccgtctcccaggttcaaacaattctcctgtctcagcctcctgagtagctgggactataggcgcacgccaccatgcccggctaattttcgtatttttagtagagacacggtttcaccatattggtcaggctggtcttgaactcctgacctcaggtgatccacccgcctcagcctcccaaagtgctgagattacaggtgtgagccactgtgcccagctgaagccatgacttcttgtgaccctagaacatctcagttatccatctcctatcactctcttctcactcattatgttccagcacttctgtcctgaattttcatccctcaaatactccaagaattcctgcttctgggctcttaccctttgtgtttcccttgcaagactggctcctgctcatctttctagtctctttctagtctttgcctaaagatttctgcttccgaaagcctttagtaggccctctagtctggtccatccctccctttatttatttatttttgagaaggggtcttgccctgtcgcccaggctggagtgcagtgccacagtcgcagctcactgcaacctctgcctaccgggttcaagcgattctcctgcctcagcgtcccgagtagctgagactacaggcatgcgccaccacaccccactaattcttgtatttttagtagaaatggggtttcaccatgttggccaggctggtctcaaactcctgacctcaaatgatctgcccacctcagcctcccaaagtgctgagattacaggtgtgagccaccgtgccctccagttctcccattgttcttgatcactgtaccctcttctttccctctgttgtggtcacatgtctatttatttatgatctgcttctctgtaaattgtgtactctatatcatgggcaggaccatttctgtttaatcataaattagttaaaagcacaaggagggccgggtgcggtggctcacacctgtaatcccaggactttgggaggccgaggtgggcggatcacgagggcaggagatcgagaccatcctggctaacacggtgaaaccccgtctctactaacaatacaaacaattagccgggcacggtggcaggtgcctgtagtcccagctactcgggaggctgaggtgggagaatggctgaacctgggaggtggagcttcagtgagccgagatcgcaccactgcactccagcctgggcgacagagcgagactccatctcaaaaaaaaaaaaaaaaagcacaaggtgaggcctgttgtaggtacctcttgaaattttgttgacccattgaatgaaaagtggtctgtctgcttcttccctattcagggtaggataagggaagaagagaggagaaacctcttcttcacttcaaaccataatcaaactctaaatatctattgttgcactgagaacttccctgccctatttcaagagcagcacagttcaactctataaccactggccagctataggcttgaatggccggcaatagcatgtggctattgagtatgtgagttgagatgtactctaaaacttaagtatttaagttttaatacacatattaatacacatacacagatttggaagacaatatgaagggaagcacataaatagcaattattttttgtgttggttacatgcctaaatgatattgtgagttaaatgaaatacattactaaaagccatttcatctgcctctctttgctgtttttaaaaaatgtggctgctatgaaattaaaaattgcatttggtcacgcctgtaatcccagcactttgggaggcygaggtgggcggatcttgaggtcaggagttcgagaccagcctgaccaacatggtgaaactccgtctctactaaaaatacaaaaattagccgggcgtgctggcatgcgcctgtaatcccagctactcaggaggctgaggcaggagaatcgcttgaacctgggaggcagaggttgcagtgagctgagatcacaccactatactccagcctgggtgacagagcgagactccatctcaaaaaaaaattgcatttgggggttgcagtacatttctattcaacagtactgttccagggaaacccatttattcatccaataaatatttgttgtgtgccttatatattccagacactattttagaggctgaggatacatcagtgaacaaaagaggcaaaaacatgacaaccaaagatattacatggaatgctataggaaaaatatatgtgcatatgataagaactataacaaataaagaaggttaagaaaattaatccagtggtatgtctctcaacacctacagaaatctgtccgtaatcataaccctagcaatgtgatatggatttatttggtgatttagttctaatctgttattactataatttaatttaaacatatctgttcatgtaaaagaattgttcatcagagatggtatgatatgttatttctttcccccatcagtttcttttgacccttcggaaactggttctttttctaaacatatatgtgatgcctcctggatagttctccacatcccttctctgccttacccccatcatagtttcatctctttgctcaatacaatatgaaatttttcttttatttgatttcccaggcccaattcaggttttctccatgggccatccttttcttcatagagatctgctgacatttctttatttctttttttttttttgagacagagtcttgctctgtcgctcaggctggagtacagtggtgcgatcccgactcactgcaaactctgcctcccaggttcatgcgattctcctgcctcagcctcccgagtagctggtattataggcactcaccaccacgcccagctaatttttgtatttttagtagacatggggtttcaccatgttgtccagtctggtctcgaactcctgacctcaggtgatctgcctgcctcggcctcccaaagtgctgggattacaggcataagccactgcacctggcctctacttttaatgaaatatgtacataatttattgcttcataattttcatagttgacacactcacatatgcagcacctagaacaggcaacaagacatcaccagcttccccaaagtccccttgtgtccctcttggtcattatcctgcaagggagtcgatcagctggactaataatatcactgacagtcattgtttttagcataaattccttgctcattaattctacaaagtctctattgagttgtacctgagacttcccaaaggtagaaaggttttgtttgaattccattctgtgtctttgatggctgctcagatagattttttttttttttggtgagacagagtctcgctctgtcgcccaggctggaatgcagtggcgcaatctcggctcactgcaatctctgcctcctgggttcaagtgattctcctgcctcagcctccagagtagctgggattacaggcgcccgccaccacgcccggctaatttttatatttttagtagagacggggtttcgccatgctggccacgctggtctcaaactcctgaccttgtgatctgcccacctcggcctcccaaagcgctaggattacaggtgtgaaccaccgtgcctggctgcttagagatagttttgaggtctcgctttctgctgtggctgctgggcctcgcagaggtgactgtttctgctcgctggtggtcaggtgattgagcatctcacagcagccctgtgacggagagaagtaacatctctacccttgtccatcatagacgtgttcacagacacagctgagctaccagttctctgctgaggcamcaaaaagaagtccttctgtcctgtgctttcataagtacgcagccaatctttccacagtgtaaaaataaaagcaaactatacaagaatttataagttcacattcacaagaaatcctttggccctgagatatctttcagtaaaatttcatcaatatgtctctttgtgcatagagacatattcattcatatctgtgtatctacctatcacaatctttatatcarttgaataccttaatctttatatcaattgaatcatagcctacgtgctacttaatataccatataaataactttttatgccactacttgctttactattttttgtgctctctaatgtttctgccccttcttccttaggcgatagatgatgaggaagatcgcttccatggtgtgcgcctgcagacttcgcccccaatggaacccctgaactttggttccagttatattgtgtctaattctgctaacctgaaagtaatgcccaaggttagtagaattcaaacccaactcagcaggtttcagagtgttttatatttctgaaacaaatggaagaatcttagcaaaatgcaacatttttcttttattaatcacaaatatgccctttaaaaaaattgaaattatagaaaaatagtattaatcatattgcatatttccaagaccctaaggcagaggtaacattttagtatttgacatacttatgttaggttaaaactacacattgagtttcccaaactgaaatttccatttccctgttataattatcttcagtcctgatgtcttgcctaactaacgcacttaatatgtatttgttaaggtagttgaaggaagagctgattttatgttatatatttcattttatatatttttaaatggagattactatataattctgtgcaatttaaattattcctacatacagatttactgggacatgatatgccatgtagcgaaatccctagagcttttttcattatttcatgattattcaacatttagtcgcatgtaatttctcccaagaagtgccctggcaagaagtctttccattcatatggttttacatttttcctgcagggctagagtgtcctaaatgaaattactgattcaaagagtattaaccaacttaaagctagtatatttccaaatagatttccttccttccttccttcctctttcttttttccctctttctctctttctttctttctttcttytctttctttctttccttccttccttccttccttccttccttccttccttccttccttccttycctttctttccctctttctctctttctttccttcttttttgatggagtctcgctctgttgcccaagctggagtgcagtggtgtggtcttggcccactacaaccgccgcctcccaggttcaagtgattctcctgcctcagcctcctgagtaactgggattacaggcatgcaccaccactcccggctgattttttatttttagtagagacggggtttcaccatgttggccaggctggtctcgaactcctgacctcgtgatctgcccaccttggcctcccaaagtgctgagattacaggctcgagccaccacacctggccccaaatagattttcaaagatgtctcacagcatatgttctctaaaataaagatgaggttgtccagcacaatataccatctctagaacaaagtatcaagatttaattgttttccagttttaatgggaaaacacatcccagtgatttcaaggtctttaattcagaatgggacggaccaatgttattgttttggcgtagatggctttttcctgtttgcggaccttggaagaggtgagaaacaagagggttaggtgtcagtatttacatgtctcctttttggacactaaggctaaaataggaaaaatgatttttccagccatatagacaacaagatgtgaagcttattgcagacatcagttcagtgatctttttctaagtatactagagcataagaatttaataaagtgcccaaccttgctctgattttagttcccagtttccttgataaactccacagcaattaatatgaagcagggactgccttccccagaagtttggttgtccttcaggcaagatacattcttggctgttgcagaaccttccataaacattgctgatatagaaataaataaataaaatgcagggtatttcatccagaatgatacaacatagtaaatgtgagataagaagtggcaattgcaacctgaggtgataatctttttttgagacagagtcttactctgtcgcccaggctggagtgcagtggcgcartgtctgctcactgcaaccttctttccctgggttcaagcgattctcctgcctcagcctcctgagtagctgggactacaggcacctgccaccacgcctggctaattgtygtatttttagtagagatgggggtttcaacatattggccaggctggtcttgagctcctgacctcaagcaatcggtcacctcagtctcccaaagtgctgggactacaggtgtgagtcaccgcgcccrccctagaggtgatgatcttgagcgaggtaaactctcctcagagtcatcttccatttaaaaagattccagccaacaatctcaccctttgtaattttttaaatccctattttccaagagctgggtcggggggcttgttttctgaagaaactagagatttgcatgagctaagcttttcctaattctgtcctgcataaggggctttcttgctccccagggcagctttttttaggaatcctggggagactgggtgcaaaacagagagggacctgaaatggcttatctgaccccggcttcccagcgaggctcagagagacctgatggggctgctttggaagctttcttgcttctctatagaatctcggattctgagctggtcgcatcattaatgaggggcctcaaaaccctcaaaatctaagacgtttgtattcagttggtagctcagatagtttttctctgactcatgtggtgttgacagctaggttattcttcccttcctggtataaaagcatttcytaacattgtaaatgtaaagagctgtttacctctctccctctgtttcccactcaaccagccatgacattgcacaggaaacgggttaagttccattggccagttcactgtagggagccgggcctttccaccctccactgcttcaagtcaactgatgtgtttcctctaggagttgaaattgtcctacaggagccctggagaaattcagcacttctcaaaattctatgctgggcagatgaaggaacccattcaacttgagattactgaaaaaagacatgggactttggtgtgggatactgaggtgaagccaggtaggtgagtgggcgaggctggcatttttagacagggatccatcatgtacctctatccttggatttcaaagaagaaatcttgtttatggttctttcccagagaagaaaagaaatctattgtcagtgttaaaacacatggacacagggaggggaacaacacacactggggccttttgggtgatgtgggaagggagaacatctagataaatagctaaaaggccagatacggtgcctcatgcctgtaaacccagaactttgggaggccgaggggggaggatcacctaaggtcgggagttcgagaccagcctgctcaacatggtgaaaccctgtctctactaaacatacaaaattagccaggtgtggtggtacatgcctgtagtcctggctacgtgggaggctgaggcaggagaatcacctgaacccaggagggggttgcagtgagccaagattgtgccacagcagtccagcctgggcaataagagcgaaactccatctgaaaaaaaaaaaaaaaaaaaaagaagaagataaatagctaatgcgtgcagggcttaatatctaggtgatgatttgataggtgcagcaaaccaccatggcacatgtttacctttgtaacaaacctgcatgtcctccacatgtatcccagaacttaaattaaattwaaaaaaatagtttgaataaaataaaatgttcttgccaaaaaagaaaaaaaaaagagaaatctattgtcagtgtattatcagtgtgataacacaacaatggtggcatttgttcatctctaggaagtgaaatgctcaaggggcctgggagaggggtggaaaccctcgaacctagggggtaaagaacagaagattctaagagtcagaagaaacataaggactatttagttccactttcttcacaatttaatcatttcttccatactcatgcttttcattttcggggtgtcatattccctgaggtaatctgttaaaaagttctggaaaatgttttatccattcacagaagctcaacatcataaacacaattttttaaagtttagaaactcccagacaatttgccaaagatctcctgatagttccttgaatctctggagatacatttatatctccaatacatttgtaaaatgccatgctctgtttgaatamctacaatgatgcagaaatcagtatcttcaatagtagyagatccttgtcttgggtaacacagcatgaaaaatttcaatgaagctctatgaagggaaggatattaacatacatttgcataggagctataaatcgctttaaccttttatgtagttgtatgggcacagattaattttaaaacaagtctcttgaacaaaaagtcacttttagaattccatactataacataaaagcacccatatgaagataagttgtatgcagtgatattatttgaggcattgtctgtggtgggaaaaaaatgaaaccaaactgaatgcccaggaagaaggacatagttgaacaaatgtgtgagtacatgttgtggaatggttttcaacaatttcaactgagttttgcctgttgctgctgttgtattttagtagtttggggcaatattgtcacagtgttgactgtgtagaccaggagtccccaacccccgggctagggactggtaccggtctgtggcccgttagaaaccgggttgcacagaggaggtgagtggacggtgagcrggcgaagcttcatctgtgtttacagctgctccccattgcttgcattaccgcctgcgctctgcctcctgtcggatcagtggtggcattacattctcgtaggagcgcgaaccctattgtgaactgtgcaggcgagggatctagggtgcatgctccttaggagaatctaacacctgatgatctgtcactgtctcccatcaccccgagatgggaccacctagttgcaggaaaacaagctcagggctcccactgattctacattatggtgagttgtttgtatarttatttcattatacattacaatgtaataatagaacttaggtgcacaataaatgtattgcacttgaatcatcctgagaccatcccctccctctccagtccgtggaaaaaattgtcttccactaaaccggtcccaggtgccaaaaaggttggggaccactggtgtagactgtctgctctttgtggtcctcagtcactgatcttccttctccactgaatcctcacaatcccatcaccttcctttccctgcaatggtgtctagagttcaagatcagcttcatggctgtgcctccccttctctgggcaaactgccctcttgttgaggcggtgcacatgagctgggactgcacttggagtttccaggcacattgcagggttggatgatgctcagccgacccaggcctcatctccacatgagtagcatctcatgagtgcacctccacatgcaccctccccgcctcctccctccagtckgtaaaatgtcttagcatctcagattgtcagagttttgtttgtgcaacttcttagctctccttgtgatgtttaatatgcgaagaagccgtgcagatgtcggattccccattgcctgcattatcagtggctagaatgcaatctagttcacagccaacatgcaatacatattttgagtaagcaaatgccaccacactctccatttctctgtaaacatcagaatatttttacattgtttacttttttatttaaaaaagattttttccaggtgtcacartcatgcttttttttttttgatagcaaattctagatgaaatgggggagattgtggatggctgggtcttggatgagtatgctggttcaaggcagctcatgttctgcccagaagtcaaatgaccagaaactcaattgtgagacctcacaggagatgggaagctcatatttattctgtcttggtgacatggtgactgagctgctgccaaaggtggggtkgggggggcatgttgcaaaattcatctgaacttygaaaacatcaaggagtctagatgaaagtgcaaaaccmcattgaaggcatcatgggaaatttttttaattattttccaaaatggtagctccaattagcaaatcttctatcaacttataagggtacccaaatttctgcaccatcaacagtcttggtacaatcacatccaaaaaacacgtgttttaattaactcatgtaatgttgttatttcatgtctaaaacactttgactgtaatttatgtagcactgtatgatatgtttttgtagccccatagttcctaagatattggcctgcaagttgaaagaaattggaaaaatgtgtttcttcctccgatgccttttctgaattgtcagtgagtgacccacaacttaatggggtttcctcagtgtattagtgtgcaaaacaagasccttatgacatatgtagaattaaattatttcagttggttgcatcaaagactagaaaagctaaataagggtacatgatttatctcatctcatcatataatttttccctcttttgtagtggatctccagcttgtagctgcatcagcccctcctcctttctcaggtaagtgaaatgtttacattaaagccaagggtatgtatgagacatcaaggggtctttgagtgacagtggaaggtatccaagtgacatggyaccagaacgttactggcagcaaatccgtataggtctgcagcaacctcaattcttgcctccttagaagacagaatttgactgaggggcataaggcagaaggagagaccgaggcaagttttagagcaggagagaaagtttattaaaaagctttacagcaagaggccaggcgcagtggctcacgcctgtaatcctagcactctgggaggccgaggcaggtggattgcttgagctcaggagttcgagaccagcctgggcaacacagtgaaatccccatctctacttaaatacaaaaaattagccgggcgtggtggtgggcacctgtggtcccagctactcgggaggctgaggcaggagaatggcttgaacccgggaggcagaggttgcagtgagctgagatcgcaccactgcactccagcctgggcgacagagcaagactctcggttctacaaaaaaaaaaaaaaaaaaaaaaaaaaaaaaaaaaaagctttatagcaggaatgaaaggaaggaggaaagtacacttggaagacggccgagggggtgacttgaaagacaagtgcacggtttgaccttttgacttggggtttaatatgttggcacacttccggggtcttgcatcccttcttccctgattcttcccctggggtgggctggtcgcctgcatagtggcccgcaggggcttggaaggggagcatgcgcagtgtgtttcttggagtcatacgcatgctcacttgaggcattcttcccttaccagctcaacctccgtaagaggttataggccagttaaactctgctcttaatgcacattcttgagcccactggcccagttcccgagatcttattgggaagctgctgatcaccagtttcaggtgttttctctstgtcaggagacggcctttccctggtgccggctgcaaccaattattattttagagagacggtgtaacaactgcctgaccatcacctgatggttgcctgacatttctggtggggtgaggagtcctctcctgccctgctcatatctgacgagctgcctgctgtaacagcatctctcagcaaggctccattccttccatccttgtcatctgccaagaatgactgatgtcataaatacagacaatgagtatgatttagtcccagaagggcgtgaggacatcatgtagacacaaaagagcatrcaacagcaaattattgggggtaaatatttaatatcttgcgtctggggaactctaagttaaagtagtttgatatggctgtgaattaaactgttagagggacagagtaaaggtgacatgagaaggatagtcaagagctggcagttgaaagtccaagaataaaagttgaaatattttggactttagacggaaaggcaagagtaactattaaaggatggataacaatgtgttggctcttcaaaacagcgtggatgattgagtgtgggttgggaatgaataggaagtggggaacggtggggctgttgtaaaagtgaagagcagatatcagccaaggatctgttaaggacactggaattagtatatagcagagaaaaaattatttacattatttaatataaagagttggctgggtgcagtggctcacacttgtaatcccaacactttgggaggccgaggcaggtggatcacctgaggtcaggagttygagaccagcctggccaacatggtgaaaccctgcctctactraaaatacaaaaactagctgggcgtggtggcacatgcctgtgatcccagctactcggggggctgaggcaggagaatcgcttgaacccaggggcggagattgcagtaagccgagatcgtgccatcgcactccagcctggggacaagagtgagactttgtctcaaaataaataaataaataagtaaataaataaaatagagttaacactgagaggaccaagtttccatcatctagtaagcaataaatccaggtytggaactccttgtctcctgatgacttcatgtccacgttaattttaaaaatcacccaaggcagcaatctgcaatgtcctctggatctgtgtaaagtcttgtgtggcaaatgacagaaagtccaacttaaatggagtgaaattatcaagagtgtsatggctcaggcgagttcaaggaagagatgtgggactgactccagggaggctgattcatgggctcaaacaacatcacaagggaggaatgtttctccatgtcttcgtcccgccttccatattgttggcttcattgtcaggctccacacagtgtaagtttccgaactcatgtctcaaaacagaccactgggagaaaaaagagagcaccttctgagatggcartcatgccatttcctagctgttgttgcctggaaggccattgaggcagattaaataaaaagaaatcatgcctcacatctggaggtgcaatgaggatcagctaaggagcttggttaagaatcagataaaggtgacgtcctaaaataaatcaaagaacatctctgtaggtggtgactgcaggctgagcagcaccaacaaaaggcttctacccttcctaaatataatgtttaggatgtggagcaaaatatagcacctgttgcctgcacgttgaaatcaaagcttagtagctcagtctacaggaagctggtccagaacatgtcttgagtcaaaatcacacctcaacctccatgcattctaaaccacgtgatatggaagtaatatgatttggccaagtttatacagacattatatggggcacaacgtaaaccctgagtctacatgatggaaaaaagtctgtatcttttcccctgttcttccttttstatgcattgtatgtctccagttaaatctcttctttcatagctctgccagctaagctttggggatccagctgaatccttctccatacctctagcatcatgcacagtttctgacaatgtatgaactagaagatttgtgtttcgttgttagagggatttatatataaatgtatgtacagcaagatagagctctgtctaggatttcaatgaaaaacaccaactaggaagaaacaggcttcaagaaatggatgagaggagtaggactgaggaagatacattatttgagacacctcratgcatttgatactgcaaagggtatatttgctctgtgaatgtgtgtgattttgtatgtccacaaattaagytacagacacaaggagcaatctcccacccctgaattttgactctaagcttggtatagatcctgaatcctgtaagtgarcgattctcaaagtctgaaactccccctttcatccaggtgcagcctttgtgaaggagaaccaccggcaactccragccaggatgggggacctgaaaggggtgctcgatgatctccargacaatgaggttcttactgagaatgagaaggagctggtggagcaggaaaagacacggcagagcaagaatgaggccttgctgagcatggtggagaagaaaggggacctggccctggaygtgstcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaatkattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcytctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttmcgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacaygtgattttccttgccatctagaaataaaccatagtatttatgttgaatcaatcaatattatrttttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttrtctgtgtcgtcccactgagtgcattcaccaccttttaaattttggtcactgtatgtatcagttctaaaatttccattttgttctctatattttaaatttcttgscttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccwgagtagctggrattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaattttttttwaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataattycactgtacatgttattcagtgtttggtgtccactgagttgtcatttgccagacaagtggagatttttgcagctcatccttgtattctcagtagttccgatatgtaccctcgamatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtytttatatgrtcagattctgcagctccatcctcttcatgattgtgatcgtraggacagtggaattttgcagttgtctataccttatcttgaagtagaactaaattgttacatttgaagaatgtacttcataaatttacaaaaataaaaaaataggttaatgttattaaaacaaaaaggcacacatttttagaagttaaattgatttatttgaggatgctaaattaaaaatagaaggccggatgcagtggctcacgcctgtaatcccaacactttgggaggccgaggtgggtgaatcagatgaggccaggagctcgagaccagcctggccaacatggtgaaaccccgtctctactaaaattacaaaaattagccgggcatggtggtgcatgtctgtaatcccagctgctcgggaggctaaggcatgagaatcacttgagcctgggaggcaggggttgcagtgagccaagatcacaccactgcactccagcctggctgacagagtctcattctgtctcaaaaaaaaaaaaaaaaaaacagaaaaacaacaataaaaaagaagaagttcattagaatgaagctactaagaagaagatgtaaatatcaggtgatatttataatacataaaaatgattcaacatgagtaaacaaacagaaaactccttgtgaaaaatgggcaaacgttatgagtaaaatgttacagtttgtaaatcgcaatggacaatgaacaaaagtagaatttcatacgtctagttatcagaaacctcattaaaagccataaaaatactacattttatattcatcaaacttccatttattaagaagtcagtaatgcctactactggtgagtatatggagcacaaatgtaagttctgctgttggttaggtaatgcttgattttggaaattaatctgaagttacacagtgaagttaaaggtatgtatactaccttatcctgctcaggttgccataacaaaataccatggactcagtggcttaaagagtaaaattttatttcttacagttctcaggctgggaagtcctagataaatatttggccaattcagcatggttttttttttcttttcttttctttttttttttttgagacagagtctctctgtcgcccaggttggagtgcagtggcgtgatctcggcccactgcaacctccgcctcccgggttcaagtgattctcctgcctcagcctcctgagtagctgggattacaggtgcccaccaccacgcccagctaatttttgtatttttagtagaacagagaggagaaggttaggggtgagtcagaggaagtacgagagcaatcgctaagagatraggtcgaactttaggaaccaggaaagcctccacacttgtcaccccacacatcagggctgtccaacagaactttctgcagtgatggtgttaccctatggaaggtcctgactgtgagttgttagggttcttggtgtgtggaacaaagaattgaacaaaatgcacaaacaaagcaacaaaagagcggagtaacgaaagcacagatttatggaagtgaaagtacactccagagtcggagtgggcttgagcaagtagctcaagagcccctgactgcagtgctctttagagttttcattaagctaaaagaatttggtaacacccctaggtgccctttagaggcctccagttggttacaccctatgaaggattggcccgtgaccaatcaagaggctgaagtggagacttctgtcttgttatcacaggagtgaggatgtggcctggatgctgcccaatcttgcctagaactggctgcacctgcttgtgccttaacccttggttaccctaaatccctgttatccagactcattgggactgctctagatcttcactatccaatacggtaggcgcttcctgaaatgtgctgagttttatttcattataattaatgtaatgcacccacatgtggctagctgctactgttctattgaaatgcaactatacaacttcccataatgtttcaaaacaccaaactcttctgtaactcccccagtctcccaaaacatcttataaaaatcctagaacaactggctgggggcgatggctcacggctgtaatcccagcactctgggaggctgaggcgggtggatcacttgaggttaggagttcgagaccagcctggccaacgtggtgaaacctcgtctctactgaaaatacaaaaattagccaggcatggtggcgcacacccgtaatcccagctacttgggaggctgaggcaggagaattgcttgaactcagaaggtggaggttgcagtgagccaaaattgcaccactgcactccagcctgggtgacagagtgagactctgtctcaaaaaataaaaataaaaatcctataacaactgcacaatgctcaaacggcccaattccctacctttccttttataccttactactactctcttgttgctcccatcatgcctcactccctactcacatttcccagacggaggttacatgtgatatggcagctgagagcccagactctggggcccgattgtgtgggtccaaattctggttctaacacctctggccaagttatttaacctctctgtggtgcagtttcctcatctgtaaaatgggggtgtgacagtaacgctacctcataggaatgttgggatgcctcaacagcactcatgtaaagcagagatgggtacaagtagctttattatatattatctgtttaacaattgtatatgggccaggcgcagtggctcacgcctataatcccagcactttgggagactgaggtgggtgaatctcttgaggtcaggagttcaagaccagcctggccaacatggtgaaaccccttctctactaaaattacaaaaattagccgggcgtggtggtgcgcacctgtaatcccagctactcgggaggctgaggcaggagaatcgcttgaacccgggaagcagaggttgaaatgagcagagatcatgccactgcactccagcctgggcgacagcgtaagactccatctcaaaaacaagcaaacaattgtatatggccgaaactttccataataaaacgtttttaaaaataagagtacttagcatagtctctggcacacagtcagtgctgatcttggcgttagcttcaacactccgacttttcctgactatccccagctcctcctacaacccaattactctataatacctgtttcccctataataacccactcttcacaaacacttaaattaaccataatgagagctgccaaataaaatacaggatgcccagctaaatttgaatttcagataaacaacagagagtaactacaatattatgcattttccgaaattagaatttaactggccattgctttccccctaaatctggtaactctatcactaaatgcctttgcatactgaggaatcctcagtgcttcctagaggctgctactgagttggccttctataaataacaacagaattaacttatataatacctcaattcccttataaaacttccagcttctctttacagcgccagttcttcccaatcgcctcccagtccctcccatagaggacaacagtccccttttcttatacctccccttctccatgaaaccccaattccgtctatagtcacatctgtcctgtttaccagtactgtcaactgtgcctggcttccagcaggagctctataataactgcagaatggcaaaagagcttaataccccaattttccctactgctttgggaggctgaggcgggcggatcctactgcgtttccacttccccttgagcatcccaagtatctagtaacttgtcgatttcaatgatctccccaaatctccttattacataggaattcaccaaaacactccctgtccttgaaaacatcccatttcccctaatatcaccccaactccccttactgcagactgattcctccggcacaccctccatccctccagttcccaggctgttagtctaatttctcccgcgaggtctctaatccccgtctccttccactccagggttactgtggcaacgccaacctttgaatccccctcctgcgcgctgagcggctcgtaaccatggagaccgaagcaggtttcccgcgtccgcctcctcacmcagagactgcagccccggcgcccagaccctttggacaaggagatccaagcgggccccacaatgctcagcgggtaaagagctcctccccactcctctcccgccagcagacgaaggaaacaccccgcagcctgcacatgctcagatggagctctgggmccgcgggttctactgcgcaggccctcacactcagcaaagggacttggacgcgaaagcgctggtggcgctyagccggytgggagttgtagctttctggctgctacagcaggagatacaggtggccaatgggtgagctggctggaggtaggaacaaggttaaggaagctgggatcttcgtgcagactggatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcgggagatcgacttaataactgtgaacacgtgtcactggaaaaagcagtatgttaataagtaactgggctgctttgggaaaaatggaaatgcaggcgatgttagaacactggtacacacactaattcattcatcctcacaaagccctatagacaggtactattatgacccctcaactgtaacataggctggaaggtcacatgacaaggaagtagtggagctgggatttgaacccaggcagtctggcttcatacttgataagcttaatcacaatgccaaastggtaaatagctgtgtggcataatttcaggtagtgataagtgctgtgaaggataaagcaaagaaaggggcagggatggctctttagagagactacttagggatggctttcaggaagaggtggcatttgagcaggggcccgagggattgatgtgacttgtgataaaagaaaaacttcagacgaattaaatttaaagaagtttaattggctaggcactgtggttcatgcctgtaatcccagcactttgggaggccgaggagggcggatggcttcaagtcaggagcttgagaccagcctggtcaacatggcaaaaccctgtctctactacaaatacaaaaattagctaggcatggtggtgggcacctgtagtcccagctactcgggaggctgaggcacaagaattgcttgaacccagaaggtggaggttgtagtgagctgagatcgcaccactgtgctccagcctgtgcaacagagcgagactccatctctaaataaataaatagagtttaattgagcaatgaaggatccacgaatcaggcagcctcggaccagagtaggctgaaactccagcacagccatgtggtggaagatttatggacagaaaaaggaaagtgacatacagaaaacgtaagtgaggtacagaaacagctgaattgattacagctcggcgtttgctgtacacagttcgaacagttggctacatttgattgcccaaaactcggtgattggcacaagtgtaggccaccttctgtttacacctccacttgttatagttcacgacgtacagaaaaaccttcaggccgaacttaaaatatgtaaggaggcagctttaggctaaacttgatttaacactgtgagctatatatgtggggcatatagagggttaaggtttactaacctttagtttcctcttgccttcctgaagggccaaatactgtaatacgtgcagttccctccaataggaacgtacttcttcattctcttttcctggcaaacacattcttcaaggtccagttctgtgaagatccttctgcctgttttttaaaatttatttttatttgtttgtttatggtcacatacgtctcttcctggtctggactcatccaatccatttgtcacagtaaagcttctggggtaggggaggtggttattctaatgtacatccaatcaagccactctctgtttaaaaccttttgaaggcttcccatacctcccaggataaagactcacctcatcttctatctttaagggcttgcggatttcactgtcc

SEQ ID NO: 12166 - DNA, 91571 bp, Homo sapiens
  misc_feature (1)...(91571): n = A,T,C or G, or insertion/deletion polymorphism (see Tables 1-2)
ctacgtagcatttcaaaaacagtgtgcctatttctcttaagtagcacaacccaaaaccttcaagacattaggatgcagttgtctttcatttttttaatggtggtaaaatatgcataaggtaaagcttatcattttatccatttttaagtgtatagttcagtggcattaagtacattcacattgttgtgcaagcatcaccaccctccatcaccgtaactttttcatcttcccaaactgaaattctacatccattaaacaataactctgctggcctctctctcccccagcccctggcaaccaccattattctttcttactctatgaatttgactactctatatacctcatataagtggactcatacaacatttgtctttttatgatgcttgtttcacttagcataatcaacatttatccatgttgtagcacgtgtcagaatttcctccctccccctgttttttcaggaatgaatttctttcctttttaaggttgaataacattccattgcatgtctataccacattcatttatttattcattcattcatggacatttgggtcatttttatcgtttggttattatgaataacagtgttgtgaacacaaatgtacaaatatttgttcatgtctctggtttcaattcttttggtgcctttcagctttgagtatatggagcaagagacgtgataaagaggttccctaaagcctgaatagtagtggtaaagaaagcaaatatttatccgggtgtggtgatgcacacctgcaatcccagatactcaggagactgaggcagaagaatctcttgaacccaggaggcagaaattctagtgagttgagatcaccccactgcactccagtctagtgacaaaggggaaactccgtcaaaaaaaaaaaaaaaagaagaagaagaagaaagaaggaaagaaagaaagaaacaaagaaacaaaggaagaaagaaaagaatagaaatggaaaaaagctaggcttgttgttgcatttctgtagtctcagctactcaagagactgacgtgagaggcttgcttgagtccaggaaggccaaggctgcagtgagctgtgatcataccactgcatttcagcatgggtgacagagtgagaccctgcctcaagaaagcaaatatttaagattgtacttgtgctgagtgctggatttcaaatgataggggtgcccatgtgttctttaatatagttactgtgtgtgtgtgtgtgtgtgtgcatgtgtgtgtgtgtaagaaagagagagagaggtttgtgtagtcctctaaagtgtgggacccagggcagggcccttgttgcctggacttagggtggtattgtcataagcacatacatgtattagaactgggtgagtgtagcagtgagtgtagatagaaaagaagttgacagactatgcctgggacacttagaaatcacaaagaaaagagagaataaaagaaaagaaatcaagaaaaaaaacaccaggagaatgtgcagacttggaatccaagtgaaattaaatgttggggaattatcgacaatgccaaatactgctaagagattgactaaacaaggactgataattcacctttggacacacacaaaagtagaactcactggtggtgttaaaatgagctgtttcattgactggtggggataaaacctgactgagaagagttcaagtaagaatgagaagagggtaagtagaaacagaaggtctggccagctctttagagaagtttttctataaaaggaagcaaagaagtgggatggaagctagatgaagatgtggtggagtcactagagatttatttttctttttgcctaacagaggtggaacagctgatggccccacatcttcagctgaagctccacagtcacacatacaagtgcctatctggcatctccatttaaatgtctcataggaactcacaggaaaatcaaacttaacctgttccaaatagaactcttgattctccctcactctatccccagtctgttctttcctaagccttccttttctcaataaacatcattgcccaccattcaaaccaaaagccatgtagccattccagattatttcaatttcctcaaaaacagtgcatcagcctgttagttctacttccaaaatacatctctaacttgatcatctggagtactacaataggttccctgctttcattctcgcctctcaccacctattctcacatggcagcaagagtgtaaaccagacaaagttacacctccacttaaagctttgattactcagtaaaacaatgattactcagtacacttcaaatccccactgcttaccttgagctatactgtcctacatgacctggctctttgctccttctccaatctcatcttcacttctttctctctcttgcaccatactccagacatgctggcctaaacctaattatttgtattacaaagatataaaaaaatagagaataatatttatatatatatacatatatatactttttttgagacagagtcttgctctgtcgcccaggctggagtgcagtggcgcaatctcggctcactgcaacctctgcctcccttcacgccattctccttcctcagcctcctgagtagctgggactacaggcgcccgccaccacgcccgactaattttttgtatttttttagtagagacggggtttcaccgtgttagtcaggatggtctcgatctcctgacctcgtgatctgcctgcctcggcctcccaaagtgctgggattacaggagtgagctaccgagcccagccaatagggaataatattatagatattatataataatatataataatattatagattatagagccagatctaatactttaattaatacttagctacatgtaccattaaaatgtaaactacatgtcttttctgaatctctattacctgaaaaagtgcctaacacataatatatgctcaatgcatctggtataattgaatatttgcttcacattaaaaaataagtaaaacattacagatacagtgaatgctccttatacctccttcccttcctctttccccagaagaactacctaccattctaaaggtgatatatgccatgcctataatatccctagttttaatattttgttacttgagcatttgttttctatgttttcaaaatttacagtatagaataatacgttaaatatcccttgcgatttgtttttttatcatgctttatgcctattatgttgatatatgcagttttcatatgttttttggctgtatatttcagtgtgtgaacataccataatttgtttatctatttcttactgttgaacatttaggttgtttcaaatattttgttattcccaatagtgctgcaatgaatatgagcaacatgacagttaagagggtggattctagagccagactacccaggattgaatttcaggcaccatcactagttgtgtcactttgggcacgttacttctttgtgctctagtttatttaattgtaaaatgatggcaataaattttcatgatattgttagtagaattaaatgagttaatacatataaagaacttcgaaaagtgcctggaacatattaaatctcaatgaatattgaccgttattattattacccttattattaggaattgcttaattacaggacatgtacatcttctatttcattaaatattacacattattctcctaagtgatatgtcaatttatgcttccagcaggggtatataagttccattttcctatttcctatactaattaaaaattcctgtcaatctaatggatatgaaattgttgttttacttgtactttgatagttacagcaaaattatatattttttcttgggtttattggccattcagttttcttttttggtgaactgcctttttacctacttttctttctctctctctttttttttttttttttagtgtccctcaggctagaatgcagtgatgccaccttgggtcactgcaccacagctttgatttccagagctcaagcgatcctcccacctcagcctcctaagtagctgggactagaggcgcatgccaccacgcctggctaattttgttttcattttttgtagacacaagatctcattatgttgcccaggctggtctcgaactcctgaactcaagcaatcctccggccttgggctcccaagtactgagattacaggcatgagccaaaacgtccagctttttaatttacttttctattgggttgtttgcctttttcgattttgggaactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgtctggtgagggctggctttttggtttacgtctgtcttctgtttcctcatatggcagaagggctgaggtacctctccagggccccttttatttatttattttttaatttttatttttagtgactgggtcttgctctgtcacccaggctggagtgcagtggcatgatcatagctaactgcagcctccaaatcctgggctcaagcaatcctcccacctcagcctctcaagtagctgggactacaggcgtgcactaccatgcccagataattttaaaaaatattttgtggctgggcgtggtggctcacgcctgtaatcccagcactttggaaggccaaggcgggcggatcacttgaggccaggagttcgagatcagcctggccaacacagtgaaaccccgcctctactaaaaatacaaacattagccaggcatggtggcggacgcttatagtgccagctactttgggaggctgaagcacgagaatcacttaaacctgagaggcagaggttgcagtgagcctagatcgtgccactgcactccaggctgggtgacagagtgagaccctgtctcaaaaaacaacaacaataaacaatggttatatatatggggaatatcatttagtctgtggcttgtctttgtgtgctttttcaacttgttatacggaagtaacacattttaatacagtcaaatctaaatattttcccttatggtttgtgcttttccggtcttattaagaaattcttagccgggcgcggtggctcacgcctctaatcccagcactttgggaggctgaggcgggcggatcacctgaggtcaggagttcgagaccagcctgaccaacatggagaaaccccatctctactaaaaatacaaaattagccaggtatggtggcgcatgcatgtaatcccagctgctccggaagctgaggcaggagaatgtttgaaccaaggaggcggaggttgcggtgagctgagatagcactgttgcactccagcctgggcaacaagggtgagactccgtctaaaaaaaaaaaaaaaaattcttccctatttttgacattataaagctatttttattttctgaaaaatgtttgcaggtctttaatccatctcggccttatttttggaaatggtttgaggtagaaatctaatcatttatttcccttttggaaaaaatgtctcatcgccatttattgaagagtctgtcctttcgcccactgacttgtaatgccgtctgtatcataaaccaagttcccttgatgttactcttcatttcggcctcacaatctttgcttattttccttctaccagggatgcttttcgctatgttcctttcagggctaccttcctcttgtcccttcagatcgcagttcaaatgtcatccccctcaaatctagattgctctacaggcatttctggctccgtgatcccatgacctcaaaggggtctaggtgggcatagcctctagccagttgttgctaggctgttgtcaggactggcgatgcgtaggccactgagagcacccggagtccgagtgacggaatcaggcgggcgcccgcgtcgctaaggagtgcgtcacagtgcgcgggcggccgggggcagggccagggctgagtcacgtggcttggttgcctacgcgctggtgggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccaggtgaggggctgactggctggctgagggcggcggggcggggaagtcagggaaggaggccctggatcctctgtaagcagccgggtccaaactgaaaggcgccacctccgtgactcgccgcgcccccgggccgggaaggcccagctcggaagctcgaccgctggcccccctgcgccactgcccgactttggccaccgctgggtcgttttgctctgagccttactgagatcccggagggccctggcgggtccctggaagggctgtgccctgtcgccgttgcctgtgtcctggccgggtggttggagcgccactgccccctgagggattgattgcttgtccctgccgggagatccttttttgagtggagtgcagatctccgaactggtaaacccgggtttttctgaataatccagagaggtgtgttggggccagagacttatttttggagttaacatcttctgggctcctaaaaggtatgacagttggcttcgaaaggcgtctagagctttctgattagggattgcggagccggttggttgtttggtttttgctttttttttttttacgtttaagccgttctttcgtcttttctgtatttctttgagaggattgtgctaccgagaataaggctgactctttgagtagaagaggatgggaagagggatgtagagtgtggcctcttttggcagtcgtatgatcatttctgtgccttggtgggtcctaacctatgattacatatttatgggtgtgtttagtttagtctccatgaccactccgagatttttctgtatgttttcaagtcttttacaaatayaaatattggccattattatttctgcttccaatgtttgttctgtcaggtttcagaggcacccatcagctccttatctgttgtaccttagaaaatgcaaaataatcgtggcatgttggtacttggagtctaataagtagtccagtatgctgaataaattgcggcgttctaaaataataattttggggggcaatttgctctgttggtccggagtagaataaaagttagcttgcttgattgcttttctyccctctctctgccgaggcagaagcacctcatctctctgaatggaattttgtccttactaatcttttccgtggattgtaccactccaatttttgtgtgtacaacctgcaacattgccctgtactattaaatgttaacgtgttgttgttctctgcttccttagtagtagtcatccctgtttagtaagctcatttattttacagatttttactgacttcataggatagtgccagggactttaccaagtgctggggaaacatgagtaagacagcacttagccttgatgaacttacagttggtgggaggtggtaggaatgacagtatttccagtgcggttttggtaatgatggaaaaggaggtgttgtagagacaatggtgaggagagagccttcatgggatatcctgatgggaaagacaattaactagaaaaataagtaaaaaggttaattataaattgtagtatgtgcttagaaagaagtaactgggagaggccactttagttagtaagaccctatgggctgcaaggatgaaaatgagtcacgtgaaggtctggggtggggaaagcatcccagtgccaaaggtagagattggtaaggacccagaatgctatgggaggaggggaaactaatggaaggagaggggtggtgcaggaaaacaactgtgggttttgggtaaggcttctaagcttgagttgtctccctggaaagatgacaagaatgaatgtaaccagtcacattgaagcttgtcaaaggatcacatatatatgtattctgctttatgtctagtgcttgcaactgcagttttgtttaaggtaatgttttaatgtcttgagtcttggtgacaccagagatgtgatggcccagaagaatttttaaaagaaagcatgtgtaatttgtcttttctatgaagttttttttaacctaaaattttcccaaaaaatgttttttagactaataaatgaaacaagaacaagtattcctgtaacactgtattgtaatagaaagcacatgggattgggagttaagttgggtcttgactgtgactttaccactgcttagctaataaccttgggtaaccatgtctgcaaaactatcttattttctgacctttatctccttataatgctttatacaatcagaatagaaaatttgtgtacaagtcttcacaaaatttatcatatttttgacacattttcccctgtagtccagataagatcaactgtgtccttgatgaccagatagagaaaaagtaaaaattgtatgaagaagcaggaaaattttcaccatcagtaaattttgttgaatagctcttggtttcacatttgaaaagaagaataagatatattcatttacttaaggaacactgattgtgtgacagttctgaaggtgggagcctagttaagacagttttctcggactctaggagaggagcacataatatataaagatagattgtaggcatttttacattataaaggtctgacccctgcttatgggatgcttaatactacaaatgtattttcatcagttatttagttagaaatgtcctagagacttagattgtaccaagtaatcccttttgcaacatcctgggaccatattctctccaactcttgcagcacttaaaagaaatggctctatctttgggattgcaccaaatcaagaaataaactaacatatgagtgaatagagaagcttgtctcattctgggcatattttcaattttcataagtttgtgaagatgataaaatgaaacactgaaagtaatacttactaagaaaatgatacttaggtcaaactgtattcagtgaaaattggtattaagtgactatgggatgtggtttgttttcctctttccttcagttccttttctgaaaccactgccagacagtgtggataagattaactttagaaaacagtctttctttgttttcttgaaaaattgatgatgtcttctcaagtttttcctgtattttggggaccaggattccttaagttttacaattggtgtctctatttgtaacacaaattttgaagactttttttttagtaaacttcattatcaaaattgaaattattgagtgattatgtgattacactttgagaatactgggcaaagtaattttatgagtaaaccacgtttatatgagacacttttaggttcaagactaacagtgacttcgtagatttttgatggctaaaataagtaagtactccattaaaatttccatttttcctagattagtgatggggagtacaagggctctgagtcagatagcctatgtactggcttcactattgaaatagttgtgtgaccttgggcatgttattttccttaaacgttaattcttttgcaaatggataatagtacttaagttttgtaagcaaattcattgttgtaaggacttaataagaaaatatctatttttaaaaatgccttcagaattgtctgtgttatccagatttcttagctttgtaataaaaagttttcacaaccttggtctcagcatgcttttcagccctccccttgtcagtcccatcacctgaatccaacttgtttactcctattcaggagttctttacttggagtcagtccatggaccaacatgtgattgcagttattcctgtgattaaaattttgtctgtaagtttccaagcacataattttgggaaagatgattttaattttcatttgacttctcaagatccaataaacgtattaactacgttaacgagatctcaggccgtgtctttccctttcattgtgtggttctctcattttctgcatgggagatttttcttctttagggcccagtataaatgtcatcccttctgtgaagcttttcctgatttaccagataggtttcctcttatttgtttgggatttttttggggggacactgtacatacctgtagttttaactcttaattttattgctgtcactgtcttcattcaggctttctcctgttgcagcaacctcttcactaatctcttgttttctgactgacatctgcagttcatctttgtgttctttctaaattataaatataatcttgttcgtcactttattccctaaaatacctcaattcctcccccctctccgccaaaggaaagataaagttcaaacttattagcttggtatacaaagccttttagaatccagaccaccaactcccattttcccagcctcattaaaaaagttggtttgatcccaccttcaccactgtgtccatttctcactctgcctaaataacccggggtcttcctttccccatctacctatttatcctttaagacctggctctaatattatggtctttcagctttttctgatttcagcaggcagaattaggtggttctttctccaatgcattctattagcttccagtacataaacgtggtgcctacataatttgtttccatgtttgtcttttgtattgacttgtaaatcaacaagagcaggggtcttgtttattcttttttgtatacttagtacctagcaattagtatgatgcctggcacacaaaactaatttgttaaatcaattgtagggacttcatgatacacacatgagatagacacttaaaacagtactttagggggaacctctaatgtaaaatctagtatgtaaaaagcaaattaaccataagaaattactataaagggagaggttgtggagaaataggaacacttttacactgttggtgggaccgtaaactagttcaaccattgtggaagacagtgtggcgattcctcaaggatctagaactagaaatatagaaataccatttgacccagccatcccattactgggtatatacccaaaggattataaatcatgctgctttaaggacacaggcacacgtatgtttattgcagcactattcacaatagcaaagacttggaaccaacccagatgtccatcaatgatagactggattaagaaaatgtggcacatgtacaccatggaataccgtgcagccataaaaaaggatgagttcatgtcctttgtagggacatggatgaagctggaaaccatcattctgagcaaactattgcaaggacagaaaaccaaacaccgcacgttctcactcataggtgggaattgaacagtgagaacacttggacgcagggtggggaacatcacacaccggggcctgttgtggggtggggggaggggggcgggatagcattaggagatatacctaatgtaaatgaygagttaatgggtacagcacaccaacatggcacatgtgtgcatgtgtaacaaacctgcatgttgtgcacatgtaccctagaacttaaagtataattttaaaaaaaaagaaattactataaaggaacaggataggagcttttggccatttcttggagacattatttatcaatctaagcctacattcatataataatgtatacatttacacgtgtgcagtgaggaatagcattgatggagagagaaaatgagaggcctagtattgaggaagagtagtcacctaataggacaatagtttggagatgccaagatgggtataatcagtccccttaccttgaggttgatggccatgaaggctcttgagccttacctctttcatatatttcaagaagtttttaatgcattagcttctcttcttgcgctgccttctttttagcgatatctaaatagaaactacatgacaagtagttatcatagcaaaagctagctttgtaatgcacatgacaaaaacatagtataaatgtgacccgtgaagcagtgaaaactttgggtgctgtcatttactgtggtaccatcttgtctcttactgtgtactgtgacctctagtggtttctgtttcttccatggatcatactcttctgaatagtgttgacaaaaacttactgcaagactgcaaagactaaaacgtgttttattttcattcagatctagatacttgtcacctttcccagtgaccttccttgactgtcttatctaaaatagcacttccctattgcctttcacctctttaagtactgctttatttttcttcaaatcactactaatcttgtatgtccgtctccccaactgggatgtaagtgccatgaaggtgttggcttttatttacctagtgcctagtctctaaaacttaatgggtactcactaaatgcttgttgatcttgatctcctccctttcctgtatctcccacttgaatttttgagagtaataagcaagtcttaactgtctttatcaagaaatagggacatttggccagctgtgatggctcatgcctgtaatcccagccagcactttgggagaccaagacgagaggatcccctgagcccaggagttcaagaccagcctgggcaactctacaaaaaaaaaaaaattaaaaattagccaggtgtggtaatattagcacacctgtgatcccagctactcaggaggctgaggcaggaggatcacttgcgctcaggaggttgaggctgcagtaagccatattcgtgccactgtactccagcttgggcaacagagtgagaccttgtctcaataaataaataaatagaaagatactttttgtttgtttgtttgtttgtttttgagacagagtctttctctgttgcccaggctggagtgcaatggtaagatagcccactgcaacttccgcctcctgggttcaagcgattctcgtgcctcagcctctagagtggctgggactacaggtgtgtgccaccacgcccagctaatttttatatttttagtagagatggggtttcgccatgttggccaggctggtctcgaacttctggcctcaagtgatctgcccacagcttcccaaagtgctgggattacaggcgtgagccattgcacccggccaagaaagaaagagacatttttttgtcaaccagtttatcctgcttcccagcagggatcacacnnnnnnnnnnnnnnnnnnnnggtttattggccattcagttttcttttttggtgaactgcctttttaccaacttttctttctctctctcttttttttttttttttttagtgtccctcaggctagaatgcagtgatgccaccttgggtcactgcaccacagctttgatttccagagctcaagcgatcctcccacctcagcctcctaagtagctgggactagaggcgcatgccaccacgcctggctaattttgttttcattttttgtagacacaagatctcattatgttgcccaggctggtctcgaactcctgaactcaagcaatcctccggccttgggctcccaagtactgagattacaggcatgagccaaaacgtccagctttttaatttacttttctattgggttgtttgcctttttcgattttgggaactatttgtttgtttgtttgtttgttttttgagacggagtcttgctctgtcacccaggctggaatgcagtggcgcgatctcggctcactgcaacccctgcctctcaggttcacgccattctcctgcctcagcctcccgagtagctgggactacaggcgcccgccaccacgcccggctaattttttgtatttttagtagagacggggtttcaccctgttagccaggatggtctcgatctcctgacctcatgatccacccgcctcggcctcccaaagtgctgggactacaggcgtgagccaccgcgcccggccgagaagcacttattaataaatatatcatacggagtgaaacacagtttaggaaattctgatataagaaaaaagaacataggctctacagtctaaagaactcaccaccacttgccagctgtgtgatcctgggaaagttacttaacgtctctggacctcagttttctgtctgtaaaatgaaaaatcacactacccacctgagggcttggcacacaaaaagatcctcaataaattattcagtccctcaaatttttcatataatggattgtatgttggccttgtgacagcaatgagttttattatataaatgtttatttatgttaaaacatattattattttttttgagacggagttttgctcttgttgcccaggatggagtgcaatggcatgatttctgcccactgcaacctctgcctcccaggttcaagtgattctcctgcctcagcctcctgagtagctagggttacaggtgcctgccataacacctggctaattttttgtatttttagtagagatggggtnnnnnnnnnnnnnnnnnnnngaggggcggaaaaaaaaaaatgggtgcttcttgaaataagggttctatgttcatataagttgggataagcttttttttttttttgagattaagtttcgcttttgttgcccaggctggagtgcagtgacgtgatctcggctcactgcaacctccgcctcccgggttcaagtgattctcctgcctcagcctcccaagtagctgggattacaggtgctcatcaccacacccggctatttgtatttttagtagagatggggcttcatcatgttggctaggctggtcttgaactcctgacctcaggtgatccacccacctcaccctcccaaagtgctgggattacaggcgtgagccaccacacgtggccatgggataaacattttaaatgttaaaatacgttgtgaatttccaagagagacattacgtattgtgcagcatttgccaaacttaccaggtctagaacattttgccatattctaaagcctttatcagctcaagagtcacattgctttttttttccactacaataaagcaaagtgcagaggtgaagaggtgattgccttgtctttctgcctgccactagttttaattatttagttttagcctaaaacataattctgagcttttttttgttttttggtttttttttgagacagggtcttgctgtgtcgctcaggctggagtgcggtggtgcaatcacagctcactgtagccttgttagcctcaacctcccaggcttaggcagttgtcccaacccagcctctctagtagctgggaccacaggcgcgtgccaccacgccctgctaatttttgtattttgtagagatagggtttcgccacgttgtccaagctggtttcaaactgctgagctcaagtgagcctcccaaagtgctgggattacaggtgagtgccaacttgcccggcctcctttcattctttaggcatgtttccttcagttctttgaatatacagttggttctcgctatttgcagatactgtatttgtgcattagcctacttgctaaaatttatttgtaaaaccagctgactctgactgagctttttatgaaaaaatttcacctccaaaggttttkcagggattaaattatgtgtatttgttacatatgaaaaatattttagtgtattataatttggggaaagtagagaatgagttatatttcagacgtatcttgagtcaagatttattcttataggtttacctatattgctgcaacataggtaggccgggattactaatgtatttgtttatttctcgccacttgtgctaagtctgattactgtctttttgagtgctattgttattattattagtagtagtagtatttggatctagcagcttatggtgctgacatttgatttgatagtgtttttgtttgtttgtttgtttgtttgttttaatttagagacaggatcgtactcccttgctcaggctagaatgcagtggtacaatcttagcttacagtaacctcaaactcttaggctcaagtgatcctcccaccccagcctctcaaatatctaggactacaggtgcatgccacagtgcccagctaattgaaaaataatttttgtagagacagggtctcactgtattgcccaggctggtcttcaacttgaggccttaagtgatcctcccacctcagcctcccaaggcactgggattagaggcgtgagccaccactcccagcctgatttctcagtattcttactcccaaggaaataacctgaatgtgtcacgttagccagcacaatttcttattaatgtggacatttgttataagaattgttattgtatatgataaaatgtatatccttgcttgggaattgcatttttatgatatataattttataaaataggcatatttttgtgattctgttgtctttgcttttttcaggtatatgtttaaaatatataaagtatcctaaagtaataaagcagatgtaaacattttagtttttgtgactcaaaactagtggatgctcattctagaaacttaaaacaagatttacaaatagatgaattagatagtgaaagtaccatataaactcacttttaatagcttggtgtatttatcagatttttggaaaaatacatatagaatgtgtgtttatataaatattacaatttctaattgtgcaaacaactcatgcatacattctaattgttaaaaattagaacagtataaaaggggagaataagaagtaaaagctcctgtcatatacactcttatgtattccagtactaccttttcctaggtagaccattgttaacagtttaggaatgcatatctatagaatttttctgtatgatgtgtacatatatatgtactatttttagaaaaggtttcaagcttatatactaaaacctgcttattattgtagacatcttttcacgtagaatatgtgtagacttactgtatttaagaaataaatgcatggtattccatcagaaattgcattgattttaaattctacaggtagcaacaccttcaacactcttaactaaaaaaaaattttttttaaactataaaagcacttcttgtggcaaaaaatacagtacagagggtttaaggaaaagtaaaagcctctttccttctgccctcaatctttccagtcacttcccagaggaaattactgttaacagtcttgtgtgtccttaaaaacacaagtactcatccttttgcaatttactttttaatttgatatgttgaccctttatgagtacatttggagcatgcaccataatttaaacatttgtgttattttgttattataaacagtgtcccatgaacttccttaaatattaagtgctggttatttctatctataatataaattcctggaattgaaattataggattaggccgggtgcggcggctcacacctgtaatcccagcactttgggaggctgaggcgggtggatcacctgaggtcaggagttcgagaccagcctggccaacatggtgaaactctgtctctactaaaaatacaaaaatcagcaggtagtcccagctactctggaggctgaggcaagagaattggttgaacccaggaggcagaggttacagtgagctgagattgcgtcactgcactctatcctgggcaacagagtgagatgccaactcaaaaacaaaaatgactggattaaagaggatgtttaagttttgatggatacttgcctgtactctatcctgggcaacagagcgagacactgactcaaaaaaagaaattactggattgagagaatgtttaagttttgatggatacttgcctacaaaaagttgaatatgtacttccgccaatagtgtttgggagtccccgttttactaaatccttgccaatgcttgtattattaaacttattaatatttgacaatctgataggaaagaattatcagattgttacactaatttgcattttagtaacattcaggttttttttttttttttttttgaggcagagttttgctcttattgcccaggctggagtgcaatggtgcgatctcggctccccgcaatatctgcctcccgggttcaagcgattctcctgcctcagcctcttgagtagctgggattacaggcatgcgccaccacgcccagataattttgtatttttagtagagatagggtttcttcatgttggtcaggctgatcttgaactcctgacctcaggtgatcctcccgccttggcctcccaaagctctgggattacaggtatgagccaccacgcctggcctacattcaggtatttttatatgtatcagacatttacatttttttttgtgaggtttacctttttcatatattatgactatttaaaaatgttgttaaaagtcattaaaactagattttgtccaatcattatgatcatgtaatttttttttttttttttaagacagagccttgctctgttgcttaggctgtagtgcagtgttacaatctcagctcactgcaacctctgcttcctggattcaggtgattttcatgcctcagcttcctgagtagctgggattacaggtgtgtgtcatcacacccagctaattttttgtatttttagtagagacgaggttttgccatgttggccaggctggtctcaaacttctggcctcaagtgatccgcccaccttggccttccgaagtgctgggattatagccgtgagccaccgtgccaggctgatcatgtaatcttgagattttaggtctctttgaagttctcatgaagcggaacatgtccaaagaattataattagagctatagcctaacctgaagccattgggatgtgtgatacacttttgtgattgatggtggctctgtgagaggtttgtcagtgtagtcatttattgatctcttataatcaattcttctaaactctggaagactaagtcatagctgagtaactggaaagactgtagtgctttccattagctaactttaaaaaatgttgtgacctggccgggcacgatggctcacgcctgtaatcccagcactttgggaggctgaggcgggtggatcatgaggtcaggagtttaagaccagcctggccaagatggtaaaaccctgtctctactaaaactacaaaaatcagctaggcgcagtggcaggcgcctgtaatcccagctactcgggaggctgaggcaggagaatcgcttgaaccctggtgacagaggtggcagtgagccaagattgcaccactgcactccaacatgggtaacagagtgagactctgtctcaaaaaaaaaaaaaagtgacctttatatgttttcaaatagagtgccaccaaatgggtatatgaccttggggcaagtcagcttgttatttgggtgcctcatattgctccctaaatgagatgctctttaaggtttgattctgctccaaaattatataactctattgaaaaatgtttgctatataagattcattttctaagtcatctccaaatatttgtcttgtctattcttatcaaaataaattaatcttttaaaagtatgttttatttgtaccatacctatatattgtataaaacagacacagaaatacataaaaggggtgagatttttaaaaactcatttgaatataagtattaatattatattccttctccctgatggattattatttgcccctgtagaataagtgcccatgccagtggaaactactgattagaactgaaagtatttgcgttagttatgctcactctctttatttggttttttcttcatagtgaaatcttgatttcagtctttaaaggacattgtcaatgaaaatgttaaatcaaagggccaagcacagtggctcacacctgtaatcccagtgctttgggagaccaaggcgggaggatctcttgaagccaggagttcaagaccaagactgggcaacgtagtgagaccctgtctctacaaaaactttttaaaagttagttgggcattttggtgtcttagctatttgggaggctgaggcaggaaatccctgaagctgaagagtttgaggttacagtgagctgtgtttgtgccactgcattccagcctgagcaggagaaccaagactctgttctgttatggtgggggtgggggggggagttaaatctagaccagacgttcccataaagttctaacagtaaatgtgcataaaacatcacatttggatcaatcttgtgttttattgtcacgtgaaatggagaacatatatgtatatttgaacctaacaagatttcacttaaaattctcattctggccaggcacggtggctcacatctgtaatcccagcactttgggaggcctaggcaggcggatcatgaggtcaggagttcgagaccagcctggccagtatggtgaaaccctgtctctaccaaaaatacaaaaattagctgggcgtggtggcaggtgcctgtaatcccggctacttgggagactgaggcaggagaattgcttgaacccgggaggcggaggttgcagtgagctgagatcgagccattgcactccagcctgggcgacagagtgagactccgactcaaaaaaataataataattctcattctattcgggaggctgaggcaggagaatctcttgaacccgggaagtggaggttgcagtgagcagaattgtgccactgcactccagcctgggtgacagaacaagactccatctcaaaaaaaaaaaaaaaaaagtacaatttggtgcactttggcatatcttaatatccatgaaaccatcaagattatgattatatccatcatccctagaagtttcttcctactgctttgtattccctttcttaccctcctcttgtatacataccctcccatccccacttaactactgatttgctgtctctataaattagattgcatttttaagaattttatataaatactataatcatatagtctctcttttttggtgtctctgtataattattgaaattcattcatcttgtatatatcagtagtttattttattgatgagtattcattatatggatatatcatgatttgtttatttacctattgatagacatttgaattgtttccagtttttgactactacaaatcaagctgttaggaacattttgtgtggaagtctttgtatggacagatgctttttcttttcttttgggtaaacacctaggtggaatggctgggtcagatgacaggttttccagagtagttgtattttacattcacatcagcgctgtatgagagttctagttttctatctcctcactaacacttggtgtggccagtgtttttcattttagccactctaaaattgctgttagttcattgtgattctaatttgcatttccctaatggctttttaaaattttgagatagggtcttactctgtcacccaggctgcagtggtgtgatcttggctcactgcagcctctgcctcccaggctcaggtgattctcccacgacagcctcccaaatagctgggaccacaggcttgtgtcaccacacctggctaatttttttgtatttttttataatggcgggattttgccacattgcccagattggtctcaaacttttggtctcaaacgatcctcccgccttggccttccaaaatgctggggttacaggcgtgagccagtgtgcctggccctaatgacttatgtcaagtgtcttttcatatgtttgtttgccatccttatatcttctttgacgaagtgtccaaatctttgccattgaaaaataattgttttcttattgttgaattttgagaggtgttgtgtttgtgtttctgatatatgctttgcaaagattttctccctaggttgtgccttctctctttttattattctcttaacagtatatttctttcttttttatttatttctttttttaattaattaatttttttttttgagaccgagtctcactttgtcgtccaggcaggagtgcaatggcgcgaccttgactcactgcaacctccgcctcacaggttcaagcgattctcctgcctcagactcctgagtagctgggaacaggcgcccaccaccacacccggctaatttctgtatttttagatgagacagggtttcgccatgttggccaggctggtcttgaacttccgacctcaagtgatctgcccgtgctgggattatcagcatgagccaccacaaccggccttaacagtgtatttctttctttctttttttttttttgggaggcggagtcttgctctgtcacccaggctggagtgcagtggtgtgatctcagctcactgcaagctccgcctcccggggtcacaccattctcctgcctcagcttcccaagtagctgggactacaggcgcccgccaccacgcctggctaattttttttttgtatttttagtagagacggggtttcatggtgttagccaggatggggtctatctcctgacctcgtgatctgcccgcccccacctcccaaagtgctgggattacaggcgtgagccactgcaccggccaacagtgtatttctaagaacgtaaattcttaatattgataaattgtgtttttcccattatatctaagaaatctgtctaatccgagaccacagagatgttctgctattttcttctggagattgtatagttttaggttttacatttaagtctatgattcatttggagttaatttttatatacggtgtgagggatggatggaaagttctttagatatagatataggtatatctaaactttaaaaaaaatcactcgtgcttgcttcagcagcacatacattaaaattggaacaatatggagaagattagcctggcccctgtgcaaagatgacctgcaaatttttgaagtgttctatatttttcagggagtctcaggccaaggatgtcgtcgaagagtacttcaaatgcagtaaatgaacagataaatctttggctcacaaaaatctttggctcacaaaaaaataaaaaacatatatatatatagataggtatatagatatatctatagatatatatgagtgttatataaatatatctatagctatgtatatgagtgattttttttaaagttgcagcaccatttgttgaaaacctatcctttctccactgaattgcctttgcaccttattgaaaattagccatacatgtgtgtctcattctggattctattctgtttcattgatctgtttgtctactctgatgccaataccacactcttatgttgcattttcaaacaaaatataatatactataaaagctatatagcacatagagacaggaaatagaatagtggttgccaagggctagaaggaggggagaatggagagttgttttttaatgagttcagagtttcagctttgtaagatgacaggagttcagtgggtagacgttcgagtggcagcacaacaatgtaacaatgtgaatacttaataccacagaaatatatacttaaaaattgttcagatggtaaattttatatgtattttaccaccattttgaaaaaatagtttgaacccaaagctgtctttggtgttttttttttttgttttttttttttttttggagagatgggatcttgctatggtcttttttgttttgtgtttttttttttttccccagagatgagggcttgatatagttagcccaggctggtctcaaactcctgagctcaagcagtcctcccgccttggcctcccaaagtgctgggattacaggcatgagccactggtatcccgccttatcaccattttttatttttattttttgagatggagcctcgctgtgtcacccaggctggagagcattggtgcgatctcagctcactgcagcctccacatcccgggttcaagtgattctcctgcctcagcttcctcagtagttgggactacaggcctgtgccaccacgcccggctaatttttgtatttttaatagagacagcatttcgccgtgttggccaggctggtctggaacttccagtctcaggtgatccacctgcccaggcctcccaaaatgctgggattacaggcatgcgccaccacacccagcctttaccaccatatttaaaaaagctattttgtaggatgctggtacaaaatgggtagtcaatttcagttgactgatttcagaaaatgagacccagagaggttatctggtaattgatggggcagagatttgaaactgtagccagaatgcctgttatttccctctgttgttacacaactacctcagaattgtaatacttttacccagcatgataaagtttgaactttacaatctccagatttaagaagtattgtaagtcagtccttttagtaataatggctcgctaatgcagaaatggaggatggtttgaatttatcctccctgcccccagcccccgtcgtcttccttttgcatgatcatccacttcagtttcttgaaaatttctaatccaaagtctctagacttaaagttaactcttttttttttttttggtacttttattgtggtaaagtatacgtaacatagaatttgccatcttaaccatttttgagagtacaacttagtggcattaagtacattcacattgttgtgcaaccattacctccatccatccatccatctccagaactttgtcatcttcccaaagtgaaagtatgtacccattaaatactaactccccattcccttttttcttcaccttctggcaaccatcattctactatctgtctctatgaatttgactactcttaggtacctcatataagtgaaattgtacagtatttgtcttgttgtgactgccatatttcacttaatatagtgtcctcaagatatatcatgttgtatcatgtcagaattttcttcccctttaagactgaataatactccattttatggatatatcacttttgttcatctgttcatgaacacttggatttcttcctccttttggctattgtaaataatgctgctgtgaacacgcgtgtacaaatacctcttcaagatctgctgtcacttctttgggatgtgtacactgaaatgaaattgttggatcatatggtatttctgtttaatttttggaggaaccaccataccattttccaaaccactgcagcattttacatttctaccagcaatgcacaggggttcctatttctccacacccttgctaacactttttctgttctttacttttcttttcttttttttgagacagggtcttgctttgtcacccaggctggagtgcagtcacatgatcttgactcattgtaacctctgcctcctggaatcaagtgattctcctgcctcagcctcctgagtggctgggattataggcgcccgccaccacgcctagctaatttttgtatttttttcagtagagacagggtttcaccatgttggccaggctggtctcgaactcctgaccacaagtgatcaacctgccttggcttcccaacgtgctgagattacaggtgtgagccacttggtctgacctcttttattttacatgatagtcaatcctaatgggtgcgaagtcgtatctcattgtggttttcatttggatttccctaattagtggtgtttcatatcttttcatgtgcttattggccatttgtatgtcttccttggagaaatgtcttttcaagtcttctgcccaatttttaattggcttgtttgttttgtgttgttgagttttaggaggtctttatgtgtttagatattaatccatcaacagatataagatttgctgtattttctcccattttatgggtttcctttttactctcttgatagtgtcctttgatgcacagaagtttttaattttgatgaagtccagtttatatatttttgtgttgcttgtgcttttggtatcatagtcaaaaaatagttgccaaatccaatgtaatgaagctatttatctatgttttctcctgaagttttatcattttagttcatatgtttagatctttgatccatttcaagttggtttatgtatatggtgtaaggtaaggtccagcttcagtctattgtatgtgaatatttggttttcctaacattgttgaatgaaaaggctgtctttggccagctgcagtggctcatgcctgtaatcccagcactttgggaggccaaggtggatggattacttgaggtcaggagtttgagaccagcctggccaatatggcgaaaccccatctctactaaaaatacaaaaattagccaggtgtggtggctcatgcctgtagtcccaggtacttgggagaacgagacaggagaatcgcttgaacctgggaggtggaggttgcattgagccgagatggcaccaccgcactccagcctgggcagcagagcgagactccatctcaaaaagaaaagaaaagaaaagaaaatgctgtctttttccctttgaatggtcttggcatcctaggtgaaaatcattttcatttgaccacatatacaaggatttatttcttggctttctgttagattccattgttctgtgtgtcttttatggataactctgtagtaattaggtgtttagattattaaaggaatatatgaaaaattttcttgaactgcaacagtgattaaaagaatgtaaattgaataaacaaagtatttcttctattaagctgatcctcacaagttatattaaaattataatatctaataattgttacagctcctcagtctgtcaccctgtaacaccaataataggaatgtacattggaacaaattttccggagcagaatttgacactgtgtaaagccttaaaaattatccacccagcaattccatttataggacattattataagaaaattgtcatggatacatgggaaaagttagataaggggtgctcattttagtgttagaggggtgttcatcttaatattttatatataatactgcaaagttagaagacattatgtccataaataaataattgggtaataaattgtatccacacaaagttgtgcagccataaaaacactgacattgaagaaaactttacaataaatggaaagacgttatagcatgattctattaaaatgttcggtttaggcatttaaaaaaaccctcaagcggccggcatggtggctcatgcctgtaattccagcactttgggagcccgaggtgagcagatcacgaggtcaagagatcgagaccatcctggccaacatggtgaaacccccgtctctactaaaaatacaaaaaattagccaggcatggtggcgggcgcctgtaatcccagctacttaggaggctgaggcaggagagtctcttgaacctgggagggggaggttgcagtgagcgcagattgcgccactgcactccagcctggtgacagagggagactccgtctctaaaaaaaaagaaaagaaaagtaaaggaaaacccctcaagcttaatgtattgcctgttaatagtggtctgtttctgggtggtggtattatgggttattaaatttttatttttgcatatgtatgtaacaatgttatgttacttttatgacaagacagtaaaaggcatttttgaaaattgaaaatgaaataaaactagaaagcatagttaaatcctgtggcagaatcggtatctaaaaataatcttagtaggctgagattgatggactgaatccagtgaagtttaatcaggatggatgaaaaaagtatagacagatagataggtagatagatagatagatagatagatagatagatagagtaataagttagtcatatcactggctttaagaaaaccacctataaccaatatagaaaatgaggcagggggcatagtggcagcatatgttaaagacttagggggtttaatttactctagccacttaactttctggttgtaagcagccagctgttctctccccatttcatttcatctcactctcagcttagtctcttgatggcaaacctccatcaagaggtggtgcttcctcatgctgacatttaagtctcttcagcatttactctgatctgttctagccatctagttgtctattcatcttttctgacttttttcaagttctttctttggagtcctcctgttcccctcacttttgctcgtacttcagagatccatctcaagtgctgccctctcctggaagtctacctcttgtagtgcagtcacattttactgaaatgtataattctgggaatttcacatgctgagaaatttaaataaaagtttcttgctttatgtgcaaaatttgaaataatccaaacccctctctattagaaaacacataacttcctattgccatagaacatacagctttaaaaagaaacactagctatcttttgtcagttttttgtgacccaccagcattctgaagtacaggatatctgtcagtgccattgcttgaaaacattccccagaagcattcactttagaatggaagttagatgttgtaaactcggsaagaaggccaaatgatgaccatgacacaacttgctacaaaatattaaagctgatgctgggggtgagggggcagaatttaaaagcacacttaaaatagttgaattgtgaaaaggcataaagaaagcgtggtgattaagtgtgggctgaggagccagatggctctagttcraatcctgaatctaacacctattggatgactttgcccaaataattcaatctctcatgtttcctcatttaaaaaaaaaaaaaattcccaaaagacaacttgacagtggctcctcatttttgaaatgggctgataataactcctagctcatggagttgtgcatattaaataagtttagtggccgtaaagctcttaggaagtgcctaacccatactatgtgctcagtaaatataattatttcattaggaaagttaatcctgaactatgtgaaatttaaattggaatgtattctttaaacattaaatgtgaccatcctgaaagaaattctcctttcttgatagtttcaaggaatagtcagaatgctgccaagctccttgaaaccatgtagtgagaaatgtagagagaattaagggtgaggggagattttttttgctttgaaaatgtagtcatgcttattaaagaaaatttgagaagtttagaaaagtataaagatgacaaaaattgctcatattcctgctacctcagtgctaaccatgtaagcattttagttaatttcttctagtcattttccccttggacattaattttttcaatgtacagacatacgtgattataacacatatacagaactagaggttatttagcctagagaagtgaaccaatgtagcagtctagatgagggatattgggggcctggtttaggtgaatggctacagagataaagcatagggacaggagacaaagatatttctgagatagaatcaacaaactttggtgtggtggtttcaaagatagttttttagctctggctcctgaaaggaggcagatggaacataggaggaagagcatatttgctggggaagatgtttggttttggacatgctgagtttgagatttgaataggacatccagatggaaatatgtaataggcagttgaggtatatagcaaggacttgagagagtaatttgagggtaatctgcttgggatgtgaatgagagcaccgaatagtcaaatatggtgcgtaagtgagctaattttttacttatatatctgaccccttagtatatatcatagcctttcaagggcaggaatagagtctccatccttacttcccagcacagtacaaaatagtaggtatttgtggaatgagtttactgaaacaaaagagagaggtcattaatttggtcactgtagaatgaactttaggaggtcatctttatcatttattgccccttttctcttcagttgtgatttcagttcctaaagaaaaataagagaccgtggctgggtacagtggctcacacctgtaatcccagcactttgagaggccaaggtgggaggaccacttgaggcccaggaatttgagaccagactgggcagcaaagagaccctgtccctacaaaaaaaaagttttttttaattggctgggcatggtgatgcacttctccagtcctagctactcaggaggctgaggtgggtgggagagaggatcacttgagcctaggagtttgaggttatagtgagctgtgattgaaccactgaactctagccgggttcaagcaattctccagcctcagcctcccaagtagctgggactagaggcatgcgccaccacgcccggctactttctgtatttttagtagagacagggtttcaccatgttggccaggctggtctgaactcctgacctcaagtgatacacctgcctcggcctcccaaagtgctgggattacaggcgacagccttgcctagtccagttttttaaatgcaagattaggttgaaaggattacagccatcctgttatttggatggctgaatcctttcaacctaatcttgcattaaaaaaaaaaaaaaaaaaaaaaaaaagccgggcgcagtggctcccagcactttgggaggccgaggcgggcaggtcacgaggtcaggagctcgagaccatcctggctaacacggtgaaaccccgtctctactaaaaatacaaaaaaaaaaaaaaaaaaaaaattagccgggcatggtggcgggtgcctgtagtcccagctacttgggaggctgaggcaggagaatggcgtgaacctgggaggtggagcttgcagtgagccaagatcgtgccactgcactctagcctgggctgacagagtgagactgtctcaaaaaaaaaaaaaaagcaaaaaaaaaaaaaaaaaaaaaccacaaaggctggatgcgaggtggcttttgcctgtaatcccagcacttggggaggccaaggcaggcggatcacttgaggtcaagagttcgagaccagcctggccaaaatggtgaaaccccatctctactaaaaacaggaaaattaaccgagcctggtggcgcacagttgtaatcccagctactcaggagcctgaggtgaaaggatccacttgaatctgggaggtgaaggttgcagtgagccgagatttcaccaccgcaccccaacctgggtgacagagtgagacttgattaaaaaaacaaaaagaaagaaagaaaatgcctggctagccacagtggttcatgcctgtagtcccagctacttgggaggctgaagtgggaggatcaccagcagtgatagaatgagactctatctcaatttaaaaaaaaagtgataatgaagaagattgattattccagccattcttcacatacccagagtatgcttatagtgggtataagagatctcactacttaatttgaaccaacacatgagggggtaaagatttaggaatataaaaagtataaattagtatagagcaaactggaagttcctcaagagtattgaatctttgaaattgtgtagcttacagaagtcctggtggaatgtctgtcagaagctattagattggtggcaagagcgttctaagtggacaggtggattgtggaaagactaaccccatctgtatgcactctgtccttctctttgcatactttagttagcagttggttaatttgcatgtgtggtttcagccatcatgttgtattgactcattctgaaagctctgtgaggataggccacatgtctgcccgcccccactgcatctagcactttatgtgtgataatctattgaaaaatatttgtcaaatgaataaaatggtgaatgtattcagcagacatttagtgagacttgagaatgtcctgtgggggtggaagtgggtagaggagtggtaggcctataaggattgatgagacataatgtctgactttaaggaacataaatctggcactaaatataaatttttgaaactccttaattcttagattagccaatgcagacagtaagtaacttactgacctaaaccagaatttttttgtaacatagattttaataaatttctttgttttttgttttttggtttttttttttgagacagtcttgctgtgtcgccaggctggagtgcagtggcgcaatcttggctcactgcaacctccgcctcccaggttcaagcgattttcctgcctcagcctcctgagcagctgggactacaagcgcgcgccaccacgcccatctctaatatttgtatttttagagacggggtttcacccatgttggccaggatggtctcgatctcttgactttgtgatccgtccgcctcggcctcccaaagtgctgggattacaggcgtgagccacagcacctggctgattttaataaattaggtgaaatcttagttatgtaacagacacccattctgcattctttctctactaattcagctgggaagcaggattgcttaggggtcagttttataatgttactcagtttttttattttattaaaattagggatttgattaagtggtgacatgttgcttttctgaaattacagaagggcatttatctaaagtgactgtgaccaagtagcaagatacttaattgagtaggtcggtatactaaaaatagctcaactgactgtaatgattcaggtatgcaaagatcagataatgcaatatattagttaagggaacttttactgtatatggtataatggtctatggtatatttccttgtaagttgtttctctctctctctttttttaaatgttaaagtaatcaagatgatgctaacagtcagttaccagaactcatacagggaccatttgtgtggaaactaaagctgcagaaaatccagcagaatcctgcgctactattgtagttatttgtagttgtttaggcagaaaaatcaaagacaggaagttaggaatgtttgaagacattattctagggtaatgaattcagataagatgtatttcactcatgttaaagctatcctctgaaaataagacttgcctatagaagtatccccaaccaaaagcctattaggaactccctagcccagtcagacagaatgtgtattccagggagaaggctgtatcctgcttatgttagactgtactacatacttcacgtcttaactagatataccaattaagaataggcaaaacctaatcagttgtcagaaggaagatatatatgaacaagagagaaaacaactccatggaactcagaaggagagtccccaaacatgaatttggcagtgatttttcaacactgtccagggagaacataagccagctttccaccatcatttggacaaatttttagtgataggacacatataatttatcaggctttattgtggtttcattttcttttggtttagattcaatactcaccagataacttctcagatgccacagtatgaggaatagggtaccctgtgtggtaagaggactattccccccattgtaaccaaataaactggcatttggcctatatggtaattttcttcataaactttataaaaaataaatatatattttgttgaggatacagggctagtgaaaaataaaaatatcaatataacattaaccttttagaaattagttagcataaattaacccttggaagcctaatcaattccatgtgtccagaaaaaaaaaaaaggattttatggtgctgtagaactgagagtcatattcaggaataattcatctcttgttgtagaaggcagggatcatagtcttattcttatgtacccagtgcttggcacatggttgaaaactcattattgaattatagagatggcaactccagacctatagtgagaacaactagacattttatggctctactcttagaattattctgacatcaaaagagtagttctgccatttctttaactcagcagaaatcattcattaagtgatgaaaatagaagcttctaaacaaaccagagccttaaaaggcaaataaaaggtatatgcatctgttagaaaaaaaatgggagagctatgtggtgtgtttgaggacaaagacaatctgtttcattatttttatttgtaaataatttttaattttattttgtagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgtaagtttgagaacttaaatcactcttaaaattgagtaccattggtcgtgttgtttgcctggtttctctttacagtggcatcacatttattcttcagagcaccattagagtcataccattgaatgaaatttccttcctactcacgttcccaggagatatagtccaagtgaagctccagccaagcaacatcatctttaacttgcctctagagtctcttttcctattcaggcttggaatctgagaatgatatatttctatcccttaggtatagattgatttaaatgacagaatacctggaaactggtagtccttgaagaacatcttggcaaaaacaacatgaaattctgcaatttgattatatttgaactaagaataattttattagcaaaaaatatcagggtacagtataagattaccatcctaagaaagagatcatgatttagcgcgggcatggtggcgcacgcctgtaatcccagcactttgggaagaggctgaggcacgagaatcgcttgaacctgggaggtggaggttgcagtgagccaagatggcgccactgcactccagcctgggtggtggagtggagactgtctcaacaacaaaaaaaaaagaacgtgatttagctgttattttaatatttagctgcatagtagcagacaaaattacacctttattgtaattttcatctgcaaattgaaaagatacaacagccaatcagttttagctgggcatcaccttgttcaacttacagattgtttagtgagatgacttctagtctagatggtttattttattttttttctagcctcacctgttttccttcctattttccagtggccctttatggaagaccagcattcctggttttatgatcatatttttccttctaccaagtcctagtttctgttttacctattgtaatccctaaggggtaaaggattattctgtagggttttagagagatgttgattcattggtattttgagttgctcattattcaagttgtagtgcatttcttttttcaaaaaaatcttcctgttatttcttttctgtgtcttctggataatagtcagaaaaaggaaactcttttgcttggttttttttacaggtaaagaaacgactttgccagtcttcctgcttcctctgcaagtgacagaaacctatagataacagttacatatatttatcatttatcattttatcagctgaattgacagtagtatgagctcccatttttgtctactggaattagaattgtcctatatgggtgcctcttcacacccaaataaacaaaataaaactgcttggaatgtgatttctaaagagcttattatattcttaccaaatgtactaaagcaacaatgtaaatataaagccttgtggtctttctttttttcctcctttttaaattgaacagtcaatataacaactctgaagcaaattttgaagagtaaaaacatttaaaatagcctaaacaaatgtaaaatagatttttagtattgctgtcatactctacttaattattactataaccacctttatatacttactcatttttattgtaggagttgtttcgaattactgctttcagtgtctgaaagtgaactgccatgtgaagtctggctaccattccttcagtctctacaggtgagttgattttaactcagaaaagttttctgtatccaagacacctaattaattactcccagcaaactaaaattggaaccttagaacaaaaacaagtttattatatattgatattaggtcatgaaatgataaaaaggcccttcacatgaaggggatgtattaaaaatgggttttttaaatttggttttgtttgcctctacatagttagaaatcaacaaaaaagtttcattattcaaacataaagtttagacagcataaagctatcaaaatcatacatgattataaagtaacagtatttggatccttcatagcatacttattggtaaccttcaatatacaaaacactatttcattacatctaaggttcacctttttcttcctaacactttaagaattgtacctggctgggtgtagtagctcacggctgtaatcccaacactttgtgaggccaaggcaagtggatcacctgaggtcaggagttcgagaccagcttggccaacatgccgaaaccctgtctctactaaaaatacaaatattagccgggcatggtggcggacacctgtaatcccagttacttgggaggctcaggcaggataatcgcttgaacccagaaggcagaggttgcagtgagccaagatcgcaccactgcactccagcctgagcaacagagtgagactctgtctcggaaaaaaaaaaaaaagacataataaataatagaccgggcatggtggtacatacctatagtcccagctactcaggaggctgaggcaagagaatctcttaagcccaagagtccgaggctgcagtgagatatgatcacaccactgcactccagcctgggtgacagggctcatccctaaaataataggactcgtctctaaaaataaatgcatgcagtcattcatttattgatcactaattatgtaccaatcactgctttacactacattttacttgttttatatcttctaatcaaattacaaaccttatagtgtgagaattatttgaatctccatttacaaatggggagacaggtgaagagaggttaattagcttggacaaagttacacacagatttcaaaccctgagcttactttgctaactacttccttgaggacacagcttagacctgtttcatggaggcacaaataaagacatgcatattaacagacacacttcattatctgaacatttctttcctctggaatacataacccaaaatgaaatgatataatgttctctttagtgagaagaggattctttgtcatgttcttggcctatttaaagccctgtaatgcagtcctaatatctcacatatccgtacagctgctaaaatcatctttcatgcgtagcactttgatttttgtcactctgtgttctgaagcctgccagtcgttttgttctggcatatggcatcctagaagggcaaatcctaattaggactattactactatattaatactgtttgagtatcccatatctcaaatgcttaggagtagtttggattttggaatatttgcattacacttagtagttcagcatccctaatctgaaaatccgaaatgctccagtgagcatttcttttgagtatcgtgttgatgcttacaaagttttggatttgaggaacattttggatttcagatttttggattagggacactcaacctctatcctttttagagggaaatctctcatatttctttattattttcttagcttgcttgaataaaatagttgcctctttttccacttgcataagctttttcaggtttatcagatgtgtaggatatattttttaacatgtgttcagtaaataaatgtagtaggggtacaaataaatgttaagacatgatccctgttgaaatccaaaagataaaaagcccttaagttttcttattttatattataaatggacaaggcagcaaatggtattaaggatacttttggtaagagaatagtttttatcagagcaggctgcaggtagaatatttctcaattactatttacagctgagtaacttttttcctatggacataaaaatatacactctgcaaatgattttttaatgaaaaatgacagcctattttctgcaacttggttttttacataataatcatggacatacatctaagattgcatatgtagatctcctgttttgatgatcacctagaattctgttttgtggttgtgcctttaattgaccaatgtcttgctatttactgtaaatggtgcaagagtgaacatcttgaaaagggcggcagagtggtcttagcaaaaaaaaaaaaaaaaaaagagcatcttgtgctattatttctgtattgtagatttcaagaactgggctaggatatttccaccttaaaaagaaacaaattgaagttttaaaattattcttgaaatgctaccatagtttttgtagttttatagatttaacattatttttaaaaaataactttgctatattagatgtctattggtaacaaaggattacataccattcttattctgagtaaactgtattttgaactttaacaaatgagaaagtagagaacttttaaaaagaaactcaaactgtggtttttatttcagttgctgcatatcatggtgggtggtagtattttctgctaaagtgtaatggtacaggtcagttagacattataaatatgataaacctgacacctcaaatttttaacttttcacatggactttttctcctcactccaaagtaaacgcgagtcattctaagttaagaagaaagaagcctgaggacaagtcaagctgttaaagcaaaattgcagcatttgttaaatattgctattggtgaactaataattagaaatattactttctgtatcaattccatattttaagtcctttctcagtggaaaataatgcaacatattgggtgggtgtgtgggtgggtgtatatgtgtagtaaaagcctattttaacatgaaggttaagggatgggggagactttatatcttgtagttttcacttgagtgaatactaaactatattcttatgcctgtgaacatttttggcttatattttccaaagaaatgttgacgtaaatggaagcttatgttcctagagaatttcaggagtttaaaataagggaaacaaattagaattttagaacatgggaacaagctcaccataatcaataatactcagtagtaatagaggacagtgaaacatatacgtaatcatttatactgaattacatttctgactccttttccctcacccttgaatataagaactttaatgaacaaactattggtaaatacattttgtttgctgagttaataacttagacttttcaggacattttatatagagccacctgtcatttaaatagcaattttttagacgaatttaaacaattatataatgatttgtgtcactaagtaatactcctgtaattcctgttagaggaacaggcagcctgtgtgaatactgcagaattctttaaaagaaagcggcaccaatggctttcaaataattaaatgggcacagtggctcatgcctttaatctcaacactttgggaggctgaggcaggtggatcacctgaggtcaggagttcgagaccagccaggaccaacgtggcaaaaccccgtctctactaaaaatacaaaaattagccaggcgtggtggcaggcgcctgtaatcccagctacttgggagattgaggcaggagaatcgcttgaaccaacaagagcaaaactccatctccaaaaaaaaaaaaccaacaaaacaaaaaaaataaatcagcctccaccagggctatcattcaagtcttcagagtctgctagtaacatgagtgatcctaatagtagggcactccaaatatccaacagtaatgcaaggacctaacttgaattgtgataattttaccagggaggaattcaggaaaacgttttaaaggcactcttttacttagtgaaaacatcctagttatttatttatttatttatttatttatttatttatttatgagacggagtcttgttctgtcacccaggctggagcgcagtggcacaatcatggctcactgcaacctctgcctcccaggctcaagtgattctcctgcctcagcctcccgagtagctggaactataggtgggtgccaccacgcccggctaattttttgtatttttggtagagacagagttttgtcattttggccacgctggtcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacttattttctgggtgtgctgttcttgttctaggagtcacatgatgcattattggaatttgggaataataacctacaaatattggttcatgttaccaaggaaggggtgtggaaaaacccagttcttcttaaaattctgtctcaacagccagtagaaacggaggaaggtaagtcttaagactatattggytgaggatttagttctgagaamgttggaattgattatgggttaaaattttgggaatttaacttgtgtatatatctagtctttctgtttttactttgagtagtaaaaattaactattagcatttaatgttttgcttaagtaaggattcttgcactgttagttttaagtccctttacactcatttttaaattttgcattgagtagcaatgttcatacaaagttcctgagacagaaatgaataatctgctgtaatctttggtgtgtggtagagctttgcttatacttttcttttcttttttttttttcccgagacgttgtctcgctctgtcacccaggctggagtgcagtggcaggatctcggctcactgcaacctctgcctccagtgttgaagcgattctgcctcagcctcctgaatagctgggattacaggcgcgcgccaccacgcctggctaagttttgtattttttagtagagacgaggcgttaccatgttggtcaggttggtttcggactcctgacattgtgatccacctgccttggcctcctaaagtgctgggattataggcaagagccactgcgcccggtctgcttataccttttttattggctgcaacaactgagggccatgaaaamagttttttttattttatatatatgaaataattggaattcattgttttatagagagatgcaaagaatgaagtttttgttgtttttgttttgttttgttttaatttgagacaaggttttactctgctacccaggctggagtggcacaattatggctcactgcagcctctacctttcaggctcaagtgatctgcctgcctctgcctcacaagtaactgggactacaggcatgcgccactgtgtacagttaatttttctattttttgtagatatgggggtctcactatgttgcctaggctggtcttgaactcctagactcaagagatcctcctgccttagcctcccaaagtgctgggattacaggcatgaaccaccatatctggccagaatgaaatatcttatttgcaaaattgtcagtcgaagaccagaaaaattatgtatttgaattgacatttgcattttagatcacaaaagtatcttctttgatagagccaacaactgtaacttcatttacgtcaagttagtggaaagttcaaaggattacactctgttaagtacattttttgctataaaaacagactttagaacaattattacacattttgagatatctttaggtcttagaactagccatttgattgtcgatcctttaaaatatcccagttagtttatccattcaccaagcttaagcacctaccatatacatggtgtttggacctctctgtatagtgagaagatgggcataaaggcacttagattttctcttgatccgtttcctctgatcattctagtgcttaccagttgcactgacaagaaaaaaaaagaataaggaaaagtgctgttaaatagaaaaagcattggtgtttatagttttccattgaggtcctcaataaacggcatccccttgtaaatgtaggtagatggaggctaaagtatcacctttgttattgacaaaagctgttagaaccaggtaatttcagaaacatcccagaattgggcagatcctatccagataagtcttgactggggcagaggagattgcatgttttgtgcaggcaggcccaagcccaagaggaaaaaagggtggggttgagttaaacatccttagtgtattttcccctgatatactaatcaactatgtcaccccacctctggagttaacagtaattaatcatttttaacatagaaaaacatcaagaaatggggagaagcattgcttacctaacattcttggtatcctgtttattcagtaaatattaattaagcactcactatctttaagactctgaataggtacatgatacctacatatccaaggaattatgttgaggaccacagtataagtggtgggtaacatgtagcctgcctcctttcacagttggcccttaatctaatttcaggtcaaaagattaaaaagctttctttatatctctgctgcccctgcaggccagatatttaacatatttgataccaaaaagcagtgatgttcatctcactgattgtcttctgtaataagtgccaattgttgataattttacctgatattcacctgacatgatcagtaaagatgccatggaagagctgtttttcttttctgtttttttttgaaatggagtttcgctcttattactcaggctggagtgcaatggtgtgatctcagctcactgcaacctctgcctccggggtttaagcgattctcctgccttagcctctcgaatagctgggattacaggcatgcgccaccatgcccggctaattttgtatttttagtagagatggggtttctccatgttggtcaggctggtctcgaactcctgacctcaggtgatctgccctcagcttcccaaagtgctggaattgcaggtgtgagccaccgcgcccggcctctttttttttttttttttttaaagacagcgtttcactcttgttgcccaggctggagtgcaatggcgtgatctcggctcactgcaacctccgcctcctgggttcaagtcattctcctgcctcagcctcccaagtagctgggattacaggcatgtgccaccacacccggctaattttttatatttagaaatgagttttcactatattggtcaggctggtctcgaactcctgaccgcagatgatccacctgcctcagcctcccgaagtgctgggattacaggcgtgcaccactgtgcccggcagagctgtttttcaactggatcttaagtgttactgtttttacataatgaagtatatagtataagataaagtgtcatgatgtctgcacctttcttttaaatggttctgaaaaagagaaggcaaagaaatgcggcaaaccagttcaattgttaaatctagttggaaggaagggtataaaactaaaaaaaaattttgtattgaaatgtttgaagaaatgagatacagaaaggattgtgattgggagtgagacatattgttttaaatattgaagcatatggtagatttcctttcaataaagaaattcaaagattgatatcttcaaatgatttgtaaaatacaagattgagccatatgttaaaattgatttagcagcagtttaactgtagttataattattgaataaaatagcttaccgcatagaaataatagctatgatttttagagtgcctgctatgtgttgggcactgtatttgtgctttcatatctcatgtaatccatgaaacaggtgagagattacacatacccaagaccatgtagttacaattgtggaggcagaatttgagcccaggtgaggtgacgttaaaatgtttttgattggagagtgatgacccttcagttgctaagtgcatggtttaattaaacatccgtaatatacaagcccttgtgcttagtgctgtagggaatacaaaggctaacaagacatgatatttgttcacaaattgctgacagtgtaataaaggagatatcagagacaatagtaagtactattaaacatttactccgtgtttggccttgtggtgagtcttatctgcatttctagtatttctttaatttgttcatccatgtgagatgggtataacctttttacagatgaagaarcttgagtctcagagaggtcagttaatttgtccaagggtctcacagctgtgtgtcagaatcaggtttcaacatcagatcagtgattctaaaacctgaaatgttaacgtttgtacactataatcccttatcactgttcttcgagaaaactaaatgtggggaaagaagtaaaatgctgtgggaatttgcaaggcgataggttgtgtaggtaatatgcctgttatcaggtatgttgcttcctgttggatttgcagaattgcttacaacctcatatggcaggtaaatagagcagaatctgatgttaggcaggcagaataggatataggggagacgtgacaggaaataataggcatgatttagattggagataattagaaaagaattactaggacataataactaagttgatttccttgaggaaaggaagtatcaaggaaagataattccaaaattttattgttgtataattgagagaatatcattgctgaaaatagaagtagggaataaggagctatgtgagtgaagggtatgaccgtgagttcatcttgtggaatttagtaactgtgggactaaaatggaaaagtccaagtgattgtgacctgttttccctccatgctttttgaccttgactacatattagagtatctatggaatttaaaaccaaaaaacatacatcccaaggtccagactccacttgctaaatcataatctccagagttggagctctggaatccagaactttttgaagtgccttaggaaatgggcacttacatattgctgatgggaatataaattggtacaatttttggagagcagtttggcagtatgagtcagtattacaaatgaacagagcctttaatttagcaattccgcatctaggaatttgttgtgtagatttattcacatgtttcagattacctgtatatagggttgtaagttgcagcattattgatgattgacagagattggaaacagcctgcaagtgtatcagtaggggattggttaaataaattatagcacatccataccacataatgctattcagttgttaaaaataagaagatagctctaactgcacagatgatagaataacctgtatcatatattaagtggcaaaagaaaatgtcttccatactcatagaatatttctggaaggataaacaagaaattggaaacttgttgtttctcagggtgggaaaccagagcactggggtcagggtaggagggagaaaaactttaactgtatagctttttctgtccttttgaaatctgtgattatatatatatatatgtttttctttatattattttaaaggataatgttacgattgattctcatatgtagttaaaattgggccagtggtttatccttagtataaaccattgctactctacacacacacacacacacacacacacacacacacacacacacacacacacacacacacacacacacacacactggtttatccttagtataaaccattgctactctacacacacacaccccagtggtttatccttagtataaaccattgctactctacacacacaaacacacacaccccccccacacctcacacacacacacacccccccccccccccccgcaacctgggagcttgtgagaaaagcaaaatttcaggtcccagacctaataaatcagaatctgcattttaataagctccctaggtgatctaggcactttcaagtctgagagatactgttttagattaaccacctaaagcagtttgtttactcaccacttggcttgacatgcaatattctcacctctattctttaagtaatactatgtagtgatgtcacatacttgttggatatttactattcaaaaattgagggctcggccgggtgcggtggctcatgcctgtaatcccagcactttgggaggccaaggcgggtggatcatgaggtcaggagatcgagaccatcctggctaacaacggtgaaaccccgtctctactaaaaatacaataaattagccgggcatggtggcgggcacctgtagtcccagctactcgggaggctgaggcaggagaatggcgtgaacccgggaggcggagcttgcagtgagccaagatcgcgccacggcactccagcctgggtgacagagcaagacttcatctcaaaaaaaaaaaaaaaaaaaaaatttgagggctcatccagagcactgtacagtcaatgccaagtgcctaatattcagtacagctcagaagtactgagcttcagtacttctgaagctttcagagtagcattttccaaagtgtgtactgaaccaggaacacatgttttacaggttactaatatgtataaaagggttctctggtcaaatcagtttaggaaacattgggtttttaaataaaagtgaacagttttctttattgcaggactgttcagagatttgaccaaggaatcctttttttttctaggactatctctcaggtcttttggtcggtggaacacactttgagaaatgcctggtttagaggaaagagcaccactggctttggaatccttggcaagttacctaacttctgtgaatattaattttcctaaccttagactggggataataatacttgccttggtggtggtgtgaagaataaatgagaggtatataaaaatatgcagcttaaaacttgatgtctcgtaagcattcagttgatagttgttaatattacataggttacttgcttcatttcttgcatttatgcttatagttcatttcactatttcttaattttcctctcatctctattagatgaatattgagaccagagtaaacttctcatttatataaactaaatttttattaactaaaaatcaaataaaaagatctcaaactttcatcttagcaagtctgacatgttatgtggtatgttgtcaaactgttttatttttcattttttctagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggaggtgagtaaataattgttgtcattcaaacttggtattaatttaatagatttatatatatattgcatggtttattttttccctttagaatgaaaaccaagattcatttttttcaggctaccaaaatgtatgattttaattgtatatttaactgctcgacagatwgaatgtaatattttagagtgaatttgaaaagtagataactaaagaatatacagaggcatgtttacttatttgggtgatgatttgctgtgaaatctttaaatgtgaaagttgttttttctttttaaagtaatgacgtctccatgtttggggaatgcagaagttgttaatcatggcatcaagggataaactaaagaaaatggcacttaattttagcttaagttactttatatatttaattttgtaagcagaaaagtataggactctagattccatgactayatcctgaacaattaagtggccaaactggatatcatggaaaataarggttgagtctttttttttttttttttttttttgagacaaggtcttgctctgtcacccaggcaggagtgcagtggtgcaatttcggctcactgcagcctctgcctcccgggttcaagtgattcttgtgcctcagcctcccaagtagctgggactaaaggcatgcgccaccatgcctggctactttttgtactttttagtagagacggggtttcaccatgttggccaagctggtcttgaactcctgacttcaactgatccacctgcttcagcttgtactactaaaagtacaaacattagccaggcatggtggtgggcgcctgtaatcccaggtactcaggaggctgaggcaggaaaatcgcttgaacccgggaggtggaggttgcagtgcatcgagatcgtgccactgcactccagcctgggtgacaagagtgagactccatctcaaaaaaacaacaactattttatgtatcagattgcatcctttaaaaaaaaaaaacctcaattattatgtttcttaaatttggagttagacttctctaatggtttttgacattatacagaaaaaaactagagattcttaagctttatttcatcatctacctttaatcctcttatctgccattcaattctgacatatggattcttactctgaactgaaattttttattagatgtagtagtcccaaggatctggttttatgctgtagtaattctgaaacttttacttgtaatatcttactctccaaatacaattgtctatctttctaccttactccctttaatatacagtctccaccaggatcaatcaagatctattgatcttgtcaccttttcattttcccttatcccccttatgtattcacttccctatttaactctgctttgtcattgtcagatcatcattatcactctcaaagagcgagaggtcctctctcttttttttttttttttttgacagagtctcgctctgttgcccaggctagagtgtagtggcgcgatctttgctcctgggttcaagcaattctcctgcctcagcctcccgagtagctgggattacagtcgcccaccaccacgcctggctaatttttttgtatttttgtagagatggggtttcaccatcttggccaggctggtcttgaactcctgacctcatgatccacacgcctcggcctcccaaagtgctgggattacaggcgtgagccactgctcccggccactggtctctctcttaattgtacttgtttgactaccagtatcctgattatccctaaatcttcacctactctatgtgtttacctgcactcatggggccaaatttacatggagaaaaatctgccagctaattttactccaggctagagtgtggtggcgcacactgctcactgcagcctcaaaatcctgggctcaggtgatcttcccacctcagcccctggagtagctaggaccacagaaacatrccaccattcccgattaatttattttttatttattttttatttttttggagagacagggtcttgccatgttgcccaggctggtctcgaactcccagggtcaaatgatccgtccacctcagcctcccaaagtgctgggattacaggtgtgagccactcactgcacccagcctatatttctttagcccattcattctcccactcttagatagttgcatagttttttcttattcttcaaaactatactgtaatactttctgccctgtttcactctctgttgctgaacttaactccctatttctctgaaaaaaattgaagcgctgagaagataaataagagaattttcataagctctgtctctgaaacatctattcatctaccagcatctatgaatgtacatcttctcttctgttactagagataaattatatctgttctcctagctaaggccagcctccctcacttctgtatttcaattgatgttgtctcccttaaggataatgctacagcagttctccttttctctattacatcatcgatttccctgtctctgttataaccaccccattggcatttatgctattatttattctgtccttaaaaaagagctcttcttaggtccagaggtggtggctcatgcctgtaatcccagcacttagggaggccgaggcacaagaattgcttgagcccgggaattgcttgagcccaggaggcagaggctgcagtaagctgagatcacgccactgcactccagcctgggcaacagaacaacagaacgagactctgtcttcaaaaaaataaaataaaataaaaataacgctgctttagatcctgtttctacttttagctactgccccatttccttctggctttttaagcataatttctttaacaaattgtcttaatttactatcgaacattttccttccttcttttttttttttttttttttttgggacagagtctcgcactgtcacccaggctggagtgcagtggcacgatcttggctcgctgcaagctccgcctcccaggttcacgccattctcctgcctcagcctcccgagtagctgggactacaggcgcccgccaccatgcccggctaattttttttgtatttttagtagagacggggtttcaccgtgtcagccaagatggtctccatctcctgacctcgtgatccgctcgcctctgtttcccaaagtgctgggattacaggcgtgagccacggtgcctggcccatttttcttctttcaagacattctaatatgacctttgcccctggcastataccatatcactaaatctaatgatgactttcagttttctgtctacctcattgattactcctttctcagttctactttgctgtctratgagtacatgttgcagtacccaatgactctgtcattgggtcttctctttttacacttaactaggcttatttccttcatctttggctttaaataccaactatggtctgactcccaaaagttttctctccagccctgttccctcctccaaactccagacccatatccaattgcctaattaccatctctacttacagatttaacatgtccgtaactaagctcttgatattcctgatatttggactttgcttttatgagggttttttttagtcctcactatgtgtttggcaccatgctaaatgctttatatactttgctacatttaatcagcacaatagctctgaggtagctccattttattgatgaggaaagtcaggctcagattaggttgtgtgcttcaaggttacaaagctaaagtggttaagctgggattcaaacctgagtttggtgtactaccagtaatattatattaaagacataggataaggaatattatccttgttggtatttaccttagagtttatatgccaaatgctgtgttaggcattggggttcaaagatgaatgcagaagtctctggactggcatacttggttttactgttggcctctacattttatcttgaaaatagccagaataatctctctaaaacttgtcgtgccatgccacttctctgcacacaattatctaatagctttccatcttactcagaatacattcagaattctttattctatgtgccatgggccctggctacttttctaacgttctctcaccttatcttgtaatcttagtgcccactactctccagccrccttgtctttgctgttctttgaacaagccaaggatgttcctgtcttagagctttgtgcttgctattccctctgacgagaattgccttccacaagataatttgaatggcttactcccttacctcatgtctgctctaaatgttctcatgtctgttcaatattaccatatcagagaggccttcctcgctgtctcatctaaaatattaccctagccccctactctgccctaaatatctgctgtcattattataaatatatactaacccatttaaaatgacccctatcactttgtctttctgcctatttgtattttcttcatagtacacattactgcttctactaggcatcatatttgattattcggtatttcctcccactagattgtaaactccggaaggacaggaacataggttgtttactggtatatccctgtattctagaagaatgcttagccatgtaggcactcaatacttattgaatgaattaatgaaaggtatagcctcatcccttgatcttttgttactaggatttctagctttattacctgagttatgaccagaatgtcaaagctggaacattccactcatgctttctaagtttttaaactttgcttggaggtctttttgaattttaaaattgtgattttatatttctctctctcagctttattttattttgaaatatagttatgctatctgtatatttataaaaataagaaccaagatgaaaccaagtacagtgttgtgattcagatttctgtataggttgattgcatcctggatcagtgcttgggtcaatagttatttcaaayggctaagaccccctgctatggcccagatcatatctcccactgtgagaatcttttatcagatttttttgttgaaaattgttttttttggagacagagtctctgtcgcccagcctggagtgcagtggcgtgatctcggctcactgcagcctccacctcctgagttcaagcagttttcctgcctcaaccacctgagtagctgggattgcagacgtgcgccactacacctagctcatttttgtatttttagtagagacagggttttgccacgttgcccaggctggtctccaactcctgacctcaagcaatctgcctgactcagcctcccaaagtgctgggattataggcgtaagccaccacgcctggccccttgttgaaatttaagatgtacttatatctaagatacttcccagtggccaaaatactgactccaggaatttgtgattctgtcctggctcctagtagtctttgcatttctatcaactaacgtattttttcaagtgctcacagactttattctgggatggatattgggttagcaacattccacttggaagcactgtggcctggtctttgagatttagtagtaacttgaatctgagaggattgtctaggcagggaaagtatagatagagacagaatgctagtcatctttgttttggggaatgaccttacacaggagcacagatacgggatgcagagatgaaacagccagttggtggctatgaagtggacaacatgtagtttcctcaaatggggattgaagctatgacctagggcctcattaataaatgttcttatttgttagactttctggtgataaagaaatcaaaggataaaatgctttgcactgcctgtcttttcagactttctacttgaatcttaaatataactgcagaaaacatttattgctcacttgtctattccaagcactgtgctgtgtgctttaaatgtgtcggtatctaatccttataaaaatctattaatttaggccaggtgtggtggctcatgactgtaatcccagcactttgggatgctgaggagggaagattgcttgaggccaagagttcaagaccagcctgggcaacatggtgaaaccccatctctacaaaaaaaaatgcagaacttagctgggcgtggtggcatgtgccgtagtcccagctactcgggaggctgaggtgggaggattgcttgagctctggaggtgcaggttgcagtgagctgagatcacaccactgcactgcagcctagatgacagagtaagaccctgtctcaaaaacaaaaaaactttgaattttatagaaattaactgaggctctgagagatgatattactggcgcatagtagtaagatgtccagtaagtggtgtgcccagggtttaaatccaaggtgatctgcctctgctttgcttttatacatattaatctgacactcacacatctcatgtacatgatccaactcactgtcactgccaaccttctggttctttctggattctggttcttaaagtagacttgttgtgcaggcaagtttttatttcttttgtttacccagaggggaaacttcagaaaagatgggaggggactttgaagttctgaggcttgtgggtggctcattactggactggatttactgaggagcttaggtagagtatgtttttcacaagacatctagagaagtgaaagcaacaatcaaaatatgtaggcttgaatcttgacattgtcatttactagccatacagccttggccaggtagctttattttccttatctataaagtaggcacaacagtagtagccgtctcacaaaatggctggatagtttaaatgtgataatatctaaagcacttaacacagttcttggcatattttagacaccttacaaacatagaccctagtataagaattctttaagcctggggtgcagaactagggaggatccgtcgaagtcaagattgatcagaggtgaaacctgaatttgcacagagaaacaatgtggtatacacagagatagcctcctatgacttcatctacatttttaaaagcagtcatatgggctggacagagtggctcatgcctgtaatcccaacactttgggaggccgaggcgggcagatcatgagatcaggagttcaagaccagcctggctaacatggtgaaaccttgtctctactaaagatacaaaaaattagtcaggtgtggtggtgtgcgcctgtaatcccatctactcaggaggctgaggcaagagaatcacttgaacccaggaggcagaggttgcagtaagccaggatcgtgccatttgcactcgagctggggcgacagggcgagactccgtcttaaaaaaaaaaaaaaaaggcgatcataagagaccaactataaacctgtatgctaatttatttatttgcagtatcaggtagtgtaaggagatagattgcttacctctaatagcagctgcagtattttatgtttgggaaagttaatcagactgagatgtagtaatggttattctcagcacctgacacatgccaaaacaattcaaaagcagcagcaaaacactacattttgggtttgattcctcatcctgtaataataacaactttactctctcagcctttgcttaattaaaacccgttttgtttctaatgttgtattaggcattgrcaaatacagcaaactgtatggcccagtttgtttgccaaaaatagttacagaaagagaagtactaagctcaatgattactgccctaaattcagtagaagtgtaaagatagagaattctgtgtttatagaaaaattgatccttgaattggagctttaagtaatggtggggtttggatgggtggaaagaatggtttggagatgactgaatggtagtaaagcacaggtactaatgagtactttgcagggatccactggagaataaataccctgcttagggcagagtggttattgaagtcttgtgagaaataagacctgttggggttggaaaagaagggcttggaaactccattgcattaatggttagatttgatgcagtagaaattaagaaggctttgcagttaggaagtgacatgtctgaagtggtgttttaggaagactagacagaaagaatatgtattatgtttaggacaagagattgtagccagcaagaggacaaaggacaggacttgctgaccgggcaaaaacagaggaggatgtacagagataccttcaagaggctcataaggcttctagcttgggagactggaagaatagtggtgctctgctgctaattagaagaaagaatgggtggagggacaagggagagtctgggaagatgataagctttgttttatacatgatctttcctggtttattaataacaatgtttggaaacaggatttttcctgattgtgttgagtttgcagggaactgtgttataggaaatacgatttgatactattcacaacagggggttggcacccacccagctacctgtttttataaataaagctttactggcacaaagtcttacattcatttcttgtctgtggctgcttttgtgctacagtggcagaggtgagtagttgtaacagaaactctctggccagaaaagctaaaaatattttctgtctgtccttgtacgaaaaatatttgctaacctctgctctacaagaattaaattttccagtctatttcagtggtttaatatcggttggtctaaccctccgtgttctacacgtgatgaaactgaagccaagctgataatgtttccaaggcccttcctgcattaagctaattagaaaggccaagcccagctggaatgcaggtcacctggctccttggtcagccttctttccrctctaccacctatttccatgtgttagacattgataagccatggtctgattgggaacatcttggtgatatatcattctgttcatatttatacatataggtgtgatttaaaacatttttatcatgatgtggattaatttgttaaatataccaatgcaaaacatttagtacacataaagttatcttaaaattattttaaaggaaccctagtatcatcgtatcatcataactagtcagtctttttttttcctttctttttctttgagatggtgtttcactcttgttgcccaagctggagtgcaatggcgtgatatcggctcactgcaacctctgcctctcgggttcaagtgattctcctgcttcagcctcccgagtagctgggattacgggcacgtgccaccacgcctggctaatttttgtatttttagtagaaacggggtttcaccgtttctactggtgaccagctggtctcaaactcctgacctcctgttatccgcccgcctcggcctcccaaagtgctgggattacaaggcatgagccatcacgcccagccactagtcagtctcttatcctagtgatacttttcttttgcaagtgtcaacagaattaaaaataatctgtagtttgctttggaaaattactagtgagtcaccagatgttgattaattagagtttaaattcagcatacgttctaaagtagcagagttacacacatatttgccatctacttcacctgagttcaggagaagagttaacttgagcaacagctgggaataaaagtacattgtatgttggtacctgggggtatcccaataataggcatatgtaatgggaaaccgctgctggggaagatttagccagacacatacaattaagattaattgactgggtcatctgaaagtcaaaattcagaacctagtgggtaaagagtgagtcctttcagatatctggtaggtctggaaggcagaagaatttcatggaatcctggagttttaggttgtgatactttatttatgtagaattgaatgagatgacattgctattaactttacatattaaaggattttaataaaagttatagacttggcagtggctcagtgtcccaagtggatgtttcctatattttttcattactgaaaggggaagtctttgcaaagatcaggttttcaacatagaaaagataacattttaaacatcaagcacttctattttaaagagctcaagaaatctgtcagcagagttcttggcgcagttaaggcaggggtccgtttcattcttaatccctgaatgaactacatcttcggtatctgacgtggttgatagacacaatagcagatggttgtttcttttcctgatggggaaaggaaaggacaaacaggatccaatttacttaccagcctaacactgttgggaattgacacagtcactaggtataaatgatagagcagatacctttaaacaggacccagtgggaattcagtttgggagtagaagaaaaagtaaacaggagtatagaaattccagatgtagtttaagtaagaatcaagattaagatgaactctgaacaaggaataattacaaaaggtttaattaagtttaaaatatgccacctccaccaccttcttttatgctaattggctgcctgttagaccattggtgtttaattgcctgattattttgaaagtcttaatacttctactttatccttgtgatcatacaaggaatgagataatacactcagaatacactaatgacagaaagtctgtgtaaagaaattgaggatttgcttgtttaggtattttatctcytaaagcacagttctttcaaatagctttgaagagacgtcttcccagaactttgtatgcatctggatctcacttctgatcttactttcatgggttatgtgtgggtattttggttggtgtatgattgcactggagggggtcattatgaagagtcgatcagacatattgtcaagaattcagcaggacgtttcagccttctttcagatacacactgtgatagggtttaaatggaagcattggtgaccatttatttctttaagaaatatacaaggtccgtgcagcatcatagtactggtctgtagcattactgcagtttaaaaggagtctcatgtttttaaaactggtcagtattcttttttcccaggtaatgtctttgaagctaacagatgattttcccaaagatatctagggttacttgaaatgtaagtttgctaactgtaactcccacctttcttctactcaaggatgcaagtgaatgaagtattattatatgaataagcttaaatctactttgattcctttttgaaaaaataaaacatttatcaactttgatttttaaaatctattactaggaacaaattgttttcagtatacctcagaactaatcagggaaatactgcattgaaaaccactattctagagaaaggtaatgataaaatattaatggcactggccggaatactagtttacattgatagcctaagcaggaaaataacttaggaacgtaagtatgctgcctgtacccaccttctgttatgccagttggctgcctcttatgcctgttattactgttgtttaattgcctgattattttgaaacctttctaactgtatctaatcttgccttttcctaatttrttttctgcagtggccaaggtgatcctttttcttttttaagtaaaattagatattttattttgaggtaattttagattcacatgtaattacaagaaataatgcagaaatgccttccatttattcagtatacattcattggaggtgtctgctgggcaatggggttacaagaatgaacaagacaaaagggagagaaacaacagacagtgttcatacaatgtgagatttagaggtctgagctggaaattaagagttctaatcaccatttgaaaccagagagtgaataagattaacttttttagaactctgaaaaataaaggctttacagcaatctgaggaggttttactcaagaaaaagaaataaatctcataagaatatcacctttgacctcagctggtaatatgcctgtcaggtggctcaaatttttttgtcacactgcgcatgtttgtgaagtgatcacagaagtgctctgattattgatttgggggttttacaaataaattttagcaagtaggctaatacacaaatacagaatctgcaaatagtgaggcccaactatatattcagagaactaaaggaaacatgcttaaagaattaaaggaggccaggtgaggtgcctcacacctgtaatcccagcactttgggaggccgaggtgggaggagctcttgagaccagcctgagcaacatctacatgtgcaacatgtagagaccctgtgtctacaaaaaaatttttcaaattagctgggtgtggtagtgtgcacctgtagtcccagctattcatgagactgaggtgggaggatcacttgagcctgggaggtcaaggctgcagtgaactatgatcatgccactgcactcccacctggacaagagtgagcctgtctcaaaaaaaaaaaaaaaaaaaaaaaaaaactaaagtatgagaacaatgtctcagtaaatagagaatatcagtaaaaagacaaattataaaaaaccaaaatgaaattctgaagtcaaaaagtgcagcaactcaagttaattcactagagaaggtcagcatcaaatttgaattaccagaagaaagaatcagcaaacttgtccagtctgagaaatgatagagcccaaaatgcatgaaatagcagaatcaaagaggcaaatggacaattcaaacatgagagttggagactttaacacccactctgamtaatgggtagaacaactaggcaacaaagaaatggaagacttaaacaatactgtaaaccaactggactgagcagacatctatagactactccacccaacagcagctaaatatacattcttctcaaatgcacatggtctattctccaggatagaccatgtgttagcaagtaaaacaaacctaaataaattttaaaggattgaaatacataaagtatgttctctaactacagtaaaataaaattagaaaccaatagcagaaggaaatttgggaaattcacaaataagtgaaatttaacctaccttcccaaataaccaatggattaaagaaaaaaaaagaaattagagagtaagtttttgttgtattttgttttgttgtttttgagacagggtctcactctgtccctcagactggagtgcagtggcagaatcatagttcactgcagccttgaacctcctgggctcacgtggtcctcccacttcagcctcccaaagtgttgagactacaggcatgagccaccatgcccagcccagaaaatactttgagatgaatgatgaaacacaacataccaatatttatggagggaaatttctatttgtaaaatgttgattttaaaaaagaaatatcttaagccaataacctaacgattcaccttaagaaactagaaaaagaagagcaaattaaactgaaagcaagcagaaggaaggaaataataaagattagagtataaataaatgaaatagagaatagaaaatcaataaagaaaagtaataaagttctttgaaaagattgacaaaattgatatactttcagttagactgaacaagaacaaagagaatactcaaatcaggaataaaaaaggagataccatcaaccttacagaaataaaaaggattataaaggaatactctgaacaactgtttgccaacaaattacattactggatgaaatgaacaaatttctagaaagataaaacccactgaggccaggtgcggaggctcaacgcctgtaatcctagcgctttgggaggccaaggcggatagatcacatgaggccagaagtttgagaccagcctagctaacatggtaaaaccccgtctctactaaaaatacaaaaaacaaatcagctgggcgtggtggcacacacctgtagtcccagctactcaggaggctgaggcaggagaatcgcttgaacccgggaggcagaggttgcagtgagctgagattgtgccattgcactccagcttgggcaacaagagcgaaactctgtctaaaaaaaaaaaaaagagagagagaaagaaacccacagaaactgactcacagataaatagaaaacctgaatatacctatgactagtaaagagggtaatttaaaaatttcccacatccacagggcctcactgtacaaaacatttacggaagaattaataccagtccttcacaaagtattccaaaaaatagaaaaagagggaacacttcccaacttatgctatgaagccagtattactttgatactaaaaccaaacaaaggcatcctaagaaagaaaaccacagaccaggccaggtacggtgtctcacgcctgtaccagcactttgggaggcagaggcgggcagatcacttgaggtcaggagttcgagtccagcctggacaacatggtgaaaccccgtctctactaaaaatacaaaaattagcgaggtgtggtgacacgcacctgtaatcccagctactcaggaggctgaggcagaattggatgaacccaggaggcggaggttgcaatgagctgagatcgtgccactgcactccaacctgggtgagagagtgagactctgtctccaaaaaaagagacaagaattccagaatgtccactcatgcaacttctgttcttattgatctctttgcctctatattctcctcaccttctcctttttttctgggctgttgaatacatctgtaaaaactcttacttaaggctgggtatggtgactcatgcctataatcctagctctttgggaggcttaggttgggggaacatttgaggccaggagttcaagaccaacctcggcaacaatatgaaactccatctctacaaaaaaataataaaataaactgggcatgatggtgggtgactgtagtcccagctaccttggaggctgaggcaggagagaggatcactggtacctaggagttcgaggctgcagtgagctgccatcgtaccactacactctagcctgggccacggagcaagaccctgtctcttatagtaaaaaacaaatgggccgggtgcagtggctcactccagtaatcctagcactttgggaagccgaggcgagcagattgcctgaggtcaggagttcgagaccagcctgggcaacacggtgaaaccccatctctactaaaatacaaaaaattagctgggcgcgggagcgtacgcctgtagtctcagctactcggaaggctgaggcaggagaattgcatgaacccgggaggcggaggttgcagtgacccgagattgcgccactgcactccagcctgggcaacagagcaatccgtctcaaaaaaagaaagaaagaaagaaagaaaaacccaactcctacttaagtcacaacatagcataaggtaaaagaagtaacatataaccagcatagtatcacctttctttaaaatatgtatatatttgcagtagtcacatattaaacccatgctgtgtaacgtgtatgtagacataatactggaaaaaaattcacattgttaatactggttatcattgagttgtaagatttaaggatagtttttattctgttttctaggttttctatcgtaaatatttttgtaatgagcagaaatctagtaaatagtaattaaactacaggtttcaagtgatttcttttggatgtatatccaagtgaaaacaacaaaattatctgttttccccataaaaccccatgagtaagtttcagatcctttagtcttctgttatcattggcctgtatgataactttgtggaaatcagcaaaaagtaccatcaccctctaactccaccttcatatggttgcctttcaaaggtcttccgtcttctgagggcaaaagcctcattggggcttgacaagtggactgaatttcagcccccactaactcccttggctggttacttttgtgccatgcaaaactgcacaactctgtgacatggccttattcagtctgtctttcccccagtgtatgatttagctctatcctaagtctctaaacttgtttaatttaacctttcattcactgagtgtcagctacgtgacatcacgcattgccgttacatcagataaccttttccctcctcacatgccacaattactctcacgttaattagtttgctcattccagctttgtattttttgggctacattctcccctatccatctagactgctatctccccgagaattcttttccttggaatctttgtggcttccttcagtcagtattattcttcctgtcttcagttttctgtcccatttattcttcatgttatttatcttatagttatttttcattctaacaaatagttattgatgttcattcatgggtctggcactgttgtaggcactgaagatacagtggtgaaagaaacagacttttgccctcagggaacttacattttagtggtaaaatagtaaacataattgattctttaaaacacgtgttcagtttgtcttaatagctatagaattgtaagccccaggactagaaattatatttaagaacaaaaaattgtttcagtatcttaagtataagatgtttcctagatactcattaaaactctcaaaagtttgttggtgaccttcattttaatttactttagctgagaagtattttgtggcatatatttgttttttagtgtggtcttaggtatttattgcaaaagattgaggacaagtagtataaccatattttattagtgaggtgttatctcattttaatttacatgaattttttaagttatttatttacttttatttctttatcatatcttttcctctatattcaagaaggtacaggtatttggggcataatactgagattctcttcaagtcaaaggatattaactgagtgcttgtcatgtgaagatcctaaaacaggtgctaagggggataaaagtataaaataagatctagtatctgttttcaagggatttagagtctataaggaagaacagataacagatatgaaaaaactctggcttcagtttttctcatttgtaaaaatgatcagatgtctcatttagttaaatgacagtggaaaataagtctagagtgatattcctgttattagctcagataagtgggtgcaaggcaaatgagctcttgaattggaagcttatacaaagcccacactataaactagttccgccttcacaatagaaaccttgatggaagtaaaacagtcaagttaataggtaatgaaaatgtgtgtgtgagataccatgcttaggagttatgaacctcttgatcagaaatttaattatcaggcatattcgtgtattttaaaatgccaggtaaacagcaatattaagagctaattaaaagaatgttagtatttgctgaaactgcataattggagaaagttaagtttaatttgagacattggtagagaaagttaaactttgcttgtttaggccagtgcaggagcatgtttaccaacaatccctgtggtaacttagaaggcatggagataatgataatagaaaaacagaagtactggccaggtgcggtggctcacgcctgtaatcccagcactttgggaggctgaggcaggcagatcatgaggtcaggagattgagaccatcctggctaacatggtgaaactaaaaatataaaaaaattagccgggcgtggtgtagtaatcccagctactcggggggctgagacaggagaatcacttgaacctgagaggcagaggttgcagtgagccaagatcacgccactgcagtccagcctgggcaacagagcgagactctgtctcaaaaaagaaaagaaaaacaaaagtgcttctactcctagcaactctcaagagttgatgctcccacagtattgctgggttacccacaactatactgaaatattttatttctatttctatgccatgctcactcttattaggccactgcatgtgtttttcttgtcctggagtatctttctcagttcactctctctttgccatggcttattcctactcattcattcctactcatcttaggtgccactttacccagaaagtcttttttggtccccaaatttgagttagattcttcctaccaaaggtatttttaaaaagtatactctctcattgtagctatttgattcttagtaactgcttccttactaacaaccctgactagactgtgatatccattagggcaaaaattagattggcttgcatctccagtacttagcacggtgcaggtatttagcaaatggcactgctttgctaggcacatacattttgatatggctatttttcttacaggattttgtttacagtggatttgggatattatttatagagctgtgctcttgtcctcaagtttatagtctagctggagagccatagtgaaagtgcataaaaaagttaaataatagggccagggcattggctcacaactataatcccaacactttgagaggctgagggaggagggatcactggaggccaggagtttgagaccagcctgggcagcatagtgagacctcatctctacaaaaattaaaaaaaaaaaaaaaaaaaggtgtggtggtacacacctgtggtcccagctccttgagaaactgaggcaggaggatcgcttgagcccagaagtatggaaacttcagtgagccgtgattaccctaactgcactgcagccttggcaacagagtaagacactgtcttaaaaaaactaaaaataataaaaggtaaaggccagtatgagtaggttaaatgttggcccaaggcagaataaatagcccaatttaaacatttttaatttaaaaatgaactttggactcattttttatttgtgaaatagaaataatattgcctgccttgccagtcttacagatttgtcatgttgagatatgaaaaaaaaaacaagataatacagtaaaacttatttgaaaaaataaaagttctagaaataagtgctacaaaggagaaatttgagagtgtttgacagcgaaccaaataacatgacctcagaagttaggaaaggattctgtaagaaaataacatttgagctgagctttaaaaaaagcctttctgcacctacctgaagatatgactaaaattagagccttagaaccacccccttgtaactgcgtagcgcactggaggagttgagctgtttacctcatttgctctgatgcaaaaaaaaaaaaggccgggcacggtggctcacgactgtaatcccagcactttgggaggccaaggcgggtgaatcacgaggtctggagattgagaccatcctggctaacacagtgaaaccccgtctctactaaaaatataaaaaattagctgggcacggtggtgggcgcctgtagtcccagctactctggaggctgaggcaggagaatggcktgaacccggaagtcggaggttgcagtgagctgagatcgcgccactgcactccggcctgggcgacacagcgagactccgtctcaaaaaaaaaaaaaaaaaaagagaaaggaaaggagccccagaaaaatttgattgatttgtccagaggatttttatttgttttttgtttgtttttttaagatttaagtcatataaatgaaaagatatatttctaaaaagggttttgatggtctgaaaaactcattaatacactagatattttccttctatgaaaaaatgatgttaatgtagcatttgtatttaaagcagttcctgaactggcctcctttagccccactgatattgaggataagccatatgttttactatctgtaaccagagtgacccagctgtggtcatagatactaggggaagacaggaacaggaaagaaaaaaaaacatagtaatacttcaggtaaaaataacctgagattattatatataatttgactcatctatatggtagcaatgttcgtaatttttttaaactgcaaaaatgtttttatctgtattgagactgtagtagaacttccttatagtgtctgttcccttctttaatattttcttatgtgaaatattcatgcaagaagactcattcattagyaggagaaaattatgtctctaatttttgcctcattaagaagtttcacmttatataacaaagtttactgaaaagtcaccattttctttttgacttagtcatctcatttttgatagattgcaaaggtcgactgcaaggaagtactagacatcatttgtaatctggaatctgaggggcaggataacacagcatttgttctttgtacgacttaccttacccagcagctccaaactgcaagtgtatattgttcttggtaagtatatttagttttacactctttatttgttagtacatagtatagcatttagggtttatgtaaaatgttaatttgtttctaatttaaaacctagcatgacctgtgaatagcttcttgcttccacacacaatcatttaattaaaaatatcattggtttaatctagtcaagaaaaggtaaaatgttcctcttgatcatcccataatgggttgtctgttaactccaatatatgtcttctaccttgaagataaaattttgtcaatatgaaacaaacctgtgttagttagattgtttttcttttcatttttttagtatcttctgggtagtcactccccattcttatttgggaacccacaaatgaaaaggatcaaattatctaggtttctaggtcaaactagcactaaaaaaggaaattcacttgaatagtaatctcttttgcaactttggaactatatagttgaattgcattattttggttttaattcaatttatatcttgtttgcctacagaatacttagttgctaaaaaggaaacagtaagtgtatccgtggttctttcattctaactgtattgaatctatttaggccaaagggacaaacctgatacacaggaaacctctaaaatgtaagactctctgtcagtaagtatcagattagtggtatggataatgctataggagatcagagagaggtgctcactgtataccagagtattaaaggtgtcagggaggaagtaatatttgagatttaattctaagaatgggttggatttgcattatcttgattagaggagctctgagtatttcagaacctaaggatggcttaaaattggaaatgagcattttgtttataggaaaacctagtaaagccttttgtgtacttcagccctcattgatctccctctggatcgtctgtctatttttatagttttatggttaataccattgtatgttactatatttctttttgtttattattttatgtagaaattttgtgtactgtaatctcacccagtcctcataataatcattgcacaggtgaggcagtgggaggatcatagggaccagagaaaacttgtaattgtccatggtctcaaggctaaagtggtagagctgagattcaagcccaggttttagacttctaatccagtgcttttcttctgtatacttgttttcttggcataggccaaaattcaaattgtagttttttaccaccaaatccactatgccagagttatacctcctgtgagaaaggagatagtgggatagcgacttaaatataatttctttataatgaaaaaatatccaccattatagctaggttttcagtacgaataataaattaaatcatatatagaatgtgttatagattgtgtttaaaatttttctccccttcttcagtcagccaccattcactcttccagagctgttagtggctctaggattaatgctgttcttctgtagcaggaagagatgaatggagatttccctttgtggcctcctcaggagctataatgagtaaaggaaagaaaatcttagtcatttcacactttgttaaaaggagcttctttcaagcaattcaaggagcaattgcatcttttttttttttttttttttgagacgaagtcttgctctgtcacccaggttagagtgcagtggtgtgatcttggctcactgcaacctccgcctcccgagtagctgggattacaggtgcacactgccacgcccgactaatttttgtatttttggtagagactgggtttcaccatgttggtcaggctggtctcaaactcctgaccttgtgatccactgcctcagcctcccaaagtgctagggttacagacgtgagccactgcgcctggccacatcttttttttttttttttttttttccccttccattgtttttgaaagctttttttttttttttttttttttttttttttggtagtgggatgctggagttagaatattagaataacataaaacattgaattttggccaggcatggctcatgcctgtaatctcagcactttgggaggccaaggtgggtgggtcagctaaggtcaggagttcaagaccagcctgaccaacatggtgaaaccccgtctctactaaaaatacaaaaattagccgggcattttggcagacacctgtaatcccagctactcgggagcctgaggtaccagaatcacttgaacctgggaggcggaggttgcagtgagccgaggtcatgccagcccaggagacaagagtgactccgtctcaaaaacaaaaaacaaaaaacattgaattttactaaggaaaattaatcacaggaattctgttcatatgagatagatcttttgttatgcttgaggtagtgggacataaggagtatttgtttagaaaaaaattttaaattaagtggtattttggataagagagatatcagtattttttaaatgtgacaataaagttaaaatacaataataaaagtagtcatgcttatttttaaacacatacgctagaatttatgtcttgggagtatcattcttgagtgtagttaccatgaagataatatttgaaatgtaaactatgtagctattggccaggcgcagtagctcacgcctgtaatcccagcaatttgggagactgaggcgggtggatcatttgaggtcaggagttcgagactagcctggccaacatggtgaaaacccatctctacttaaaatacaaaaattagccgggcgtggtggcgtgtgcctgtaatcccagctaccctggaggctgaggcaggagaattgctagacccctggaggcagaggttgcagcgagctgagatcgtgccactgcactgcagcctgggtgacagagcaagactctgtctcaaaaaaaaaaaaaaaaagccgggcgcggtggctcatgcctgtaatcccagcactttgggaggccgagacgggcagatcacaaggtcaggagatcaagaccatcctggctaacacagtgaaaccctgtctctactaaaaatacggaaaattagccgacctggtggcgggcgtgcctgtagtcccagctactcgtaaggctgaggcaggagaatagtgtgaacctgggaggcagagcttgcagtgagccgagatcgggcgccattgcactccagcctgggtgacagagcgagactccgtcgcaaaaaaaaaaaaaaaaaaaaaaaaaagccggatggtagtggtacgcacctataatcccagctactcaggaggctgaggcaggagaatcgcttgagcctgggagtggaggttgtgatgagccaagatcacactgcagcactctagtatgggtgacacaatgagaccctgtctcaaaaaaccaaacaaaaacaaaaaactatgtaactgtcactcagaacggtttttattattttagaaatttcgctcagagacatttacaaaccacagtaaaaagtaaaaatgttttaaactttatagcagttatgtttaacttatttattaatcttgaccccaaaagatttttggctgttgaagaaaattaaagaagtactagaggagtaagctccctgtagatgcctctcagtggtaacgtaattggaatagtcatgcatttgaaaaaggtgaccattttgagtgagatggtgtttgtatatagagaggtgtaattacggcagccattttaaagtcataaagttgaactttgaacctccacagtaagctttcagtgagtatttgatagactggcctttgatttctgtaatgtgctaagcttaaattttgtgttacacatttgtatttcttcagatgtagttacatgtctgttctgccccagctagactgtgatatactaaccaatatgttgtctaattcacggttgtgtcctaagtaactggcgaagactagcatatgtgttttatttaacagaattgtatgggagagaaaagaggtcatgggggtcaattactattgtaatagctttaaaaattttttttttctgtaatagccttttttaggggatgatcatcccttaattccacagttttatttacttcattcctaaaatacctaaattctgaatctcagtgtaacatgttaactggacttcatgggcttcttgctatgtagaaacacagagtgatgtttgtatgtatatatgtgtgtatgtatttattcatttatttttgagatagagttttgctcttgtcacccaggctgcagtgcaatggtgcagtctcagctcactgcaacctctgcctcccgggttcaagtgattctctgcctcatcctcctgagtagctgggattataggtgccagccaccacgcctggctaattttttatatttttagtagagatagggtttcaccatgtgggccaggctggtctcgagctcctgacctcaggtgagccaccacactggccaaaacacagagtaatttaaagttcttgcttagtagctaaattcctaccaaaatgtgcttcttgctgttaacagagctaaatttcctttccgatttttataaatttatatataatttgttgaaatgagctaggtaatgggctaaatcaagggtacagtacatcatctgaacattggcagcatacatacagtggaatcattttccatgattttcaatggttggctttgtttaaaaaagtcacattattgtagtaattgaagaagaacttatcctagcgcatgtttgatctgtcaggctgtaggttactattggatgttgatttcagtgttccagtgtacagatttgaatggatgattgaagtgacatcttgcatcctcatgagtaacatactggctgtcgtggtttcaggcatgtttatatatttgggtgggtaatcattttacatcaatttataactatgcaaatatttttacaaaatacaccataaaatgcccatttttgatcatgcttatttggagttaacatacttggagcctgaaatacttaatttggaataaaccaagccctggacattctgacttactgttttaaaaattatttgagtggccaggcatggtggtttacacctgtaatcccagcagtttgggaggccagggcaggtggatcatgagttccggagttcaagaccaacctggccaagatgctgaaaccccgtctccactaaaaatacaaaaaatagctggggatggtggcgggcacctgtaatcacagctactagggaggctgaggcaggagaatcgcttgaacctgggtggcagaggttgcagtaagccgatatcgcaccactgcactccagcctgagggacagagcaaggctccatctggggggaaaaaatttatttgagcctgtaatcccagtactctgggaggctgaagtgggtggatctcttgaagtcaggagttcgagaccagcctggccaacatggtgaaaccccatctctactaaaattacaaaagttagccaggcatagttgcgtgcgcctgtagtccccagctactcaggaggctgaggcaggagaattgcttgaacttgggaggcagaggttgcagtgagccgagatcatgccactgcattcgagcctgggcaacagaacaagactccatctcaaaaaaaaaaaagccaggcgtggtggctcatgcatgtaatgtaatcccagcactttgggagggcaaggtgggcggatcacctaaggtcaggagttcaagaccagcctggccaacatagcgaaaccccgtctctaaaaatacgaaaattagctgggcgtggtggtgggtgcctgtaatcccagctactcgagggaggctgaggcaggagaatcacttgaacccgggaggcggaggttgcagtgagccaagatcatgccattgcactgcagcctgggcgacagcgtggactccatctcaaaaaaaaaaaaaaattatttgagacaccttagttctcaacctgccttttaccactttaatggatttacctaactttgttgccaggctggagtatagtggcaaaatcgaagctcgctgcagccttgaactcctgggctcaagtgatctcccacctcagccttccaagtatctgggattataggcatgagcctctgtgcccagctttagttagtgaattttattttatttgagagaagatattactctgtcacccaggctggagtatactggtgagatcacagcttactgcagccttaaatcctgggctcaatgaccaccctgcccgccccccgctgcctctgcctcctcagtaattgggactacaggtgtgccaccaagagtggctaagctttttttgtttggttggttttagggtcttactgcgttgctcaggctggtcttgaactcctagcctcaagtaatcctctgctgaggttatagggatgaaccaccatgcccagccctgcagtaaattttagatagttgacatcatttactcatttatcgttataatcaggatttactggctttgataatttttgttctgttcaaataggacagatttcacatacatatgacagattacaaaaatttttattacttaacgtgcttaaatctgaataaagcaattgtgtgtttaaaaatgaacagttatcccagcttgcctggttggtggctattttcacagctggcctatctcaattttcacttcttgtggttaggaaagtagcactagccaaataaaggcaaatatttaaaggcattttaaattaattatattggttatagctcaaatttgccatcctgttaagctttattcatttatcttttttttttttttttttttttttgagacagagtcttgctgtgtcacccaggctggagcgcagtggtgcaatctcggcttaccgcaacctccacctcccgggttcaagcaattctcctgcctcagcctcctgagtagctaggattacaggcatgcaccaccacacccagctaatttttgtatttttagtagagacggggtttcaccatgttggccaggctggtctcgaactcctgaccttgtgatccacctgccttggcctcccaaagtgctgtgattacagccatgagacaccacgcccggccagtcatttatcttttgagacaccatatattcatttcaatctttgaagcgagttttataactacttaaaaatttcaccttatgccgggcacggtggctcatgcctgtaatcccagaactctgggaggccgaggcaggcagatcacctgaggttgggagttagagaccagcctgaccaacatggagaaaccccatctctactaaaaatacaaaattatccaggcgtggtggcacatgcctgtaatcccagctacttgggaggctgaggcaggagcattgcttaaacctgggaggtggaggttgcggtgagccaagatggtgccattgcactccagcctgggcaacaagagcaaagctccgtctcaaaaaaaaaaaaaagaagaaaagaaaatcaccttacaagagccccagttccctctttagaaatataagaaaataaattccgttaaatatatttactttaaattacatgttttcatttcttaagctttggatttgtagccaactttctgggagacagtctgtgttaatagcaatataggatatcagkgtttttaaattggcttatgaaaaagtacagatttttaaatgaaaattatttaatcagtatccattgatttacttaaaagagccacatgtattaagtgatagcattctttttagtttagtgttttttttgtttgtttgttttgtttttttgagatggagtcttgctctgtcgcctaggctggagtgcagtggcgctatctcagctcactgcaacctccacctcccaggttcaagcgattctcctgttctcagcctcccaagtagctgggattacaggcatccaccaccacactcagctaagttttatatttgtagtagagatgaggtttcaccatgttggccagcctggtttcgaactcctgacctcaagtgatctgccccccttcacctcccaaaatgctaggattacaggcatgagccacccgccatgcccggcctctttttagttttgctattagaagtgataacattctttttagtttcactattagctttccttgcattcacattttacattctctcattagcatttctatccttggcattgttgagtttctaatgcttttttgcgtgagtgttttacccattaaatgtttttgtttaatttattattttcaagctttccttttgtttccataatgaatctttgtgagattcctgtattttagccatttccaaaaagtgccattttacttatttcactggaagtatttaaccattccaaactacaggctctaagtagcatcctgacattttagatctggaaagggccctttaagatcactgtatagaagtgtaccattagagtgtctttgttgtatatatatttcgttgttaatttagtgatggctgattatttctgcccattaggacagggcttaattcaatcagtatattaatcaccagtgtgaaggataaaaccttttagaacaacatgggatctaaataagttttttttaaatgccactgttaaggaggtagtgttttgtttttatttttccccctaaacacaagagagaagtcagggaattgttacggaggattcttaacaattttatcagtttgggagaaagcagtggtgaatatagacagcttttaatctagtttttgttttctctactgtcagctttctacagatcaaaaaattgggttgccgggggcagggcagcaaataccagttactttaaatgttttaccatgatcttctttttttatagggaactgactcttttttggagtaaactgcaaagaagaattgacccttctttagatacttttttggagcgctgtcgtcagtttggtgtcatagctaaaacgcagcagcatttattttgcctcattagagttatacaaactgaagtgagtactttatgccttctctgctaactgtagctggaggaaagaaatgagtgggaagataacttctcaggaaattccctttaaaggaagataagaaataatgagttttaataagattaatggaattgaccacatctgactgtttctccagattgacttcctataattaatcagaaacaaattgatggtcaaacaagttaggtgatatttatttctaattactgtgaatgaagttgtgtctcctgtcacgttaagaacattttaagaggccaggcacggtggctcaagcctgtaatcccagcactttgggaggccaaggcgggtggattacttgagctcaggagttcgagaccagcctggccaacctggtgaaaccccgtctctactaaaaatacaaaaattagccgggcatggtggcgggcgcctgtaatcccagctactttggaggctgaggcaggagaatcgcttgaacagggaaggcggaggttgtggtgagccaagattgcactgctgcactccagcctaggtgacagagtgagacttggtctttttttttttaaaaaaaaaaaaaagaacatttcaaggtaactatagaacttgcctgtttaaacaattactttataattggccattagaacattttgttttgtttaaatctttaataaaggtactaattttctattgttgaataacatcacaaaaattaatacttaaaacaatgtccgtttttatcagttcagttttgtaaatcagaaatccagcacaatgtggcaggattctcttctaagattatcatattggctaaaatgtagtttgccaggctaagttctatcagaggctctgtggaaaatccacttcaaagcttattcttatcgacaggtttcagttcctgtggttgtaggactaaggtttctgttttctggctggctgccaatcagggtctgttctcaggtgctagaagctacactcagtctttacctctgttttcaagcagcaagggtgcaacaagttggtgcttgaaacctgacatcctccatctctgactttagttttcagtttttggttgagacaggtctcgctctgtcacccaggctgtagtgcagtggtgcgatcatagctcattacagcttcaaactccttggctcaagcaatcctcccgtctcagcctccagagtagctgagattgcaggcgtgtgccactatacctggctttttcttttttggcggggagcagtggtagatacagggtcttgctttgttgcccagactggttctgaactcctggcctcaagcaattctcccacctcagccttccaaagtgctgggattataggtgtaagctgccccacctgcttgaacttgggaggcagaggtggcagtgagccgagatcacaccattgcactccagcctgggcgacagagtgagactctgtctcaaaaaaaaaaaaaaaagcaaagattgaatgacttggctatatcctatgtgcgcttgcaacagtatgccaagtcactcttgatccctcaccttcctagtttaagacccaccaatttcttcaaaattcagctccacattgcatatcctgattcacatttattcactactcctttcagtaactttttggcatatctgttcagaatatataatagtatttctggttacttttctttgaaaaatgttgttagtgatttttcaaatgttaccatcccagccagattaggctgtttaagaaagaatggccattctttgctgtccacctcacagtcttccaaaaggagttagtaacttgttgagaaactgaattattttaaaatttagctgactttccccaagtcctctctgctcttacttacaaatgataaacttmtatcacatcatcctaataagtcaagagacccatggtctagtcctgtggagccactaaagcaacatggcctgttttacttggactacattccaaatgagagggagaaacttctatattctttaggccactactgttgtgggaagtctgccactcacaacagaaccagatcctagctgatacaggctaggtaatgcctctctttcaaaaaagctagagtctcagctcgtctgaaaggtagggagttatctcaattgattgttcacagtcagttacagactgaactctgttctactctttcccccttctcactattacacttgactagttttaaagaaaaaaaagttggagtctcagtttgcaagggattctacactcactcactcccttttcacctaccagtccacatctcttctactcttcaggccaaatatcttcttttttttgagacggagtctcactctgttgcccaggctggcatgcagtggcgtgatctcagctcactgcaacctccgcttcccaggttcaagggattctgatgcctcagcctcccaagtagctggggctttgggcctgcatcaccatgcctggctaattttttgtatttttattagaaatggggttttgccatgttggccctgctggtcttaaactccatgcctcaagtgatgtgcctgcctcggcctcccaaagtgctgggattacaggtgtgagccactgtgcccggcctaaatgcttttaagtccttgctcctctgctcactagttagtgacattgggcaacttaacgttctgagtgttgggggttttttgtctataaaatgaggataataygtgcaaaaaagtttatttcaaataagtgcctaggctgtagtaggggttctgtaaatcaatgacagtgatttctttgtgttcccagcatttagaatgaatgatgcccaacacagaattaaatgcctggcaaattgtttactgatttaaacagtggaatttactccattattttacattgtattctgttaaatagttacaatgtgccagcgttattatttcatctttataaccttaggaggaaaatctgttattaacattactgttatcattttaccaataaggaaactgaagtttagaggttgagaacttgtcacttgttgtgaagctggggttcaaaggcagtcaaagtctgattctaaagtctctgctcatagcagtgcgttttaagccactctgacatatcttgcttttctttgctcatgtcatttttgtattttatttcagcctctcagataaaaagagttatcttgtatgtaccaagcttttatcacatatgaccaggtcttcctaattttaaactagtttctgagaacctgctgccatagcaagatttctgatttctgttttttccctggaaagctgagattcagtacacctgtgacggtgactataaattaccagattctttcaggaggaaatggaaaggatcatttattttatctttgaagttttgaaaaatccaagtgttcatgatagagagaatttttttttttttttttttttttgagacggagttttgctcttgttgcccaggctggagtgcaatggtgtgatcttggctaaactgcaacctccacctcctgggttcaagcgattctgctgcctcagcctccgagtagctgggattacaggcatgcaccaccacacctggctaattttgtatttttagtagagacggggtttctccgtgttggtcaggctggtctcaaactcaggtgatacacctgcctcggcctcccaaagtgctgggattacaggcgtgagccaccgtgcccagccaaagagaatttcttaaattgaatttaatcttagactcacatctatacctgtgtttcctgttgctgccattttaaaccctgcccctctactcaacatcattctattttgaatcctccagtgaccttttttatcctgaatttctttggattcacatgcatttattgtttatgcattcggggtacagataaattccttggaagtaaggaactgctttaatacacagtgcctagtaaatgtacattgttcgtagttgtagcatctaatttagttctttgcatgttgagacaagaaatatctaaatgtaactttcatgaagaaagatktaagataaaatttaggaactctaaaagtttktacaagctaaaattccttatcagtgaaagttatataatctttctgtatgcaaaaaaataatttttttatcctcttttacttacaggcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattytaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattrctgttaaaaggctctcaaaagggtatttgtcctaagagcccctctgcaatcccagagcaaaaccattcattgaatgaccaagccaaaggagagtctcatgaatatgtcacrttcagcaaattagaagattgccacctgcaagacaragatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcaygaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagyctttgggccctccagtttaaaagaaaaatgttccagtatggcagtttgttttgacgggactaagtttacctgtgrttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactcyccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattaygatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcwcwcwcwgtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagygcacagaacacagccattcccygggtgacagtagtgcacccatccagaacactgattgctgtcattcaagtgaaagggatggaggtcagaaagggtgcatagaaagcagctcagtatttgatgcagatactctgctctacaggggaactttgaaatgtaaycatagttccaaaaccacttccctagaasagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagadgatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacccattcgttgtttactcataatgagctttcatgccacatgtaaactgaaattgcacttgtattttctgaaatatgccattcacattttaccccagtaatttttttatttattattagctaaatcattcagaacaaggttcttttttttttttttttttttaagacagagtttcgttcttgttgcccaagctggagtgcaatggtgcagtctcgactcactgcaacctcctcctcccaggttcaagttattctcctgccccggcctcccaaagtgctgggattacaggcatgagccaccgtgcccatcccagaacaaggttctttttatcttaaaatttttgtttttgtggaaagataattctgagattaattagctgcgggagtcaagatagctcccagaggatgtccagatgttggccgagtagaaaggagaggatatgccaacctagaacatgaaggacgtagcaaattcagagggcatgtttctaggaaactacaaataatttgatatgctggcaataaaaggggaacaagagagtgacatcattgtagagatagcaggaactaaatcatgaagactaaggagtttggatttgagtctataggcatatatcagttgaagtgtggagtgctcacttgatttgagaagctgaaattggaaacagtatacttgaagtaattgaggcaagcttggtgagtgtatttactgacaattgcagcagaaggcagagtagatgaagtatttaaggagacaggattttgggggcttggagagtgaaggaaaagatttggtactgatgcaaccattttaagtaggtatacaaagaaggaatgaatatttgggaagataatggaaaccaaggtgagtttggcttttagatgtgttgagtttcattggactgtgggatgtctgtctaatgaggatagcagtatatccttttaatacagcagcttcatttcctgttgcttgtgaagttttcaactactttcattagctagtaatgaagtgactcagacaactaacatctctttctcatccttgtggttagattttttttttttttcaacggagtcttgctttgtcgctcaggctggagtgcagtggcgcgatctcgactcactgcaacctccgcccctccaggtttaagcagttctctgcctcagcctccagagtagctgggattacaggcttgtgccaccacgcccggctaattttttgtatttttagtagagacagggtttcaccatcttggccaggctggtcttgaactcctgacctcgtgatccaccctcctcggcctcccaaagtgctgggattacaggcgtgagccaccacacccagtctattgtggttagaatttcaagaccttttctctgactcttaaaccttattttcttgttttgtcagctcttcaggaatttcattctgtcacctcaccctgagtctaaagcactcccataaccaagtcgtttattgtctcagatcccagtaggtaacagaggattctgagaaatccaagtgatctgagtaagactctgttgaaagaagtggcagaaacaaggatcttagagactgagaccagtattgtttctttggaatcaagctaatttcttcagtggctttaatttcctcacttacgaagggaggaggtagaggtgaaaggtccctttttgtgatatgagcatgagaagcacctgtaggcctagtaaaaattcctcatacgagagagatggttagtccagagtaagagaaagctactaagactgaactatatccattcaaccacacagaacttgtagcccctggaaggaccaagtgaggccattcacagtggaactaaacctagattttaagaacccaattaggccgggcgcggtggctcatgcctgtaatcccagcactttgggaggctgaggtgggcggatcatgaggtcaggagatcaagaccatcctggctaagacggggaaaccccgtctctactaaaaatacaaaaaattagctgggcatgatggcacacgcctgtagtctcagctacttgggaggctgaggcaggagaatcgcttgaacccgtgaggcggatgttgcagtgagccgagatcgcggcattgcactccagcccaggtgacagagcgagacttgtctcaaaaaaagtaaaataattcaagtataagcctaagtagttgatcccaagatcactgtctatcccagttagagcagcttgcatcatttgatctttattaaagacttttggctgggcgcgrtggctcgcacctgtaatcctggcactttgggaggctgaggcgggtaggtaacctgaggtcaggagtttgagaccaggctgaccaacatggagaaaccccgtctctactaaaaatacaaaaattagctgggtgtggtggcagatgcctgtaatcccagctactcaggaggctgaggcaggagaatcgctgttggaccctgaaggtggaagttggagtgagctgagattgcaccattgcactccagcctggtcaacaaagcaagactccatttcaaaaaaaaaaaaaaaaaaagactttcctgtttaaaccagcatgagtgactatacgataatacagggcaaagggttatttttttagcttgtagtaatcattttaacttgatatctctggaatttgtcccaaccctggcacagacctgaaagcactgactttgttttcaaagctttttcaattcaagagtgcctccaaaatggtgagtaggaatgaagacttccagacacttctattcttgcctttacccagaattctcttgcttcagtgttttccccattttcatgagcccatgtgtgaaatagggtaaggaactgtggaggagaaagttttttattagccttcctcagggtattccattctcaatctatcctttctcagtcccaaaaggcctactgagctgaactgcctaagacataatcattcaccaaatatttaaatacacacatttaaagagatacaattccagatgcaatgggagacaaaaaaaaaaaaaagttgtcagggccatcaagaagctttcacaaggtgaagggagggctggagtatctcagaacattgttacttaaagtgtggtagtgggccagcagtataggtgtcacctaggagattgttattaataaaaatgcataaattcaggccctactccagacctactggaccaaaatgtgcgtgttagtaagatctccaggtgattcttaggcacagaaaagttctagaagcactggcctggaagtggaaagtactgtgagaattcagggtaattgtgctttttagcattttacataaaattatgttgttgaattttcataatcctatgaagtaggtgctgttactatatttgacaaagaacgagatgaagtgtcttgcctggctggcacaaatagaggtggagcccagtttccaatctcttctgactagaagaatgtcagagagggacatttagtgtaaaggaataacagatggaaagttgcaggtggtatttgaagtaccaaaaataccacagttctgtaatgtgagtgttgtttgtgaaggtgaatagtgggaaatacaatttgaagtgtaggtgaaagccaggttattcaactcaaactccacagtcatatggtgctgacatttcttcatttgagtatagagatgggaaacgtgcatatttttttctgtgaataacatgtaacctacgaaaaaggcaagttttcttttctgaaagaaacttactcatttttgttattttttgaggcgaggtctcattaggttgcccaggctgatcttgaactcctgagcccaagcaatcttcccaccccagcctcccaaagtgctggaattgcgggcatgaaccgctgcacccggccagaaacttctaaaactcagaaaagttgctcctcctcacctcctaccccaaggtaaactgtgatacctcctggctttatactactgattttataccctattatatagaactgtgtctagagagagtggcctatccctctgtgaccttcttggtctactcctgcaggagtggcttctgtgacagactgcatttggaggtttgattcactctggggaaggtaaccaggataggcaagagatttaaaaatctgtcagcatgtatttgacaggtataacctgaaaaaaaagaccagaggcgtaggaaagctatctaaatggttaagaagccaaatatttacaaagcatataccatctgctagcccctgggtggtaggtgttgaacaagactcatttcctgcatcatagagatttaagaatccagtaagggactgggtgcggtgactcatgcctgtaatcccagcactttgggaggcacaggcaggaggatatttgaggtcaggagtttgagaccagcctggctaacatggtgaaaccctgtctctactaaaaatacaaaaattagccgcgctgtagtggtgcatgcgcctgtaatcccagatactagggaggctgaggcaggagaaccgcttgaacccaggaggcacaggttgcggtgagccaagatcaggccactgcactccagcctgggcaacagagtgagaccctgtgcccccaacctccccacccccaacaaaaaaaataatccagtagggaagacagacattaaaacagtacaaataataaagtaaaagtgcttttaaacagggggggtggaggggcttatgagaaggggaccaaaaaaggacagcaaaagcttcattgaggataatgtttaaactgaaacctaaagaatcaatagaagttagccaggcaataatctgtagtcccagctactcgggaggctgaggtaggaggatcacttgagcccaggagttagaggctgtactgtgcaataatcgcacctgtgaataggcattgacctccaagctgggggaggagggggaagctaggcaaagaacaagagtaatccaattatgtgccaaagctttgtggttcaacagcttggtgtgttggtgacattgataagactactatagctggagttgaaagaacaaatggcagaggaagagaagacttggtaggtaagcagggaccaggcattttagtgccctgttagccatgttacagattttggattttgtttgaaagacaatgaagaacctataagaatttttcaaaggcggactgggtgctatttctcatgcctgtaatcccagcactttaggagggcaaggtaggaggatcacctgagatcaggagttcgagaccaatctggccaatatggtgaaaccccatttctactaaaaatgcagagatcagccaggcgtggcacgtgcctgtagtcccagccactcaggaggctgaggcaggagaatcgcttgaacccaggaggcagaggttgcaatgagctgagatcgcaccactgcactccagcctgggcaacagagcgagaccctgtctcaaaaaaaaaaaaaaaaagaatttaccaaaggcttgaaagtaggcattgcctaagtcagtaagtcctaatagggcatgatatggaagactactgagtggaagtgactgacagatgagtgggtggatgccactattaaaggtaaactgaaggccgagtgtggtggttcacgcctgtaatcccagcactttgggaggcctaggcgggtggatcacgaggtcaggagttcgagaccagcctaaccaacatggtaaagccccgtctctactaaaaataaaaaaattagccaggcgtggtggcacatgcctgtaatcccagctactcaggaggctgagccaggagaatcgcttgaaccccagaggcagaggttgcagtgagccaagattgcgccactgcactccagcctgggagacagggcgagaccaaaaccccgcctcaaaaaaaaaaaaaaaaaaaaaaaaaaaaaaaaaaaaaagccctgtttatatcctacctccttgctgggtgcagtggctcatgcctgtaatctctgcactttgggaggccagggcaggtggatca

SEQ ID NO: 12167 - DNA, 29207 bp, Homo sapiens
gatgaatcagattcaatctctgttcaaatataaaatatctctatgactacaacttaaaattgtattgaaagaagagaaatcctgagttaattctaataaaaaggaaatagaagggacatttatcttccctattttttgctctagtccctaggagggtgtggccagactctgtaaattgttccttgggagaagggatgaggctggggagggmatggtgtctatgctccctcctggtctgggacctggcctcttaggtcctcattttcaggcttgatcctgcagaaaaaattaccatggtaggtggagcaaaaacagacatttgagttgcttttttgtgtgtatcttgatatgatcttaaactctttgcattaatagattttctcatttgaaaccgttctgtccttgctctgttgctgaggttggagagcagtggcgtgatcttgggtcgctgcaacctctgcctcccaggttcaagcaattctcttgcctcagcctcctgagtagctgggactacaggtgtgtaccattatgcccagctaatttttgtatttttggtagagacagggttttaccatgttggccaggctggtctcaaactcctgacctcaggagatccacctgcctcagcctctcaaagtgctaggattataggcgtgagccaacgtgcccagcccaatctgttaatattttatatgggatttttgcatctatgttcgtaaaatagattggcctttaatattccattctcttactgcctatcactggtttgggtatcaagtttatatcagccccattaatgagtttgagaatgttctttatttttctattctctaaaaagtttgtagaatatttgaattagatattctttttttttttttttttttttgagaaggagtttcgctcttatcgcccaggctggagtgcagtggcgtaatctcggctcactgcaacttctgcttcccaggttcaagcgattctcctgcctcagcattcctaggagctgggattacaggtgcccaccacacacctggctaattttttgtatttttactagagattgggtttctccatgttgggcaggctggtctcaaactcctgacctcaggtgatccgcccaccctggcctcccaaagtgctgggattgcaggcgtgagccaccgcgccctgccaggtattcttttaagtgtttcatagagcttgtcttattgatttataagagttctttgtatgttttccatattaatgctttgtctcgtaatgtatactgtaaattatataatttatataatatatattatctaaatatatatttagatatgtaattgtatatgtaatatatatatgtaattgtaaatatacattataatacaggtgtgagccaccacactcggccaacatggagtttccttatacagaaatgtagatatatgactctcaacttttctgacttttaattttatctgtaatttttattgtaaaaaaacttaaaaagtgtgataaagtgtagaaaagtgtgataaagtcaactttaagcatttttcttatcttttttaggttttgtgtactgcccagaaatgttttccatgacaaaaaaaattattttttaaatttattttaggccttttataatttgctatctttatatatgggccctcaattaatttgttcaagaatatagttttggtatgctgatatagaaatctaagttgaatttttttctgaatatatggccaattacctcaacatctagtctaccctttcctcactgctcttgaatttaacctttatcataaactaaatatatatactttcatcatagatttcaaatattatatatatatacatctatgttgcccagtcttgaaatcttgggctcaagggatcttcccaccttggcctcccaaagtgctgggattacaagcatgagccaccatacctagccatttgtttttaagtttctatttttattttttgtgtttttagagacggtcttgttctgtcacccaggctaggatgtcatggctcaatcatagctcactgcagcctcaaactccagggttcaagtgatccttccacctcagcctcccaagtagctgggagacaccactacaccctgctaatttttttttttttttttgtagagaaaggggtctcactgtgttgccccagctggtcttgaactcctagcctcaagtgattctcctgcctgagctttcaagagtactgagattacaggtatgagccaccacacctggccaacatggagttttcttatacagaaatgtagatatatgactctccacttattcagggtctccctgtgctttaagagtcctatgcaagaagtacctactgaggaggctgaagtgggaggatcacttgagccttggaggtcaaggctgcagtgagctaagattgtgccactgcactccagcctgtttccaaaaacaaacaaacacccatatgcaattggctggaacctccagtccatgtcttgtggtccaaagccttccctaaaatttatatatatatatatatatatatatatatatatatatatatataattttttttttttttttttttagacagagtttcactcttgttgcccaggctggagtgcagtggcgtgctttcagctcaccgctacctccacctcccaggttcaagctattctcctgcctcagccttcctgagtagctgggattacaggcatgcaccaccatgcccggctaattttgtatttttagtagagatggggtttctccatattagtcaggctggtctcaaactcccgacctcagatgatctgcctgcctcggcctcctaaagtgctgggattacaggcgtgagccaccttgcctggcctaaaatttatcttgattggctccagctttaagcttcagctaccactggattggttcagtttataaccccaagtgtggcaggatgtattttccaaagatggttgcatcaataataaaaattgcatccccaggctgggtgcagtggcccacacctgtaatcccagcactttgggagtccaaggcagaaggattgtttgagcccaggagttcaagacaacctgggaaacatgacaagaccctgtgtctacaaaatataaaaaattagctgggtgcatggctgggtgcagtcgctcacgcctgtaatcctagcactttgggaggccgaggtgggcagatcacttgaggtcaggagttggagaccagcctggccaatgtggtgaaaccctgtctctactaaaaatacaaaaattagccaggcatggtggcaggcgcctgtaatcccagctactcgggaggctgaggtaagagaattgcttgaacccgggagatggaggttgcagtgagccgagatcacaccactgcactccagcctgggcaacagagcaagactctgtctcaaagtaaaataaaataaaataaaaaattagctgggtgcagcggtgcatgcctgtagtcccagctactcaggaggctgaagtgggaggatcaggagcccaggaacttgaggctacagtgagtggtgattcctccattgcacttcagcctaggtgacagagggagaccttgtctcaaaagtaagaaagaaagaaagacataaataaataaattttatcccttattctcttcttaaaatgtgacactggctgggcgcggtggctcatgcctgtaatcccagcactttgggaagacaaagcgggcagatcacgaggcgggcggatcatgaggtcaggagttcgagaccagcctgaccaacatgatgaaacctcatctctactaaaaagacaaaaattagccgggagtggtggcgtacgcctgtaatcccagctactccagaggttggggcaggagaatcgtttgaatccaggaggcggaggttgcagtgagctgagattgcgccactgcactccagcctgggtgacagggcaagactccatctcaaaaaaaaaattaaaaaatgtgacattaacattcatccttgaggtggggtctctgttccctccccttgatcatgggcagacctttgcaattgcctcaacagtaagaatgtggtgaaggtgccactgcatgacttccaaggacgggtcctgagtggcaattctcttcagtctggtgctctcctactccctctgagctgctatagaggatgttcagctaccttgaagctgccatgttggagaaacttcatggaaagcccacaaagagataaaggagagaactgtccaagcaactccagctgttccggccccagcggttgaaggcttcccagtactgacatcagacatgtgagtgaagaagccttctaggtgacatcaggcccagccaccatctgactatgaccttataacagaccccaggccagaccgaaccagcagagtcactctcaaattcctaatccaaagaaattgtcattttaagctgctgaatgttagggtgatttgttatggtgcaacaggtaattaatacatcaatgtgtgctgtccagactgtgaaactcatcctctttccataatttccacacacaaaaagaaaacttactcacacaaggcctttcttgtggttagcccacaaaagatggagagataagtgatgtgaaacaaacaacttaaaattgaatttggacatcccagttctaaaaatcctttataggtttaccccacccaccccaagcaatgcccaccatccctctcttacatcctcctcctcttgctctcatcttccaacaaacttcaaattcttcttcactctgttaggcagagcaattacattctctcaagctctttctcccaaactcagctccaggacaacctttcaaaatccagagccctttgctaacctgcccaatggagttggacttttctagcttcaactaggttcatcattttagctgatctgcctgtggccagcttccccacattggatgccaacctagtaaaacagtcatccataaatcataaggaaagctaaaatgtatcaagcacctactatgtgctggttcgaggttaaatgcctcgcatgagtcatctcattcaatttccacaaaaaccctttaagataaggacaatttgctgggcacggtggctcatgcctgtaatcccaacactttgggaggctgaggcaggcagatcacctgaagtcaggagttcaagagcagtctggccaacatggcgaaaccccatctctactaaaaatataaaaattagccaggcattgtggctcatgcctgtaattccagctactcgagaggctgaggcaggggaatcatttgaacccgcgaggcgaggttgcagttagctgacatcgtgccactgcactccagagccttttaagactctgtcttaaaaaaaaaaatatatatatatatatatatggactattagtatccccattttacagatgaggaaaatgagacttcatagagtttggggtgcctgtggtcatatctataattgtgaaaaagtcagattccaaagcattttaccaatattgcctaagtgagtgggagggaagggaaggctctctggagtcgggctatgctggacagcggggttcggaaactctggtgaataaagtggtagttgtttctatgaacatggagtgagaaggcccaatcctaaacacaccagtgcttaaggcagctgcagagaattaaaggcaatagaaaaaggggagctggatggcaggagcttggatggggaagacttcaagggcaggtgaagatgccaacagcttcctgcctggaggaccgaagaagggttgggcttcactgcagacctccaggagacagatttgcttgttgggacagagtagggaggtgaaagcgaggtgaggaagttcgggggtgggggaggtgcacacagytccactaaagagctggaagaggccgatggagtattcatgagacggctgatccaggaaggactgtggcatattaatatggaaaaggcctgtttgtttgtgcttggagaggaaggagccagaggagaggggagcaaggtgggcgggagctggggagagcctgcagcaagatctgcagagcccgaggtgctctcggcmtgggccctggagaggacgtagggtaagtgatggggcacaggctgtgcgtcagggggaaggtgctggggcctgaaggtcccgaggggaacctcagacggccttatgccttctcacaaagaaactggaccatcatytccgacccgcaccccggtcgcccctcgaggacagagggtgggcgcaggaggctggaccgagcggggcggagctggatgcctggcgccggcmtccctcccggcaaccccsccggtcctctcaggtgacagctcacgccggcccccgccccgccccccgcatattcaggagccccagcccaccctgcccgcgaacagccagcgctggaggagcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattgtaagtttcgcagcccctccgctgccagggtccagggtgcggggtctggagtccgggatggaggagctctgcctgtgtcccgcgcctactgacacccctagcccgagaggccacctgaggacagcgccgcgggcaggtcccctcggtgggtgcatacatggtgcccatcgcggcaccgtgaatggaggtggctgagccggagagtcaaacgggacccgtccccagacgcgcggcccggcccgggacaggcagcgtggggcaggagctggcgcccggtcctggcagcccggggagcccaggtggcggggcatacaatggtgctcattcacccgmtgcgcagcmtccgcccccgccgcytcccagggggcgccggctccaaccagacgccgctgtcgccccgaggcggcytctcggccctgcccgcctacccacgtctcccttccgagggccgccgggggctgcgggcgcgcgggtagggcagagactgggcccggtcgggtgctgggtgtggtttcgagctcgcmtgcggggcgccagcctggcacttcgcggcctggggaggtcgtgggcaccgggacccctgcmtgggtccgagctggcytcttaaaagggccgccttttaagatctctgatctgttcagagatgggcagcaggatggagactctccagctgtgagctcgcctcatcttgatatgacttgtgacctccctgaaacctcacacccacccaggggcattgaattgcaggcaaacgggatccagagagagggtctgctttctgggaggtgccggctcctcctgctcccctgcagcagtcaggrcttagcagagggaggaccgggcagctgtgctgccgaaggggcgctccgagtgggaagatagtacccgcttcacctccctacacctcctttctctgcgcctcccccactttcccgtcgggttttcccscaccatggggagaggaggaggcgctgtctctgcctgtcgttcacgtaagaacaacaacccgagccaccgctcactgagggccggcagcctgctaggcacaaccttacattccatctgtgatttatttgagctgtccacgtctccatctattccccaccgcgaccgcgcaagggcaaactggcacagtggaaggagtcgggcagatccagggcggactcctggcgccgccgcccactctcagtgaccatggacccttcacgttytgagccagtttcttcgactgcaaactggggcccgtaatagsgcccgcctcccggttytgagtattctgtaagataatgaatgcatgtaatggcacacagtgcctgctatacagaagattctcaatacgtgggagttcgcggaagagctgcgcccctaggaccccgctcccagggtcgcttgcagccccggggacgcccagcttcctgcrctgtytgaggactgccccaccccgtgtgtgtttttcagagaggtccaccgggagagcggggccccccgggtcccccgggaccgccgggagtgcctggatccgacggcatcgacgtaagtctctaacctgagaccagggcgggagggaggcggcagacaaaggagaactttgtgagcgctgtggtgggggtggggacttsggggtgcccggagatgtagtgcccstcgtcgccaataggcggcgccggcccgcaccacaaggacgccgtttgttytgcaaaaacctcaaaccagccctgacatgcggagcccgttatagccgccgacagacaaggagytgctgttcagtccgccggccgcagctcacagcgaggcctcatccccctyctctcctttcccctccttgtggggtaggaggcgactcaacccctcaccctgcctytggcacatytggacgcttcttcaggttcgcttgggagccttggccagaccaccgaccagcttgggccagactcctgtctcttcccttcggttttctctccccgatttaraatcagctgggcttgttccctgcagggtgagggttaaatacctcattytgaaagctcccgcaggagggccgcttgatgtttaccagtctggacagacttctattcaacctggtgcccccamcccccaaacacaggatgctgggcccccggccaggccctggctgctgagggctctgaaatgcctggaggcctctctggggctgaatcgcactctaccggccctgcctgcccaccaccaagggtcctttggcactggaaggaggtccttccctccttgggaacactgaatttcccccttgcagtcccccttggtccttgccactggctcagcttcccgttctcctgccctgcagtctggaatagagctgctgcccaactcgctcatcccccttcacgtttctctaaaagccccaaccttcctcccacacgtgcccaaatccaagaggcatcagcttggagcccccagccctggtagtgggtctcacagctggcacctcatgacatcagcatgtctgtaccttcttgcatgttgctgtcaccctctccagcccggccagggttattctcatgctcctgtgatttgtttttggtttttatttttgaggaaaagggggctcttttcccaaagattgcaaggcttaggggacctggacagaagagaggagagtgaggagagcctttgggagcggcctgccagggcctgtgtgtgcccacttggggtagygtgagccgtagtgtgctgtctcaccaacttgtatcttgcagggtgacaatgggccccctggaaaagctggccctccggtgagtgctttatcctctttggcctttgacccttcctgctcttgccctcctctggctcatgtytgttccatctctgttttcaagggacccaagggcgagcctggcaaagctgggccagatgggccagacgggaagcccgggattgatgtgagtagctgagtgtcgggtggggcagggtagggmtctgccaattgacctccagggcctggctctggcatcttcactgatctgttcagagatgggcagcaggatggagattctccagctgtgagcccccctcaccttgatatgacttgtgaccttcctggaacctcactctcacccagggtcattgatttgcaggcaaccggggtccagagagagggtctgctttctgggaggtgcaggttcctcctgctacccctcagcagtcaggacttagtctcacatttctggcctccaaggatcaggctgaatatgttgggtggggctgtccttgtgtgccctgtcctttcctccgctcttcccctgacccctacccacagccccaggcatgactcaggagagaaacatcatttagctgataccacagagctcccagggggcccccaaggtcacaggctcttgaacacagccagccccaggggcatgaggacaacatctgatgggggttacactgggtcagtcactgaaagatgggagaaaggagaaacccccatgacttgcctctgccctgctggctcatgaggtgtgaccagggctgggacagtcaccaggaccccttcaaactcatccacaccctgcaacgattacaaggcatattgccttctatgttgcatcagttctcacatccacccagagaggcacccagatgagaaactaaggctcagaaaaagttgccaatggcctggcgtggtggcttatgcctgtaatcccagcactttgggaggccgaggtgggcagattacttgaggtcaggagctcaagaccagcctggccaacatggcgaaaccccatctctactaaaaatacaaaaattacccaagcgtggtggcgcatgcccctggtcctagctacttgggaggctggggcacaagaatcatttgaacccaggaagcgggggttgcagtgagctgagactgtgccactgcactccagcctgagcaacagagtgagactgtgtctcaattgaaaaaaaaaagaaagaaaaagaaaagagaaaggaaagaaaagaaaagaaaatgaaaaagttgtcaaggtaggacatcaagcaaatgaccaatcttgacccatggctaggtcttctagactcctgaacccggaggcatgaagcctgggtctggcataaagccaaatctttgggctttggtttctcatctttcaaaagaagggaattgttctgcctgcctcctagggttactatgggaactggggaaaaggaaagaaaggtgtggaggttcctaggccttcatgaggtgtggcaaaaaggagcctcggcccacccaggagggacccttgaacctgccctgctctgtgggtcagggagcaggttggccctcattgatcctacattttcattcttccccagggtttaactggagccaagggggagcctggccccatggggatccctggagtcaaggtaaggggcctgctggggcctcagcrtgggcaatctagggccagcgtttgggagtggctgtagagaggaagtaggagccggggaaaccccagcctctgagcctttctcgttgcttctgcagggccagcccgggcttcctggtcctcctggccttccggtgagtacaacctgcaagggcttcgagggactcttgggggagaggggacctgcagagggagccatgaagccaattttctttctttctgttccagggccctggttttgctggacctcctgtaagtcctcagggatggggcaggatccccagaactcccagggaaggaggggacaacagaaaggcttcgagggaatggccaccatgggaaggagccagcttgctgtgatagtgtcaggaataagtggacctgccagagacccagggccagcccactctgggcctgtccactggctctgcaattctctggtccttaaagcctcagtctgtcagtctctctggggttggcaaaaaaaaaaaaaaagtaaaagtggagaaacgggctttgggtgcctgtytctaccttygtgcccagggtatctgaccctctgaggcatcctgaccrtcamctctctgytccccaggggcctcctggacctgttggcctccctggtgagattggaatccgaggccccaaggtgagcctcagccaccctctgttcactgcctcctgccttctatctccaagctggcaagctgggtggtctttctggaagttcctgggcctgctcctggccactgggaaactcctccaggtctggggcagaaacccctcctatgagcccacccggcactaggtcttttagggacgccgctggccccatcccctgtcaatcaggccttcatctcccaagatggtrgatctcacaaagtgaccgggaagacagggtggagagggcagaggcaggacctggaggagggcactagggtaagctggtaagggctggtcaggggtatgatttgggcttcttttgcttccagggggaccctggaccagatggaccatcggggcccccaggaccccctgggaaacctgtaagtgtccccagacccccgacatggcaaagtgcaggggaaggagaagggtctttgagcaagcctgcggcgggaaagggtcaggccaagctccatcttcatgtctcctctcagggtcgcccgggaaccatccagggtctggaaggcagtgcggatttcctggtgagagacgaggtctggggcggggctaacacaggggggcggggccacagagatggggaggcggggccacggagatgggggtgtctggagagatggggaggggctgcagtgcaggggttccaccaggtgaggcggaggagagcacggggcttggagagatgggggcgcactgcccagctgatcacaggaccctgtgggattttctgtttccagtgtccaaccaactgtccacccggaatgaaaggtcccccagggctgcagggagtgaaggtgagagctcctggcctgaatcttgggagggtggtgcaggtgacaggaggggacctcgtattgagctctctccttcccttcaggggcatgcgggcaaacgcgggattctgggtgatcctggccaccaggggaagccggtgagtgcaaggkctgagggctgtgggtcagggatacgtggagatggtcctacagggctctgtccccttcttcrtcccttccccttcccctgtgggttctggggacagagccttgagccgggggctggaggcctgtgctccaggtcggcatgtctctggtcatgtctccttgcttggcttttctctatctgtaacacaggactgtagggttcgtagtagtccctcccgtctgcttgtgctggggaaaagagrtggtatctttgcttgtctgtatatgtgtctttccatctgcctgcctgtctgacagctcatccctgccctttagggtcccaagggagatgtgggtgcctctggagagcaaggcatccctggaccaccggtaaggaacaccttgcctcagtggccctcttctccctcaccccaggagcccttcatggagtcattccyctgctcaggcctctagcttgtaaaagagacacctgtgtctagctgggagcatctctggatggggagatggaggctgarattgtcaggaatgagggacaggaaccaaagctgtcagcaagaagcccaggctgaggtccaggtctgccactgtccctttgagtaatgcagtgagtccctcctcatctctgaacctccatgtcccatccatgagacagagactctgctgcctacctcaaaagggcactgtaagattgaaggtgggcwtcagacaaggtatcatgaagtgggccttgcaattgccattgctgtcatttttctttctcaacagggtccccagggcatcaggggctacccaggcatggcagggcccaagggagagayggtaagtgaaycttggggtgttctacaagagcttccaggagctgccttctggcccctggagttcagccaggactgacctgcaaccctttcctctccccagggccctcatggatataaaggcatggtgggcgctatcggtgccactgggccaccggtaagcctctttttgytcccctayccctgaggctggagctcctacagctacagccacagagtgggcatggctccccctgagcctgtgtgacctggattcctgcttgtctttcttgccagggtgaggaaggtcctaggggaccgccaggccgagctggggagaagggtgacgaggtgagtcctcaggcacccattgttcagtcaggacccctggggagtactgggsaggacaaggcaccccctaaggctgtgtgtgtgagagtgcatgagtgtgtgcgtgagtgtgaatgtgtagtgtgtgtgagtgtgtagtgtgtgtgwgtgtagactgtgtgtatatgagtgtatgtgtacagtgtgtatgtgtgaggctgtctgtgagtgtgtgtagtatgtgtatgtgagtgtgtgaggatatctctgagtgtgtgtgtgtgactgtgagtgtaygtatgtgtgtgtgagtgagtgtgtgtgtgtctgcccaagtgggtgacctgctggggaggaccatctgtgccaagagcccagtcagcccaaattcagactttaggmgaagccctgggatccagtcccatggtcactggggccagacaatgagattccagcaaatcagccatggggctaatgggatttggtctcgatcccagttctcttaactctttttttttttttttcccaattaatagacctgttgggggaagcggttttaagtttacagaaaaatggagcagaaaacacagttaactgttattattatttagttttttaaattattttcttttctttttaaaaattaaaaaattcttatacttttatttttctattagacagcagagatcatctagttgttttgttttgttttgtttttgagatggagttttattcttgttgcccaggctggagtgcatggtgcgatctcggctcactgcaacctccgcctccctggttcaagagattctcttgcctcagccacccaagtggctgggattacaggcatgcgccaccatgctcagctaattttgtatttttagtagagacagggtttcaccatgttaggctggtctcgaactcctgacctcaggtgatccacctgcctcggcctcccaaagtgctgggattacaggtgtgagccaacacgcccagcaatatctagttttttaatgcaattttttaactatacagaaaaccagtgagagtgatataaagaatccccatgtacctatcacaggttccaattcagttattaacattttgtcagtcttgtgtcctctatcccccagacccctccttcctttgattttgttattgctttgctctgatgttttcaagtaaatccttaacatcctatcatctcagccctagatacttttgtacatatctctaaacaataagcactcattctcacataatcacattatcacaactgacaaaataaacaagtactccctaacatcatctaatggccagtctctgttcagtttttcccaattatctcaaaaatgtcttttcctggttcttgttcaaatcaagactcacacagcatccacacactgcattcggttgttgtgttcctttggctgagtggaktgtggggccttggccaaggtctcagtggattctggctcccacccctgctctggctcagcccagcctggcctcctggcactgacttctcctccctcctgctggtgccagggcaggaagggtactcccaaggctctctcctccggcccctgcatggtgtggcctgtgccagaggaactctgggacctagaggccactgttctcagtggttcccctctctgcacagccagacaggggcccaacatcctgagggtgacctgatctctctccgctttgcagggcagcccaggtattcgtggaccccaggggatcacaggcccgaaaggagcaacggtaggtgccagaggcctaggcccaccaggacagaggccagggcccagctgctttgtccaaacccccagaagagaagcctgggatgctagtctgaactctgcaactggtgggctggctccataacctcaggaaatgcctccctttctgtgcctcagtttcttcacctgtaaacaggggtgatgacatacgggaggtcatggggagcttgcagcagtcggggacaccaccctccacactagggaaggactgtgttccgtgaccctcatccccttcccacttcaactcccctcccccagttggccagtggggcttcctgggatgaccagagccactccctccctgcacactgcagctgtctcagaggaacaggggtgggtggccagaccccagacatctccgcattatcactctcccttgaactttcctcctgggtagggccccccaggcatcaacggcaaggatgggaccccaggcacgcctggcatgaaggtaggagtggggctgctgatgggactggggcaggggcaggaccttgagtcctggattctagacaccaagagcctggggycctcagrtcatggacatgccctttcttgcctctggatctcagtttccctacctgcatctgggtagaagccatggccctctggctggagctttaatttgtatctttggttatctgtctatcccagggcagtgcaggacaggcgggayrgcccggaagtccaggccaccagggcstagcggtaagtgtcaggtggagccacaggggctggccaggggctagtggctgatgaggttagaatccacacacacccggggctcttgctcaatcaccacctcttgccttgttaccaactctgtggcccctggcctggcgaaggcttcattacttggacaattactctagccttctctttggccattccagtcctccatgttggctaaatgggatctgaccatttctgcactatagcaccttccatggctccccaccgcctccaggaaaaagtcattcagtccagtccttcaataagtagttattgaggtcgggtgcagtggctcatgcctataatcccagcacttcaggaggctcagctgagtggatcacttgaggtcaggagttcaaaaccagcctggccaatgtggtgacaccccgtctctactaaaaatacaaaaattagctgggcgtggcggctcatgcctgtaatctcagctactcaggaggctgaggcaggagaattgcttgagcccaggaggcggaggttgcactgagccaagattacaccactgcactccagcctgggtaacagagcaagactccatctcaaaaaaaaaaaaaaaaaatagttattgagtatctraggtatactaagtggcaggtaaacaattataaataggacagatgcaatctttgtcttcatggctcatcttaccattcaatgaccaccataatctgaccccaacctgcccctcctgccatatcagcaatggcccctctctgtcctttcccttctcaacaggccttggcttttctgcctccacacctttaggcctttgctggtccctctgtttgaaatgccctttctggtctctttgtgccttcttatcgttcagggccatctccattccatacctcctggagtccagtccatgggagcctgccctccctccctgtgggggtactgagtggccaaacctgtttctgtgcacacatgcagacttgtgttcctgcgtgcactcacatgggctcaggcacctgagagcacatatccatctcttccacgtagaccccaggtcctggaagacaggccattctctgtgccccactcctctgccaycactgtgggaatgtacagttaagttcatsatgccgtggctggaccttctsttgttcagctcccacaggtgggggaaatctggattggggatgggaagcaaagcagcaggtgcatggggctccctcatgccagggcagaaactgacttcaacttctttctgcagggtgtgccaggccagcctgggacaaaaggaggccctggagaccaggtgaggcgatcccaagctggggacagaattgagcaaggaagtctggggccaggaagacagcaaggcccaggcctcagccaagtctcagaggctcagccagaacataagccccttgggcctaaccacctccctcctgccacctcccacccatcatgcactcctcagcctgcctcagtgcagataggatggcatggcttaaaatccagaggagaaacaaacaggaaaatcaggagccaagaggaytgaaccaagaataccctctyccccktcccagctcatctggttccaggctctgtttaggcttcgttgggtttccctgaggccaagggcctgactgggccacccagactgacctgagaactgttttcctgcagggtgagccrggcccgcagggccttcctggattctctggtccccctgggaaagaggtaaatgccccctgcactgacacaagggttcctgctttagggtgaggccatggggtggagccctaacctagggagagctccgagttagtctggctctgccctgacccaatgattcagggaagctctttctcctccctgggcctgtttccctatgtacattgcagggagggtggggactggctctgttctggagtgtgactttcctagatggccaagttgatgggctgggaatccaacaggcagagttgttcgttcatttattcattgcataaacattcactaaacacttgcaactatgagtctcctcttcatatggagggtatagtttaatggaagaaatagacatgaaataaatgatcaygccgggcgcggtggctcacgcctgtaatcccagcattttgggaggctgaggcgggtggatcacgaggtcaggagatccagaccgcggtgaaaccccgtytctactaaaaatacaaaaaattagcctggggcggtggcaggcacctgtagtcccagctactytggaggctgaggcaggagaatggcatgaacccgggaggcggagcttgcagtgagcggagatcgcgccactgcattccagcctgggtgacagagcaagactccctctcaaaaaaaaaaaaaaaaaaaaaaaagaaagaaagaaatgatcacatgataagtaattcaaattgtgttgggtcctttgaaagaaaactacagggacccaaaaccatggaacaggtggtctgggaaaccttccctgatgaagcaaattagctgagacccagggtagggaggggctggccaggtgtggaagggtgggttccaccaggtcaaacgcttagccccaatttctccttcctcyagggagagccagggcctcgaggagaaattggtccccagggcatcatgggacagaaggtaagtgccwggcacaatggcccctccccgggggcctctgyggcagctggcactgctggatacagcatctgctccgtgcagcccgtgagatgcctccccaggcagggcctaggtttgctttgctggtctgccaagtggagaaaggaccccctgccagtgacagcaggaatggagggcaccctgaccatgcggtgccaggcctcggtgcgggakgctacccctgctgagagctgctgaggttgtgaccttctctttccatttcagggtgaccaaggcgagaggggtccagtggggcaaccaggccctcagggaaggcaggtgagtgcaggccagctaaggtgggcagggcgtcatatccaggcccctcaytccatttattcctttggtttcttttctcctcagggccctaagggggagcagggcccccccggaattccaggrccccaaggcttgccaggcgtcaaaggagacaaggtgccagatggggctgggaaacacctgggaaaggggccctataacagggggagtggggtcggcaggactcagatccttccgragcctccaaacctgcggatctcagggttctggtctggtcggcgaggcggagttggaaagaggggtgtggccgaaagttaggwgggggaccccgtggaggggggagctcgccaaacccctcactgccygctttctccagggctccccagggaagaccgggccccgcggcaaagtggtgagttccagcacccckgttccyagcgacccccaaccctgctctgcgtccccgccgccaccgcgcgtytgacccgtggttctctctgcagggtgacccaggggtggccggcctccccggagagaaaggcgagaaggtgagcgcgcgrcctrgggaagggcggggagcggcggctggccccggggtccccgcggcttcgtgaccgctgctccttgtgcctgcagggcgagtccggcgagccggggcccaagggacaggtgagtcctcccctcccggcgttctccgactttcctgggcggccactcccttcctcgacccccaccccccactctcgcccacccgggcgccttctcacccggctctgctcccacccccatccccccgcagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggaggtgagtcgggccccggggtaggaggtgcttcttctaggtagatctgttctggggtgcggcttacccgccaaaggctagggattcccagagactcaccgacttccccgagactggttccaagccccagagcagacaggaaggctgtgagtgcagcctgagggattaccccgcgaccttcccaagtaagcccttggccctgcccaggtacaatctgttcctcagcttgggaattaatgactcaacaccagagtctcctccatggcggcctcacgctcagccaggtgggataggagcggtgggcccttgtagccaggggcttcttcctgaaaggcctctgctttcagggccgggatgccactgaccagcacatcgtggatgtggcgctgaagatgctgcaaggtgaggggcagcaacccctcctcacagtcagttcgagggcatcgccgccccctcaccccctcccggagcctccacrtgttcacttgtctgaaaatctggagtcctgggggctccttccagtccagtctctgaagggttttgggaccttgaataagtcactctgggcctttgacttccrcaaaacagagccyacggaaggtggtgcttttctgtctgcaaacctaggggccagggcccatcggaatgctctgcctcccctagtgttactgctgacacccatctcatagacttccctctccctccctccctccctccctccagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcrttcctggcatcgtgggagccgtgggtcagatcggcaacacggggcccaagggtgagtgctcctctgcrgtgggcatgggggccaggcagtgaggatttgtccaggccggccctttccccattcccttctcaggatgacatacagacccttccccggttcctcagccacatggtccaggagacactcctgggctctttcctagtagcaaacggatggcaatgaatgtactatgttatcactcggggtttctggggtttgtttttgaatgtgcttagtggtaccccataagcatctttccatgtcaatagagatggggcggcagaccagcagagcagtaaagcaggcaggctggagccacacacgggtgtgaatccagactcccctttctcatcgtggctctcagacgagttacctgctaatttccctgggccttaggtttacyatctgtaaaatggggacactgaaagtaccaacctcatcatgtggcagtgaggactatccttagagtagtttacatagagtttgtcttagttcactgagacacagtaaatgctagatattgttatgcttgctttcctgtaataaactttattggttacataatcttccatcctttgtctgcaccttcctttatttaacaagccctgcgtgaccatttccaactttcctctattacaaactagcacaaaacaggaataatttctttgcgtgaaacatagcaaaaaatagaggaaaagcattttccaattctgaaaaatgaagattyccttttttgtctacaggaaaacgtggagagaagggtgatccaggagaagtgggacgggggcaccccgggatgcctgggcccccagggatcccaggtaagccattggccctgcccagctgcagtgtgttcctcagcttgggaattaatgacgygtggacactgcggtctcctccatggcggcctcaygctcagccagctcagtccttgatacccagcttctgcacccctttggagcaccccggagtctctgggtggttccagctctggaagctgggcctctcaggacttcccaggatccaccaccatcacttcacagaggtgatggaagggatgtttgctcccaaagctcactgattgggagctgggggtaggggacaatcacagaatctctgcctctggggcagagtcctttctcctatggtgttttggcctcattttctccatctgaaaagtttccccaccttcaaaattctgggcctgagacaagaggtgcccctaatgtcttgactttctcctgttcacaggactccctggccggcctggccaggcaatcaacggcaaggatggagatcgagggtccccaggggctccaggagaggcaggtcgacctggcctgccaggccccgtggggctgccgggcttctgtgaacctgcygcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggacycaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcaccttyctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactaggatagaggagttgttgggcttctcttcttgtggatggggcagttgttgctgggcctccattgcccaggcaggaaggacagaggctctggagggggagggaaggatggggcgttttctctgggcacctgaattctgagcattaggatagcatggcagttttgaggaacatctgtgggaggaacctaggaatggaagcaggatgctgacctgctgtgtaactttgggtgaatcccttttgagcctttgtacaactgtggcaaggactcacctgtatcttgttcatgccagtatagcacacccagtgtctcgccggggtctgccacttggaaggtcctctgtgagtttcagcacccacggtgtgctggccctggggtaggagctggtagtgaaagattggaagaccttgttcttgccttccaggggtttccaggttcatgagaaaaacagatatggacttggatgaaaaaagtccgggagagactagctcagatctgatctgtaccacctgggggttcccagcccatagctctgtaggccttcaaggaggaagaggaggggaagggggggaaggggctgaggctcggggactccagcctgaagtccaagcatgtgcggaagcctagaccctcccaccttaccacaaacttggctccaagtcccctctatgctgacgcatccttgccctcctcctcctccccactgccctccactagcccatcctccctcctccctcctcccctcaacacacatttatcactagtgacatctcagccccccctaccccaatccagggacacaggagggacacagtggggttagactgagggccactgatgtggcttcaccctcagtgcttgggcarttcccaagttacagcatctcagtccccagagaaggccatgctgccactgtagccgccaagggccccctggagtgcagggcacagaggaggaagggagaggatgtgagctgcaggaggcagctgaagccaagccttgggcaggctctcaggtattacatacctggtggggaggagggttctcccttccctaggctggatccctcacttgctcctagtgcctggaaccttaggtttagagagccactctactccttgaagtctcttgatgcaccttacctggggccctttccttatccctctctgcagcattcccagagatggtccactggagggtttcagcaccacagagaggctgatgattcacaaatctcatgcagttacacctcattccttctgacagcaatttgaaggggctgaaagggggctaatccctaaggaccagtggttggtagcctacgtaagactccctggtgggtaaatttcactcagaccatttgctgtgatctacgaatctcctatatgcctttctaaactcaactctgtgcttagactctggtacattccactgcagccataccagcctatgctgtccctctaacacgtgtacaacacacaagccatgccctgtttggaatgttcttccccaaaatatcactgccagtgaccttgcttcaggtctttattcaaaaactgacctcatccttaccctgatattccagaataccattctgctttattatttgtcttccacacttagcactattcaacataaagcactagaatataagctccacgagggtggaaacttttgctcttatttgctgttctattctgcagcacatcaaacagtgcctggcacacagcaggtgctcaataaatatttattaaatgaatatgttcaggatgctcagaggaagatcccaccaatcatcaaaccaggaaggaagggatctggtctccacttgtgtgtggctgagatgtgttctgagatggcccagtgtccgagttttattccctcacctactgagaacagggacctgccctttgacagctgaatcttgggaggcaacagtctgatgcaaaaaaaaaaaaaaaaaaaaaaagtaggaactcaattcccctgtttacaattaggaaaagggggatttagaagcttaacagaaagggcattgcaccaagacagcccagcccctttgcaaaggttcaacaccacactgcacctctagaatgcagcctgtggggagagtcccacacctgctgctgctgactcttctttcaaacttcatctctctggcaatcctctcctcaccctgaaggccagctgggtcagaaacatttttttttttttttttttttgagacagagtctcactctgtcacccaggttggagtgcagtggcgtgatctcagctcgctgcaagctccacctcccaggttcaagtgattctcctgcctcagcctcccgagtagctgggactacaggcacccgccaccatgcccggctaatttttttgtatttttagtagagatggggtttcactgtgttagccaggatggtctcgatctcctgacctcatgatccacccgcctcagcctcccaaagtgctgggattacaggcttaagccactgcacccggcccagaaacattttaattttgtgcttatttacatcatagcaattagggtgaattattaatatcaccaacaagtatcaattgttgagctcttatattattagatactgtgctaagtgtctgcaaacattatctcatactatccctaccacagccctgtaaagtaggtattaccccatctgccatgttaaaaaataaaatctctgtctcaatcccacctgtagatactatcccaaatttttgctcccttttatggggagggttggtctcactttggcttttagctcaccacactgttctcagattcctgcgctgatttctcatgtctccagtatctgaaagtcacttgttccttggaccacatctttttctctggctcctctcatatctcattcagtttcatggctttaaactttatctatatatccccagtccagatctcgctgcttaacttgatccgtcgatccaactgcctactcaacatctccccttcgatgtctgatgggcatctcaaatttaacatgtccgaaacaattcctgatcttcccctccagaatcccccctcctgcgatctttcccatctcacccaagggcaactccatcctttcagttatttaagccaaatacactggagtcatcctccactcccactttatctcttagaccccacatctgatccatcagcacatcctgttggctcagtcttaaaaatatatccagaatccagccacttaccacctcctgactaccactccagtctagcaccattatttcttgcaagaaggattgcaagcctctcccaactagtcccctgcttcaacctttgctcctcaacatagaagccagagtggtcctattaaaacttcagatcatgtcactccttagcctaaaactctacaatggcttcctaccacactcaaggaaaagcctgaattcttacagtggcctacaaggccctgcaaaatctagcgtctgggatgctcttccctcagacacctccctagaacacctcactcttcatttccttcaggtcttggttcaaatgtgaccttcagtgatgcctttttgtgaccaccctatttaaaattgctggccaggcacggctcatgcctgtaatcccagaactttgggaggccaaggcgggtggatcacttgaggtcaggagttcgagaccagtctggccaacatgatgaaaccccatctctactaaaaacacaaaaactagccaggtgtggtggtggatgcctgtaatcccagctacttgggaggctgaggcaggagaatcgcttgaacccgggaggcagaggttgcagtaagccaagatcgtgccactgcactccagcctgggcgacagagtgcaactctatctcaaaaaaataaaagataataaaataaaattgcagctcctacccccacccaaacacctcagcccccgcctttttttccaaaacatgtatcaccatataaatacattttagttgtctttctccctgatactagaatgtaaactccaagacgtggcggatttttgtaccttttgtttaccatgtattccccatcacctagagcagcgcttggtagagtggggacagatggagaaatacagtctcggtcaagtttcttacccaaagtcttactagtaagtggcatgttggattatagagccccaggcttaatcctaatactttacctgttattgaccatcatccagagagccagaggggagctcggactcagccaagggcagagtaaggcaaatctgcttcctgagtattggcggtcccggcttcacaggtttttagaacacacagaggtatcttcctagctgtttctggtcaaactgtttaggaaatcctcctccctggaaatcatcctggataacagagaagagcccaagatttccttatccatattgtctaaatgggactatcccattccacaatggattatatttgccttcccacaaaactgaactcagcctggcacacatcgttcaagttacttgctcacatcactgtggtcttaaaatgtttctggataaaagttttggattacaaattatctgtaattttctttgttttgcccttaggatagaacgtaaggcccttaagtggtagttagctttctgctaatgatggcagaatactcaaaaccatcaaagatatagaaagtatataagaacatggccaggagtggtgactcacacctgtaatctcagcattttgggaggccagggcaggcagatcacaaggtcaggagcttgaggccagcctggctaacatggagtaaccccatctctactaaaaaatacaaaaatttgctgggcacggtggctcaccccataatcccagcactttgggagggcaaggtgggcggatcccctgaggtcaggagtttgagaccagcctggccaacatggagaaaccccgtctctattaaaaatacaaaaattagccaggtgtattggcccatgcctgtaatctcagttactcgggaggctgaagcaggagaatcacttgaacctgggaggcagaggtggcagtgagccaagatcatgccactacactcaatcctgggtgacagagagacagagagtcttaaaaaaaaagaaagaaaagaaaaaaatacaaaaattagccggatgtggtggctcacatgcctgtaatcccagctactcaagaggctgaagcaggagaatctcttgaacctgggtggtggaggttgcagtgagccgagatcgcaccattgcagtccagcctgggcaacatggtgaaaccccatctctactaaaaatacaaaaaattagccaggcgtggtggcgcaagcctgtaatcctagctacttgggaggctgaggcaggagaatcgcttgaacccaggaggcggaggttgcggtgagctgagatcggggcattgcactccagcctggacaacaagagagaaacttcttctcaaaaaaaacaaaaacaaaaaaagcaagtagaaggtttccacagggaggggaatatcacatgtaggatcaggggtaacagtgagcatataaaatataagggcaagcggggaccatcatttggtactaaaaccactgaactgatcctgggaattctcctatcctaaacagaggcagaatttacaagcagttctcagacctcagcaaagggccaactcagataaagccagtatatacacacaacagagattcaaccttagattcagagcttaactctgctggagttgtgccattttacccaaggctttgacctactcaattttgcccctgctgcacatccaccaggtctttcttagggtgcagagtgccatctattccttcgttggtgggcctatctactcttcccttgattggtcaatttcttaggaacctaccagtatccttttggccatccctatgcctctgccatccataaagtgtgggtgactaagtcagtcacatatttaaaagctaattactgccaccatatgtaaggaaaaccaaagaggcagctggagcagacca

SEQ ID NO: 12168 - DNA, 120897 bp, Homo sapiens
  misc_feature (1)...(120897): n = A,T,C or G, or insertion/deletion polymorphism (see Tables 1-2)
caaaagagtgtaacttacattctaatagcaaattaaagtcactgatggattccaaatagctctccattctttaggaatatagtaggtagtcattcaaaaaattaagggtgaagcagggcaagagtggcacaacaacctggctaaataaattaattctacactctgctagttaatttccttttccacatggcgatttgtatttacttcacaacttatatatggtaatatggcaaaagttcgattctagaataaaaagtaaacttagggtaggggaaggaggagttggtgatatggtttggctgtgtcctcacccaaatctcatcttgaattgtagttcccataatccccacatgttgtgggagggacctagtgggaggtaattgaatcacgggagtggatgtttttaccgtgctgtcctcatgacagtgaataagtctcaccagatctgatggttttataaagggcagttcccctgcacacgcactcttgcttgccaccaggtaagacatgcctttgttcctctttcaccttccaccatgattgtgaggcctccccagtcatatggaactgtgagtccattaaacctcttttcctttataaattacccagtcttgagtatttcttcatagcagtatgaaaatggactaatacagtcggtataactgtggaaacacctgggcacaatctcttgggatttccatcccttcttgggggcataaaacacccaaggacagctgggaggagtggtttcctctaaggcaaaatgtcacagatttatttactttattctattcattcacttcctctgctacttctcctgtttctttggctctgtattttccatgagtttagttacatcctaacttttggcaatctgctattacgataatatgacttcatttactcaaattatactctgcattgtcatctttactcagttagaattttaggaattttctcctaagcttgttcatgcaagcctttagcaggccacagctaaagggacatggcatgggataatttgacttcatgatgtgaacaagcctgtttacttgtgcttacatttttaaaataaaaaagaacctggtagaatccattgtcagagagagagagagagaaagggggaaggagagagagagagagagagggagagagagagagagagagagagagagagagagagagagaggaagaaagaaaatgagataatcagagtccttctggcttgtggctgacctgtatttttctctcactttaaaaaattcacttgactcatggctttaaacaccatctatatgcttatgacagccaggacctcttccctgaattccaaacttatgtttgactgtcaacttgtccatctgtacttgggatatctgatatatatgtcaaaacttgtccaaagctgacctcctgattcacacccacccccccacccccaaaactagtttttcctacagtcttcctcttctcagctaataggaactctccccctccagttgctctggctaaagaatatggagtcatccttaatttttacccttctcttgcaccaaacgttcaatccttcatgaaataaggttagcactagccgcaaatgtacccccgtttggccacttttcaatacctctactgccacctactggtctgagttgccaccacccccagggggaatattgtactagtctcctgactgttctccttcttccactcttgcccctgcagtctattctccactgagtggccagagtgattctttaaatgtaagtcacatcttagcacttctccagtctgaactcttcgcttgtcccccctgttctggtcccctaggactgtctctaacatcatcacatgattattctacttcatcttaccactcctgaaactggcatcttttctactcctccaatattctgagcaacatctgctccagggccattgcattggcagtatcctctgcttggcaaactgtcccagatatctgactggctcgtgtcctcatttccaggttctgcttctaatggcatcttcctaatagccctacgcagaccaccctgtttaatatcacagcctcaccctccacccagcactccaatctcccttactctgctctgtgttttctttcttctacaggactcatcaccttatagcataatacataatttaattatttattacctttattatttgtctctcctcactaaagagtaagaccacaagggctccaacagcttatctctgcagtttgaactttgttcatgggtatctcttctttggggacgtcactccattacctcctgcatgtattccttctggtgctaaaataatctgcttgtaagttgggatcagatgtgaattattcacacttactagaattgaagattaacatgtcacctctcctaagggtgcttgcatatcaaacctcaggttcagtgccggaacaaactgccctgtttttaatgaaaggaaatgggtgagtaggaggtggaggtagacacaaaaatgtttgttgtttccttttgttatcasccatgtcctgtcctgtcacccatgaaacctttacatagactgttggcattttgtcaatcttactcctgtttttctagtcggaggtaagtatttgtggtctacatggagttggcgaactatgagccccatgagtttttgtgaataaaatttattggaacacagccactattcctgccccacggcctttgcattgatggtatcctctacttggcaaactgtcaagtgttgtctatgtctgctttcagtctacaacggcagagttgaatagttgagacagagactgtatgctcacaaagtctcaaatacttactatctggccttcacagaaataaatcaccaactcatactctggaagcatcctgccagctttggaagtgatcttgcagcttggaatttagtttaacagctccattcaacagagagtcacttcatttactgtgtacaaggtgctagagttggaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttatcagggtaattgaggtaagtatcaggggaatcattcatctaaatttctccagtttcctggttcagagatgaattggcctttcaggcctgagagtattttgcttgtgatggattctagaaagttctgtggctcaaaggaaagggtcataagctatttttttttcggagaactgccaaaaacccaagggaaagatagagaaaaacacaattatgagtttcatgcaacagctgatcacatgtagcttcttggtcagagcactggtcgatggaacagaccgtgtctgtgcagaatgctctcatgagggtggatatgggagtcacatgtgctcatcttttctggatatctttggatgtctttaaccacccagtgtatttatggccttcgtaaactagcatttataaaataatcagtccttgacttggagccaattgatttcctgrgttcagtgagtctgagtctttataatatggaatatttcagagacatttgtcatctaatgaatagcagctacactgccctgaagggcaaattaacaaaatctacaagaaagaatttttgagttgatggcttgaagaagaaagaaacaaaaataaggaagtgtttcagatgtccatgtacttttttttttttttttttaatttttgagactgagtttcactcttgttgcccaggctggagtgcaatggcacgacctcggctcacggcaacctccgtctcctgggttcaagcaattctcctgcctcagtctcccgagtagctgggattagaggcatgcgcccccacgcctggctaattttgtacttttagtagagacagggtttctccattttggtcaggctggtctcgaactcccgacctcaggtgatctgcctgcctcggcctcccaaagtgctgggattacaggcgtgagccaccgcgcctggccccatgtacttctataatatgtatctttgaaaagaaattcaataagttttacagaggaggaaaatggaattcgtgaataaaaaagaaaagagtcaaggtacctaaataatgtggttgtctttaaagattataatggtgttatttggaatcatttagggaaggctttgttcattgtcatatcagcatgagttttctttatgcttcccaagattccaaaggtgatcaacagtccatctacacactcatatatttagccacctactccacatcttgatctggatgtcaatgacagtgtgaaaagtgctcaaagcttaatatacagggtcacatttctcatctcaaaacaggaccctgttacagtgaaacattatacgccctttgttcatttgtaagaattcttccctctctcacctttgtttctcctcattttaagtcttctaccttttcagacttgttcttttttcttttcttttcttttttctgcaggggcctgtaaatggaattcctgcattgctctaaccatgtacaaccttggacttagcttttacctgtaactggcttctgagagacaaagaggagaaacgttcactcctagtacacctattacagctgcagaggtagaggagacagttgcagaactagttacaatgacgataagaaacaatactttgttattccatagcacctttaatgttcatgtgtattatctcagctagccttgaactgcctaagtaaggtgatgaggacgggtttaagccccactgatattttaaaagcccagagaaaagtgttcgttcctctactaacctgttcttttagagcagggatctgcatactaggcctgcagccaaaatgagtaggtagcccactacctatttttgtatagccagagggctaagaatggtttttacattttaagtggttttacatttaagatcaaaagaaggataatatttcatgacaagtaaaaattatatgaactcaaaattgtatgaattttatgaatttatatttcagtattcataattaaagttttattgaactacagccacattcatttatttacatgttatctatggctgctttcttgctacaaaggcaaactggagaatgtacatggcctgcaaagtcaaagtatttactatctggtccttcacagacaaagttttccaaccttattttagagacaccactgtctttcctttctcaaaaccaggcaatgagccttctggtgtttagagaatagaaactgcagctatgcctgtaccactagttaataatcctagtaatcaactagatcccctcactggcttgtgccagctcctcattcttctggaaaaactctccaacgcctgcccactgtgttccaacaccatacaaactcttaaccaattatctccccactagagtgtgccttctcttcaggcaggaataaagacgtatggctgcccgtccccactcccgcactccttttctcgcaattctaactgacaaacagcaggcaacttatctatggaacaaacgattctgtagtgcttagaatgtgacaggctcatttaattctcatttcagcccgataaggctggcactattatcatcaccatcctcattttatagaggaggaaccagaggcacagagagactgagccacctgtcccaggtcatgtcaagtggtgcctcccagcggtggaggcagcactggaatccgtgccgccaagctccgccggctgggtgacagggagactacagttaaaaacagatttcccacaagaccgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggckactggacccacactctcttaacctgccctccctgcactcgctcccggcggctcttcgcgtcacccccgccgctaaggctccaggtgccgctaccgcagcgtgagtacctggggctcctgcaggggtccactaggtgagggaatgctggcggtcagtttgcaaaatcctgccttccccagctcactttagactcctaggggagataacaagagatacttaaattgtactacgaaatttggtgaaaatggtagacgrcttttctttctgcaaagcactgagatctaagtacctcatcagttgttcacatgcatacaatttaatcgtaggagtctggaagracccagacataatctagatggggataaagatactttctggttgcttcgatgtaggtgatgaccggcctgtactgctttgagtattaagctcgtttctgcgccttgcaacctatcacccaataaatatttatcgattactattcagggaggatacattttagggtaggccttgactaagtggagggtattgtggagtagagcccttctgaataacagcarctaacattctcatagcactaactgcacccctttgaggtaggcggtcttatcattccattttacagataaaactgagccacagaaaacctcaggtcacacagctgatatgtggtgaagctgagatgcaaacctaggctgtctggttccagagtctgctttttgccaaagcacctctcttcgtttcagtaggaatctttgaaggaattgggtatatttcacttgaagaaaagatttaagggattgggggtactgtctgcaaacacttgaagtggaatagggatagattatattccttctgggatagtccattagaacctagacctcccaaagaggaaaagactttcgaataacaaactctggctataggtaagtcctgaaatatgagatacattgccaagaacagctggtccatgacttgcctatgctctaggagacttcatgagtaagctgaaagatttcttgcccaaaatgttggccctgaacttcaggaatagatgggtctttgaattcaatgaccctcgaagatctcttttaatgccaagatcttcagcatgttctggtaagagttagggacctctttgtttttctccattttctctaaggcgccacacaaacctgcccccatctgtcagcctcattggtagcaactacctcatgggtgctaccagtgaggctgacagatgagtggcactggggaaggggtgggagatcgagagaattcagtgaagtaagaaagacaaagtgttcattggagatttttagtaaggggccaacagagctgctaaagtcatgcttcacttaacgatggggatatgttcggagaaatgcattgttaggtgattttgtcgttgtgcaagcatcttagagtacacttagacaaacctagctggtataacctaggtgtgtagtaggatatatggtatagcctattgttcctaggctacaaacccatacagcatgttcctgtactgaatactgaggcaactgcaacaccgtggtgagtatttgtgtatctaaacatacctaaacatagaaaagatacagtaaaaatatggcattatagtcttatgggactactgtcatacatacagtccatatattgttgactgtgtaatgttgacctgaatgtcattatgtggcaggcacatgactgtrtcgctaaccttygcacaagattactgtaggattacatgagatagttgtaaataattggtggggtactgggcacctagtaggtatgcatacatgttcaccatcattatggttgttttaaatcacctaacccaggccctgcacatagtaagacatcaacaaattgtagctgctactattttgcgcatctaatcttaatatcatttattttgtagtccttggatgttccctcctttatgacttcttttttttttgttgtccttcctttagccctccatcctctacagctcagcatcagaacactctctttttagactccgatatggggtcctccaagaaagttactctctcagtgctcagccgggagcagtcggaaggggttggagcgasggtccggagaagcattggcagacccgaggtatgctagttgggtggctgctccttgttttcttttcagaagggactggtgggatgttgatggtgattttgggaagagggggccaagatagtcgtgagctggcctgtggagtgcataagtgcaaactttaaagtttgcaattgggggcaaaccagccccagcccaaagggggtttctgtaatgtgaatacagaggycttgggcagaaagtgcagctgagcttcaggaaatgtctctgcttctctctgcacactggygtgccaccctgggctgacatgctatctgcctcagcatgcatatcgccaaacatgcccaccacacagcccctaartttatttgcccacacttcaaagcaccagggagtaactctgattctcaattccaaattcccaggagagagaatctgattggttgagcatagatcaggcctccactgctggccaatctgccgttgccaaggatttagattcactgagagactgctgggacccaactctgtagacgtctggtgagggacacgtgtagatgggtctagctctcagagaaggtgattatagattaggtagatgtctttcaactttagagaatgttttcatttgaatatgggaaatttgggatttgtgggggaaataagtcttatatgcacagaaaggtatcagatggtggtcatagcccagggaatacagcccctagcaccatatcagatccccaaaacattttctaatagaagaaatacattacagagatggattccattttgaaaagtgagactggtttgtccctcttaaactctactctgataattttcatgctactttgttgctcaacttaagctttaaaagggttactttctcaactttttaatctttgaaatgtatttatagggttttaaaaaactcctggccttcctcaatgagtgctgatctacatttttgatgggttcaatttttttagttatgttttaaattgacaaataaaaattgtatatatttatgatgtacaaaatgatgttttgataggtgtctatattgtgggayggctaaatcaagctaattaacatattcattacctcacatacttatttttttgtgatgagaacacttaaagtctctcttagccaatttygagtatacattgttattaactatagtcaccattttgtgcaatgaatctcttgaactcattcctcctgactgaaattttgcatcctttgaccaacatctctccttccatatcctcccatcccctagccggggtaaccaccattctactctttgcttctgtgagtttgatttttttagatttcgcatatgagtgagatcatgcagtaattgtctttctgtgcctggcttatttcacctagcgtaatgttgattggccactgaggcagaggaaaaactgtcaacacaactctccatcagccccatcaggccatttctctttccagttagcttcctgtttacacctgaatgtcttttgaggtccatcaaacagtgttttctgaaggatacctgcaaacaagattattctaatggctaaatgcacagggagtgttggggagatgcagatggagttggtatcatattctactaggctacatcaccaatagaacaattggaaagaattttggggccccaaacacacctgttactaagccactattatatattgagggtaactaacactttaattagcccatctgtcaggaacacatctgctgagaatttctttattgtttttgtcctgtgaatccctttggcagtttgatgaaacctatcaatttcttctgaaagcaatgttttaaaatacataaaataaaatacataggattactaaaataaaatatataggattaccaaggaaaacttttatactgaaacatggttaagaacaattttaaaaactatttcataatctggtaattttacattaaataacacgatttggtggcagttctagtaactgctgaatttcaaagctgtgaagaacacgaacaatatttcgatatatctactaacaactgtaatgtgatatgaaaataactttgatttcaattggtgacaaagtcacaggtactggtaatttactgtggtgcattgactacattcataattgaagaagttaaatttcagtctagagatgacggtaatggttgtacaatgtaaatatatttaatgccacaaaactgtactcttgaaatggttaaaatgctaaattttatgttatgtatattttaccacaataaaaaaaaaacaaaaaaattagtagaggttagtgacaatagagatataactttttagcagtccaagtttacaacccytctgagttctatcagtggtgccaggtaaaagtccatggctgataacttatgctttacagatccccatattttactgattcagatctcctgtaccccaggtatgactctaccctaaggaaaaataaatggataggaatcattcctaatcccatcagcctggtttaattactgttgagacaaagggtctttttgtttgtttccatataattgtatattttacatcatgggattatatagaacaaacaattttatgttccaatttttttcatttaacaatggtagcataaggacttcccatgttattataaattcttcataaacatcattttaatagttatgccatatcccatgtataagcattgcattattctcttactcgtgaatttttgaccatttagattgttgccatattatttttgcactctacatactaccaacttgccagaaaggtagactccctaaccctcccatcagcagagaatgaaagcatctgtctaacatcaagagattacttttctttctttttctttttctttcttttcttttttttttttttttttttttgagacggagtttcgctcttgttgcccaggctggagtgcaatggcatgatctcrgctcaccgcaacctccacctccctggttcaagtgattctcctgcctcagcctcccaagtccctgggattacaggcatgcgccaccacgcctggctaattttgtatttttagtagagacggggtttctccatgttggtcaggctggtctcaaactcccaacctcaggtgatccgcccacctcggcctcccaaagtgctgggattacaggctgagccactgcacccgaccaagaggttatttttcaaactctgcaccaaagcttctgtctctaaagaaatatctcataaactttggacccagagctattttagcatagtgtctacaacagcactcaatattcacagccgcaagtgttttgactcctttgactgcaaatgtggagatagaagaggaatatacaatgctctcactgagcctttctgtgatttaataacaaggaagagatggagtggggctggcccacacccttcatcacagttatacatgggccagcctagccagactggaatttgaatggctgagtagcataggtgctagggagtggttcctctgtgctcccagcaggagggaaatccactactaatctgcacttgcttctatgcccactcctgctaccagacactcctcggtgtaatgtgattctccatgggtcactcttatttttattttgttaatgaagaatttcaatcatcatagaaaagtagagaaatagtatgacgaatctccatgttccttgcatccacaatgatcaactcatggcagtcttatttcatccatattatcatccatttctcccctcaaagtattttgaagagaattccagccattattttatttcacttataaatatttcaatttgtatctctaaaagataacttgaaaaaaaaaactacaatctcattatcatacttacaaaaattttaaaaatcccttaatatcatcaaatagccttgactaatcttgttcttcactgatttagcctctgtagatgatgcttttcattatcaaggtctctagatattgaatcaaggaagtgggccatatagtcacagctcaagtccattcaaggctgtatctagatctcrgtctaggatatgtgctgcagtttccttctgccttctcattgttatccccaggttccagtctagaggccgagtaaayccagaaggtagcctgaggtgttggagtcaatcttgaggagcctgttccttcagctgctcccgtattgtcttgatgtaggctgacctagaatcacctgattcttggctactaccatagrcattattgcccttttatcagttaggattaggttcaactgtgtgtaacagaaagcatcatccaaaaccaatgatatacataagtgtttgtttctcttttgtaaagtgccaaaataggcactccagggtggccttccactcttatcagggacctgtgttcattctatcctaggtcataattcttagtacattcttagtgcatcgccttatagtccaagacagctgttagggaaatggcaaccatttaccctctggcaaagaaaggaggaagaggggaagggcaaaatgatactcatctkstgtccatcctcctcttataaggaattttcctaaaagttccaccctgcaacttctacgttgtagctagattcaatcatatgaacacaactagctacaagagatgccatggacctaaaacaagtaccactcagtatattatggagtaccttttatgtacacagaattattgtaagttcagtggagcatcataaaaaagcatagcatcggccccatcctcaaggaactattattcttgctagctacttccagtgcttcctgttgtaaataaaattccaggctttattatgggagtaccacatgcctgaggggtggtggccacaagttttgattgaccttctttttttttttttgagacagagtctcactctgtctccctcggctcactgcaacctctgcctcctgggttcaagcaattctcttgcctcagccaccacgcctagctaatttttgtatttttagtagagacagggtttcactatgttggccaggctggtctctaactcacagcctcaagggatccatctgcctcggcctcccaaagtgctgggattataggcatgagccaccacgcctggcctgattggccttaagagactaaaagaagtagattggaagctgccacttgaattcagcagctaaaggatttagaactatttgaatgaaaagaaattctcatgtggctcaaaaacgttaaaagattgtcaatttgatatgtagagagagaaagatgtgaatgagttggggacttagtgaaaacattttagaaaaatcagagttttgtaaattagatcttgtctaccgataacacatgtttattttacatgctattgaattcctgctaaatgtttagagaatgttaggaagtttgacgaggactaatacccagtactgcaaataacactttagtacaacagtctaatgcaagatattcttactttttggagggaaagtgtgtcttacacatatcaccaattttctggcaagataatcaattcatccttctgactcttacctcaatcagccccctagcttcttcagtctctttcttgtgctggctttcttcctatgtgtgttcatatttcatggattggtgaccagaaggatcaaatgggcaataaatatgacaaatagtactgatttggtctgaatctatgtgtcttccctactcctaattcctatcatgaaacctaacactcaatatgatggtattaggaggggaggcctctgggaggtattaggtcatgagggcagaaccctcaggaatgggattaatgcccttacaaatgagaccctggagagctagctggctccttccaccatgtgggacacagccagaaggcactgtgtctgaaccagaaagttggaccctcaccagacaccaaatttgttggtgccttaatcttggacttcttagtctccagaactgtgggaaatagatttcagttgtttataatccagccagtttatagtattatgttatagcaactcaaacagactaagacagaaaattggcactgaaattgggatcattcttccattgtcttgaacaataggtcctggtttctgttttgatggctgacaaggctccttattaaatggtgaaatggtcatttggccacacccttggtgttttctcctgaacatgtttctcattttttataatatgggtaggctgaaaatttcccaaatctttaagttctgcttctcttttgattaacaattctgcctttaaattatttctctcttcttgcattttactatatgccrtcaagaggaacccggtctctcaacgctttgtgtacaaatagcatcagctaaacatccaatttcattgcttacaggttctaccttccacaaaacactaggatatgaacacagttcagccaagttatttgccactttataacaagggtaatctttccttcagttttcaataacatgtttctgtctaagacttcatcagaatggcctttactgtccatatttctacaacaatctgttcaggattacttaggtattctttaagaagattgaggccgggcrcagtggctcatgcctgtaatcctaccactttgggaggctgaggtgggtggatcacttgagctcaggagtttgagactagcctgagcaacatggtgaaacctcrtctttacaaaaaatacaaaaattagctgggcatggtggctggcacctgtagtcccagctacttggggcactgaggcgggcgcattgcttgaggccaggaagcagaggttgcagtgagtcgagatcatgccatcgcactccaacacaggcaacagaatgagaccctgtctcaaaaaaaaaaaaaaaaaaaaaaaaaagaaaattgagactgtatctaccgctctcctcttttctttctgggccctcaccagagttgcttttaatagttcattcacagcaatgtaggcttttgctagcatgacttcaagacttccagcctctactctttaagtttaagcagttccaaggctacttccagttttaggtattcattacatcagtgctccaagttcttgataacaatgaataactactgttctgagggtggtggatggtgataagggtaggactaaaaagagagaacctcttggttttcacagtttgacagcagggcatatttgctcatataaaactcttcgatacaaagaaacaataagtatttctttatcttgtctttacccatattttaatagaaccacaacaacacagaatttaaaagttatcttagagcttcaaacactttgttttgtacctagggaagtgatggctgtgatatttataggactggtgcagtataatagataccacccatctatgtagaacctacagtgctttgggcactggaccaggtgtgctacattcattgttttcaatccttataatcttccaaggtatatattatcatgtgaggagaaagcaatgtataataaggtatgagaattctcaacctctcctyctaccaatcccagttctgttcctggacttttaataagctgatgtggaaaaatgaatgacaagactgaaaggaaacaaatttgcttggttgattttcactggaaagggcagagacttactagtggaagagaaaagagtaaatacagaaggtgagaggagaggagaaaaggaaagaggtgtcttcwgatggtttgaagtgatttgaagagttagagtgagagaaaatggaatcatgggagacagatatatacatggagaggggtaagagggattttaagcatatctttaaattgaagcctcttttggtgtttttgagaggattcaataaataatttgaatttattttcaattacttttaaatattggactggatgaaacaccaggttgagataggctacaaagtgccccagctttatatgggttgcagtccacattttcaaatgaagaaattgagaattggttaggttaaaaaacttgcagtagcttgttgaatttatatatatatgtataatgtatatgttatgtatatatgtgtgcatgtttttttcatagaaagttaaaataaagataaaaccggagaatgagaaagtttcatactttaatttctagtaatatgacagagtagacatcctgagataaataacttaaaattaattagctgagctgccaagaggttgctgaaactcttagagtataaaacaataagaaagaaagaaaaaatggaaaatctgaatagtttcatagccataatggtaatcgaatgaatactttaaaagtttataacaaagacagcaggaccagaagattttatagacaaattttacaaaatatttaaggtgtaagtaattctaataatgcacaaactctccaggggataaaatccaaggaagtgctcctcaaatcacttcatgaagctgacattaccttgctatcaggaccagacgaggacagccagtgaaagaataattacatcacatttatgagaatgtttgcaagaatcatagaaaattaaccaaccaaattcaacaatgtattaaaagataatatatcatgaccaaatttggattatctgaggagagcaaatttggtttaatgttagaaaatctatttgtgtattttattaacattaagaggttaaaggagaaaaaatcatataagtgtctcaatggtgtggagaagacattcgacaattcaacatccattcatgtttaaaaaacaacaactttgtaaactagaagtagaagggaaactctttaaccttatgaagggaatctataaaacacctgcattaaacaaccagattaccaataaaactttataaagcaatctatgtaaaatcagggagaagacaaggatgtctaccaccaccatttctactcaagactgttgtagagatgctcgcttgtaaaaatacaagaaaaagaaatggaaaatataacgattgaaaatgaaaaaaaaatcccttcttatttgctaatggttgttggtcgaaatgttactaccaaatattcattccttctctataataggattttacacccgcatccatttttaggtacattacccatgagacacatagggagcgattaagtgccctcctccctgactttgggcttggccatgtcacatgctttgaccaatgggatgtgttaatgtgattgtgaatggttgacttgccttgctttttgctcctgaccttggctatgagaacataatgccctccatagtggccgctgtttcagcttgaatcccagagtgagaagacatgtcaaggccagccaggcccataaaaacccagagaaattgcagtctgccacggctttaatccaatgcaagacaatttttttgtgtgtgaactattaagcaaaagtttattgataaatacactggtgatatgaacatctacaaagaaaacccaaaagaagctacagatgaatcattaaaattaataagagcttagcagggttcaaaaattgcctagcgcatgtctaatttccagcagcaaactgttcaaaatataatgtgtaaatgctgtttgcagtagaattccattaaaaatacaagttagctagaaaaataatttttaaaaatatgtaagacctttatggagagaattgcaaatccttattgaaatatgtttaaagacctaaataaatggggataaccatggttctattgaggaaacattgaggaaaactaaatattatataaatgtcagttcttcacaatttgatccatagattaaaactaattccaatcaaatgttcaaaatttttcttcatagaatttgataaatttcctaaaatttatataaaataacatggtcaagaataagcaagacaatcacaaacatatgttgatgacaaccagatatgtttctacctctcatttgagcttgagattgatctttagttgtctgctagcctttgcataatataatgtgcacttaatagttctatttatacagataacatttatatggatatatcaaattcagtatgacctaaaatgaagtcatcatagctatttcaaggcagcttcttctattatgttctttaagtgctgaatggccctaccatcttcccagataccatagttaaaaatttgggagtcagttaatgctcttcctttttgtctcataaatatctacccagtcactcaaccactctccatcactactgccattgccttagttctggcctttgcctttgctcagactatttgagataaccttctagatattctttgtttcctgtcttcctttaccacagagtgatccttctaaatctgatcatatcaaactctgatgaaaactcccatcaccttcaggataaaatccaaactcatttaggacttgtcctccatcgtctgcccatgtatctcataattccatatgcatcttttgccccaacagattagtatcccttagttcttcaagcatgccaagctgtttttctgcttttctacctggaatatctttccttctctttttctcccatctacttgattaactcaaccatgtacttcaagacagagattaagtgccatattcctgagttttctgaccttctttgatcccttcccactctcatatgtgtaaaattgtcttcctccaaagcatttatcatcttgttgcaataattgattttctagtctgttcccctgtaagattatgaatctgtttaggatacagaatacatcttgtttatacttgactatttatatcttagatgattatgaaatgtttgtccactctttgcgcttctcataaaatgacaactctctaacacaatccgtaaatccttgtgtgtgtgtgtgtattagtccattttcatgctgctgataaggacatacctgaaactgggcaatttacaaaagaaagaggtttaactggactcaaacagctccatgtggctggggaggcctcacattcatggtggaaggcaaggaggagcaagtcacatcttatatggatggcagcaggcaaaaaaaaagagtttgtgccgagaaactcccatttttaaaaccatcagatctcgtgagacccattcactatcacaagaacagcacaggaaagacctgtccccatgattcagtcatctcccactgagttgctcccacaacacacgggaattatgggagctacaagatgagatttgggtggggacacggagccaaaccatatcagtgtgtataagaagttcttcctgaaagcaattttcattgtaaaaagttgcccattggctatgtagttttcaatgaggcttgctagatctgttcataaatgtagcccctggtagtatggcttaaaagacatatctaatcwgcaaattttatttttatttcagttaaaaaatctggatccgtttttactgtttgatgaatttaaaggaggtagaccaggaggatttcctgatcatccacatcgaggttttgaaacagtaagtacaataatttgactgcagaagtgtgtattttgaaacatacctctttcttctaatagaaaattcaattttaaaagcaataaataataggctaaaaattcatttataagttgcaggctattttacataagatatactcaaatttaaatatttactgtttttagtattctttgaatttatgccaccaaaaacattcctatttgtgcagttaataagttggcttattaaaatatttttgtaattaaaataattcattggggatagaataaactatttgtgattaaaatacttttttatatagaaaacctgtttctaatcatgtcactacgctccattctgggcaacagagtgagaccttgtcttagaaaaaaaaaaaaagaaagaaaaaaacctgtttctatcttgtttctatccaagaatgttcagatgtgtgtaacctcctgtaatattataaactccaaaaaacaatctaagaactacaagagtatttatactaacttctaaggaattatagaatcaaggggcccaaatataacatagcctaaaaattaggattttaaggacatacatatacatttactagtttaattgcaaaatttagagattctactgaacacttaatattcagctttagttagatacagaaataaaatgtgtaacataatattgtggcactttcaaagattctcattgtccacacacatatattctgtggaagctcagggatcgttacttcctagttacaatgtttaaccatctactcaccagaacaacctgcattagtagggaagagaccagggcttgttaaaggctcagtgtgtttataaacccaattagtgaatgagtaaatatttattgaaggctggcgatatgcaggcgttggtgtagggtgatcttttgtatgttagggtgtgttgtgtgttgggaagtgtgagcagaaggcagagggagggaggctaaagaagggtgaggcatgatccctgcttgcctcatatgcagtctagttaaggaggttaaagatgtttgggaaagggcaccaccacagtgtaaagggataatgaaccaagaagtttctggaagtaggatcagggtagttggactcttttcccttcctcrtttagccattcgccttccagttcccttctctgctaacacgttgaaggcgctgtggcttgctttgcagcaataatggaagccattcctttcacctaccctacactcatactggattctgaccctgttcctggaagatgtctccactctgtgctcctgctcgagctacttcttgtgtgctccatcccatagctccacttaccaccttactaatccttcaaggtcttttcggatatcaccagctccatcaaattttgcagacaatcccaagaggatgcactttctccttcatttggtcctcatcgcattatatttttaccagtctcatgcacattatgcctttttgatgaccttgattgtattctatctgtcttgcattagaattggggattgcctcaacctcccctcacatacccaagaggatcataaattgcttcagctgagatcattctctgtgttctctrtgtggagatagtaactactggctgaatttaattggataataaaaagttgaagacaatgaatatattaaataaaatgaatgattaaatatattactttgatttccattatggaaaatgctttctkggggggggggaatactttataaattataaggtactcagctttaagcaactccctcaaggagtgcagctgtagaatattartgtttggctcttttaagaattttctttaaaactgtaactgtaattatttgtcagttcatttacttsctaaaattcatttgtaacccccaaatcagtacctgtggtgcttttgtagtaatttgtgggcatgtgtagagtggcaaaaaatttgagctgcccaatgcacacattcccagctgaggttgaatgaagcgatgctctttttttcttgtttcacaagaaagtgacctttcacagtgtatttagtgccactttgtccaccttttgtgctttgtgtgggtaatttcactgtttaaaatggctcccacacacaatacactaatgctgtctagtgttcctaagtgtaagaaggctgaaatgtgccttacggagaaaatatctgtcttagataaactttattcaggtatgagttgtaacactcttggcctagagttcaatgttaattaatcaacaatatttgttaaataaggtgtctttaaagagaaataaacataaaacaaagtcatgtattgatcaactgagcaaaatattgtgaccagaggcttgcaggaacacaatcctgtatttatcctaggagcaatggtctagtattctctaattcagtgatcatggcaactatatagaacattttttctataaaaatgatgagaatcaactgtatcagttttcctcaggagtgtaggtaagccagagactcaagtggtaagccattatctcttaatgtgagctttaaaaggctgaaatttaaagccagccccacttgtactctctcatcacctccctggagcattttctaaattatacaggcttgtacattttgaaaatgctgactaggataaagaacaaatttagaatcacctgtgatgttagctcaccatccagaaatagctattgtttttattttgatatattttcattcagtactttttttctggtaccacactatgttttgcatctttttgttagcttagtattatactataagcatttaaaaaatattatttaaaaaactaattttaatggcctcattaagcatctgccatgatggttgtaccaactgatatcaccacagtgatgtgttctgaaggttcctgttttccctcaacatcagcaacataaatgtatttattcgacttttctgacctttgccatttttacaagtgaaaaataatgctttatgatagttttaatttatatttctcttatttgagcgagattgattttgttttcattttaaaacattcattcaccatacatatttaatattcttggattttttttttcctgctgggttgctggtattctttttattattttatagaaggtcttcatatattaaggaagtcagatcattttcagtgataggaattgcaatagtgttaagagggattgggcttgttttgtatgccttcagaggtaaacttttgaatacaaagcatagatacaaaatagaaggaagaactttgtaacaattagttatgcaaagatagaataactaatataagcatgcactggaacaacataagcatgtactgaatggtcacatacttgatgtgttatcaggatcaaggtcctcaaaatagtgatgtgctggagctcccatttatttattttttaataaaaatgaaattttactaacacatgagtataaaatgtaactaatatacatattttgagtgcacactcacatttattttaactggtagtgatacatgatcaaagaaatgtggaaaatattattctataaaattctcattatctcaggtgtgacccatgaaccagcagtgttatcatttgtagcctcagtctccacttcagagctctggatcagaatctacatttctacatcatcaaatgattgatatacacattaaaatttgagaaatgctggtctagatcttccaaatcagaaatacgattctatgagataagtaagagagagaacccaattttactgggttaatggctaagccatttttaaacttaactcttaggtttgaatagctatatattttctattaaaaatttgcctgaaaattgagaaggcgtactctagggaagaggcacagctggtggtcacaacacaaaaggagaaatgcattcagtttttcctaccaggagtttgttttctggggaggattgtttttcaaaaggcctgagtggtaaaaggtgaaatacttctgcatttaccctgtttctggtcaggcctgatattgtgatttgtttagggcaacttcagttatcagaaacaaagaacaatcagagacatgggaaagtcccgctaaagtttagctcgaaaaaggaggtacttatagatcggactccgttgatgaacctctcacctaccttaggaagaaacatgtgttgtgccttttgaaatcatccttaaatgatagcctctggacttttcaggttttagcactgaaaggctcctgtccccaggaacctctcagtccttagcaaactgagatgactggtcactcctgtttaattaaacttaggaactattaggagaaaaccatcctgcctgcttttcagggacattttaggatggccttgtctactgtgttctcagttaggctgagaagtgtttttaaaattttttcactacaagcctcagcaagttctttgattttgttcacgagaacaaaaccaccctgtttccaagggtgtgtccatcagaaaagccacgctcataattacttgttggtagccgacagtgtttgcgtgcaatgcctgaacaatacccaggagaggaagggaaaggtcctggtgattcacacctaaaacttatgacccgattcaaacctcccacctcccacatagcctgttttttttttctagcttgctgtgcaccactttcaaaagcaaaccctaccatcaaggctgaaaaaaaaaacttgattaaattcaacatccattttggaaaaccgggaaaggatactttttcaatatcataaagactctctattgttcagggagcatcttttgttatatttaacactgagatattagctatattcctattaatatgagaaagaagacaagactgtctaccagtaccatcacagtttaatatggttctggaaactttgaagctattaataagtaagagttacagtgttggaaaggaggagaaaaattatttgtaggtaataaaataagaatgaaactcacagtggcttaatgtggctttggttgttgatatgactggaggagggaggaaggctcaggatttgtcctgaagttgtgattacagtgaagcacacaaatcttagcatatatattcatttggcatgatttgagagtgaaggtaacagatataagaaggaagctaaagccacctctactctcaagacaccccttggcaccactgtactaagaatgtcaaccaaaacctattagtaaatggctggatataaaataactatgaaaaatcaataattctcctgcttaaaagcaataatcagatgtaatggtggtgttaaagcaaactaaatatggcttgagaaggactctgtatttctatatttgagtccttgtggacgcaccataacctaaattaatagatagacaatattgaaaacctaacttagaagtatgtgcctgtaacaatagctgggtcttggctaatcccagcagccatacttcaaccactcatacactgctgagtgttcaaacaaggcaaacacttgtttgaaccagtccagctgtttctgtacctcacttctgatttctgtatgtcactttccttttgttgtctataaatttgttctgacmacgtggcatccctggagtctctctgaatctgctgtgattctggagactgccagatctgctaatcatttttttttcttggtccgttaaactctgttaaatttaatttgtccgaagttttcttttaacaggggaaagcatcgtattcataatggcagtaagaacccgatataattccctagaaaaaagttattctcctttaacccagtaaccctacttctatgactctatttatgggaaaaatccaaagtaagaagaaaggcttattaacaaatgtttattctggtacagtttttaaaaaataaaaaacagaggctgggcgcggtggctcacgcctgtaatcccagcactctgggaggccgaggcgggcggatcatgaggtcaggagttcgagaccagcctggccaacatggtgaaaccttgtctccactaaaaatacaaaaattagctgggtgtggtggcaggcgcctgtaatcccagttacttgggaagctgaggcaggagaatcgtttgaacctgggaggcggaggttgcagtgagccaagattgcgccattgcactccaccctgggcaacgagcaagactctgtctcaaaaatagataaataaataaataaataaaaataaaaaagtattcaaaatagtagaggaataattatatatctagaaattatctataagaaaattatatatttgaaagatggaatgttatgcagcattatctataaagacaaatattgtagccaatttaaatattcgtcaatcataaactgtttagattgttttttttaacctccacaactagtgactttttggatgcataattctttgctatgggggggctgttccacgcattgcaggatgtttagcaacgtccttggcctctacccactcggtgccaattgcatctgcctacacccagttgtgacaataaaaaaaagtctccagacattgtcaactgtcctctgggggtgtgagagagggcaaaatcacccctggctgagaaccagtactttaaatatatgtgtccaatagcatggcttaccatgcagtcattaaggagaatgacatggcttgataggtcctaatatagaacaatcttgatgatatttggaaagtgacagaggcaaggtgcacaattcttgtggcatagtgtagcatttatataaaaagcaaaaactatgccttttttcttttttaaatggcttattgccaagtttattgtggggaagatggattattataatgaatgattatttctacagactatcctgatgcaaataaaataaaattacaaaatacatgttatagtacccaaagaagatggtgtttaaagagaaaatgaacacatcataacaggtacaaatatgtatttacaaagctttttaaaaagtagtggtttatgtacttataggattrcacaaccatcactgctgattccagaacactttcatcagcccagaaagtaaacctgaactcattatcagtcttttctcattcttccttcctccagctcctaggaaccacactttctgtctctatttatttgtctattctgactattttatataaaaggaatcatatggtatgtggccttttgtggttggtctctttcacttagcataatgttttcaaggttcattcagtttgtagcatatatatttctttatatgcctgactaatattctattgtatcgtatggatattctattgtatggatagaccacattttgttatccggtcatccattggtggacacttgggttgtttccatttacacctttattcatagacttgcctggattatctctgaaaggatccccaagaaacttgtaatgtgacctctagggaaggttagcgggtgacaagggaaagttgtggacaagattattggttttcgctgaaccctttttttctctttgtacctttagaatgttcagttgtatttgttaattatttaagaaattcatgttttcaaaatttcttcttcgcataccagccattcagatatttaaagatgaactgtgccctcatggttagtgaaggtcctgatgatcacttgttctccaggaactcttgctgaggcctcctacttgggtttgccctctccagataaagtgaaccttacctgtgttctattcctgtcaaccagataagctaataatatatgccattgtgtaatggggatgaggactttctctagaaaacatctgtgcaccattagaggggcgcatgagatttaggagtgccttaaatcaaaagcataactttctcctccacaacacrttgcctagctgaaaggatattaaaatagtgagtgcactcatgagtttagaagtggaggcagaggactttcaaattgcatgaaagttagaaaataattaaggaggaacaagatgggtatagttgaagaagtttcatgttttgaggcagaagctrtcccttctaacagaaggatctgggagggcttcagggaaaatttgcccatttagtaaggccttaaccaataagtaagatttgactctctggatagtggaggtaaaggtgaaagtcgcggtatggggatatagtagaaacagtgagtcatctaatcgggcttacaaatgggatgtggaaggatgggaggtggaggagtattatagggtctaaaattttaggttgggccattattggggaaggcccaagcttcgaagcccaagcttgatctctagctatagatgaatgaacaatatttcacatcctgaaactgtcaacttaacacaatcacgttaaaataaaaccatctttagcctaaaagttctgctttttgtggagtgctgtctatgtcagtggttctcaactggaggtgatttgtccatctgggtcatatggcaatttctacatttgatcttagccaaaagcccaagaagtgactcatttgcaatttctgtagtcatttctgagtgtcacaactggggagtgctactgccatctagtgggtagaggccagggatgctgccaaacctcctacagtgcacaggccacttcccacagcaaagaattaaagcctcgtctgtgttaacaagcgtaggtcacatgagggagagtagaaatttaactgaaatattctttgaaagtagtccaaataaattcccaacaaatttccctatacatcctacccacaccacattgcaattacaaacaaaaaccattcatgtcttaaaggctacattccaagagtttttaagtagaaaaattgagtgttgggggggtggggggccggggtgcgctgggcgcggtggctcacgcctgtaatcccagcacttttggaggctaaggcaggtggatcacttgaggtcaggagttcaagaccagcctggccaacatggtgaaaccccgtctctactgaaaatacaaaaaattagctgggcgtggtggtgggcgcctgtaatcccagctactcgggaggctgaggcaggagattcgcttgaactcaggaggtggaggttgcagtgagctgagatcacaccattgcactccagcctgggcaacaagagtgaaactctgtctcaaaaaaaaaaaaaaaaaagaaagaaagaaagaaagaaagaaaaattgagtggggggaaatgtaataaagactataagccaatcattaaaacattattttatatcaccaaatataaaataaagcttttcaagtgaaacgagaaataagtccaaagtaaattaacatagatcattaaatgataaaaagcttcatgcaaattgtccacactattaacaaagctgcttcagagtcatccaatcaacagactcttagaatcacaggcctgactacacrggattaaacttgaaggaaatttgccatgcaacagtattaactactgatatatgagaagcttcatatgttgatacgttacctgtaagcctcaaaacaatcttgaaaagtaaaaattgttatctcccccattttacacatgaggaaactaaggttcagggaggcggtgacttgcgaagttcacacaggccatacagagcaagatttggtgggcccatatgatcccaggcccacatttgtccactcttttttgctaccactccttctggaacaaagttccctttctatatatctgatattttctcaatactttgacacattcagatgattaaaagatttttaataccattagaaatgagattgtgcaggtgacatagaccataaaactatgaataaacaccccatactccttctgccactcacttactgtgggacctatgctttcatggtccagggatctgaattttcctatctgtaagtccaaaatagtgctctcacttgtcctctgaacttccagtataatgaggaaatgggttaggttgattgtacctggctatttaaggacaatcatttaccttacttcttatagctgcaacactgttcatgatctagtagtaacatgataataaattcatgtttcagtcgcttataacttactacaacctaatttttccctctttctgtataccttttctccccaccctaccttaattttttcccccaaatttcttctttttaagacccacctgggaggattcctcctccacgaattactccctcattcctctggaatctttgtcacaatcaatctttcttctagatttgcttgtacttctctttagctttcatttctcttgtctgcatattttagtggtttatcttctgctagagtggtagctccctgaaggtatggaagcaatgaccactgtgttccttctaggtgattcctgacttcctgtttgtgagtttgtaatgacattttatcttgggtgggccagaacgaaagaaagaaaaagaaaggggagggaggaatgattagcaaagtagtgggccttttcctagagataaatttattttatttaaaagactgttctttattcagatattgctattcttcctttttttggttgttagaatggcctttcttttatgaaatgatgaccatagtagataatttttacctttcacaatctgaatttaaaagttggcaccmccacccaccattgaggagtattctataaaatacttcaccagtactcttcaaaattatcaagctcatgaaaaacaaggaaagagtgagaaactgtcacagatggaagaaaccaaggggacatgatgacatggatcctgaaccaaaaatggatattcatagaaaaactggtgaaagccacataagtgatatactttagttaatggcagtgtatcaacattggtttcttagtcttggcaaatgttctgaggttatataatatgttaatggcaggagaagctgggtggactctccatactatctttacaattgttatgtaaacttaaaaattattccaaaatttaacttttatttttaaaagactaaggaaggcaaaaaattggcatccctctctcagacccctttattttaaaatgttttattgcttcttgatgtccaaaatcctggggcctggggcccaataacatcaagttcaatgatcacactcactcaaagtttgagaaattaaatctacagtgaattgaatcagggaatcataataataacgtacccataaaaaggtgtcagctgcttaattaaatattgttataatgaaattttaacaaaatattaaaaggaaaatcgacatgagtctctgaaacctcttcctctgtaagacccctgtgagtcccaaacctgcccaagaccatatgtgcaaacaagtgttttcaggcacttcattcttaggcatctgccttaacaacttttaactggagactgtactaagcagaagaacttccctctatgccacaacatagctgatcccttaatgactagatggcagcctgccacagtgacacacagtctttaagcagagacgccatgcatgtgctacaagacatatttagtaatcagtggatctgttggcgagacataggtctggtttggtgaggtttgattttaggaaaagaatgagcacacataatttgtgtcagcagagggctctcttaagcaacaatagttccgactacccgtttatgtggaaatttgggtagtcatagaagttagcaaaccattcccttcaggccccttcagtataacatggaaattaaaacaatggaaatgaacatcttgagcacagttttgccagatgtaggtggtgccagttaagaagttgggctgctgattacatggcgacccaggcatagcttgtctgaagagattccccaaaacatttattcctgatctgggtttgaaggagaaggggcatgcctggtcctggggttctagaagcagctggaagtttctgagggagtttgtaattcagctcttttgagtagttaggtttgggaatatgattatcatagaaccttgatgtccatgtcagaaattttaatcagagtgaaagaaaaaaataggtttgggagacttgagaatgggaacaacgtaaaaaaataagagacaaataagtcagttgttcttttctttgtagttagatggtaggtagaactctttgatacccacaccaaagaaggatttcatgatcacctcatctcaggatcctgtagctttgggatcttccataaacctactcccttcactcagaaatcatgaggcctattttcagctttgtgtatattagcagtaggaccctttctttgcctgaaatagccagtttgcctgaagccattgaagttggcaaagtccccttgttacctgtgtgaaatccctgcagttctggctcctattgcaattgtcatgggatttctcctctgagacaagccctgtgctcccagcacatacgttactggcaatatgccgtcagcatttgtgaggcagcatgggggtgggggagtgaaagtagttttattctcagggacagataatgttgttttagatctttgttctgctattgttaactgtaaccttaatctcactaagccacgatgttttcatcagtaatatataggtgatcacatatttccaggatcagatgctttgtaaatgctgaaatgctatgcaaatataagatgctattcatccatccatccatcgattgattgatcaattcattcattcattgaacaaatcttcagtgccagctgtatgctaggcaccatagtagctaagttaaaaaagtccctgccttcatggggcttacattctcttaatgaagacagacaataaatgaataacaaataattacataatatagtgtcccatggtgaaaaagctaggaagaagaaacaaaccatggttggaggatacagaattgattgataaattagaccagatgggctggttggaggtggcctttcttaggcagtaacatttgaacagaggcctgagtgaagcgaggaggtgaactatgagactgttggagggggtagggggaactattccaggaagcgtgaatgaagatccacgaatgggatctctgcccacggagctgtggtggctgtgccaactctaggacttacccatcacctgttatgggccaggtgctttgcacacattactcacttagtccttaccactctcggagagctcacctcccaggtctatgctgtacatgaggagactgagcctccaagaagtgaagggacttcaccctgcataccaaacctggtaaatggcaaacctgaggtttgcaccagagccccaaagccggtgtagtttttggaggcagggccacacctgcagggggcagagtggcgggagtctctgaagcactggtgcttctgcagggtggtggcagggaaatgtaaggcaggacctggtagagctttaaaatactcggatttatccattggccgaatacctgaaccgtgttggttatcttttcctttttgttaaaaccaccttttggaacttgtgaaggtgcgtatgtggggttgggattgggtgagtcaatttagtcaattgggtgattttcccggtttctactcaagtcatgaaaacatttttgtaaaataacttgagtccttaattgtatggattcagacatccttgaagaccagttagcagcttctattatgcaatatgttccttgctggcatctctcatcagccatgacctcaactcgtgttttgttttgtttttctctttttcctaccaagccactagtagccaaaaaaaaaaaaaaaaaaaaaacagccaccattttaaagcaaatggaaattaaaggaaaacatagttttccctgtaatataaacattttgctttaaagaacaggtcttgcatcttattcccaaacactgaatgaggtactcagactctgccttctaaataccagccagaaagaaacaacaaactatattatctcttgcgttgtaattcttcagaattaatttatagctccttgaggtacacctttcctaaacttcacatggcaagtgacacttttctttcatcactattgtgtgttttgtctttctgcccccaaacacaaacacacaaggaaataagaactgacaaggaagcaaaaatatttagtaaagacccacggaaagaattagaaggaggaaaagaggaagcaggaccaagaagcacgtcaagtgctttaagaaaacacctgtttcagattacaaatttcttacttaattagacacatgcaactcttgagtttaaacataacactcacaattcgtcagccacccacggcarttctccaggtgtttgtgattatgtaatgccctaaaaaatcatctggattgtgtcaactctcagaagtactgcttcagttttttaaaaaatcctctacagacattaatttatatgtaaagtctcagtctagcatttacactacttagcaaaaaaacaaataaaaggttataataagtaaaaggtcagtggtttccttggtttctgatttttttttccccaaaggctgaaagtatgttttttgcttcaagtagtaaaagataggcattttgaattcaataaaacttcattgaccagacttctctaattcagattttatgatatttaggataggagcaacgaggtttaattgtataaccagggaaaggagcatccacactgcaaaagtagaggaaaggggggataactgtttcctgaatctttttaaaaaagtgttgaaattgcttcctaaaatcaaatttggaaaaaaaaatcttgatgtccacttagatttttcatccttaaatgagtcatactcaccacaatttactttttaaagttgcttgacatatttttagatggttagcaacctgaaagcccttaggcttggataattgaaaaatatttggggatggaaaagaatatgatttgaaagggactcctttgagagcccaaaagggagcttcagcccaaacagaatggagattgcctttctcatgcaattattttaattaaaaatgcatgtgcagcaggaaaagcaaagcaattctagacaccactccttatagtttggctgattgtttgaaatctggaagcttttgtttgtcctcttaaatttttaagctttgtattagatcctaaatgctttgttcctattctgacataagcgctctctataaaaaatgcaggtcttttccacacagtaacacatgttaaagtcggagctgcattgtcctacatgtaatatggagctactcttctgattcttagtgtttctccttgtgtctcactgcctttctatccagccccagttcacctaagcagggaacaagatattcatcagcgtctatgtaaaataaactatatcacttactttcatccactgattagcggcagcatctttcttttttccaaaacaaaaaagttgtttccattgtataaaagtcaattaattattacagaaaattcaaactgtcagaaaaatggaaagaaacatatctgaaattctactatctggagatgaccactgttcacattgtgatgtatgttcatccgggcacctccatgcatactaacacaactcgataattttatttaaatgagtccatttaaatacattgttttatttgtcccctttaaatagaattgctgttctgtaacctgcttttccaattaaataatatttcatttttttctgtgtcaataaataaagatctatatcactttttaacggttgcacagtattctcttatatggctacactgtaatttagttgcgttacttattaacctatcatccagaatgtccctgtcttttgctattgcagtaaatattgcagagaatggaattgtgcagaaaatcttgttttttttgtttccttagatttaaatctcagaagtatactatttgcatttaaatccttcatccatttggaacatgtttttgtatgtagtgggggattactgtcttttctcatatggtcatttgttctaacatcattcactgggaaatacatccttgccccactgatttgaaattgctactttcatatattaatttcccatacaaatgggtctcttctatccctgtgccagtgttgcattgttgccattaccatagcgagttcccagatgggggttttagacttcaaacctagaacctctaatttttgtagccatctgcctgtgacctgctggggtaaaggccctgcctaggctattctgttcacagtatacctcaatgatattattctgcaggatgaaacgtggagagtccttgtgtcagccagccctgatttgcactgtattatgtgctctataaatattttgattcaagaactggcatccaataaagttagctcaggaagaggagagtttattataaatctgcaatataaaaacgtcaacaacatgacagtagcaaggcttttattgcttttagtttaggtattaggaggcataataaataataacttgttctcccagcctgaattctcaaccaattgagaagataaaggagtaagaaagatggcagacaaaaatacctttatttctgataaagctgatactggagaaggtggcttatatctgcgggcaggtgggcttctgaatactgcacctgaaaataaggcagacttactcagatctcaccagctgtgctagacccctgtaggctaccaccacgggtgctagtccctctcacggagacaaagagaaagaggacacttgctttctgtggataggctgactctcaagaggagggagagaggagggggcttggctctgcaaactcaatttctactttcaactctaccagtcctacttactatatgtcttcctcatgagaatataagcttcatgaagacaattactgtatctgtcttctccacttttttatctcccaacacagtacctaggacattataggacttcagtgagtatttgttcaatgaatgttgttggtgcacttaccttctcaatatattattttaaaattattgtatcataggttttatatatttgaattgatatcttatgattatgtcctaaatatacaaatatgtagggcaaaataataaccattgctgtttatgatttttaaaacaaatttttgaattttcatgtgaaaaaagactatttaggtctactttttatgccttaggataaagcaaaaacatagacgacaaaaacaatctggctttgacttattcgatgagtgcttgtatagaggaggaaagaacaattttgtttgtgtaaaacagcaatatctgatgtatatgctgagaaattcataaatattttctcttctcttgcctcctgggcatttttttttctttcttctttatatcttacaatatttccactctgttttttattgtggatttagatatttcttgaaggagttaacagataaatttcccaaatgcatacaaaatggatgtcgaatccaaatagattacacaaaaagagcccatgtcctgacacacaacattttacgctttaagtgctaaattatatatttcaaataacaatgttgccgtgttcctgaggtaattttaaattcttactaattatttggtatcttttaatctttatttgctagagtaatcactatagccttaaaatgagaagtttagagttgcttgatttttccctttagtagaataatgaaataagaagggtttacttttcttctgctttttagagttgatgcaagtcttgttctaccaaaaggtactgtgattgcagaaagtcctgggaaggtttttctatctacacaaaatgcctaccatagttgactactgattttcaaattcattctatctaaacctgtgctatcaaagggaattttctgtaaagatggaaatgttctataatctgcactacccaatatgatagccattagccggatggggmttttgagcacccaaaatgtggcaggtgcacctgaggtgctgaattttaaattttatttaattttttttgtttttgttttatttatttatttatttttttgagatgaagtctcagtcttgttgcccaggctggagtgcaatggtgcgatctcggctcactgcaacctctgcctcccgagttgaagtgattctcctgcttcagcctccccagtagctgggattacaggcgcctgccaccacacccggctaatttttttgtagttttagtagagacagggtttcaccatgttggccaggctggtcttgaactcctgacctcaggcgatccgcccaccttggcctcccaaagtgctgggattacaggtgtgagccaccgcacccagccaattttatttaattttaattaatttaaacttaaatagctgcatgtcgctagtggctactctattgggcagcatagaatttctttccatttttagatttagtatggacatgtccctggaaaagttgacttattttctatgaattcatttaacatattttataaacatttattgagcacctagtgagtttgtgtgcttggtgtcagaaatatgtttcctttggatttcctgaggcagctttttggtggtgtggagacctcacatatgccatcccacacacctgtgtgaacaagccttggtaacagggaccctgctggttcaacaggagctgtctctctttcaccccaatctccagggcccaccatgccaggaccatcatctgctgggctgaaggkgtgagtggcggctcttttcactcagctgtgagctctggcaggctcagggatgcatctgctaggaggaaggggcacctaggtgagattctgtcaaagacattgtatggctaatgtggcccagtcacagagattctttatctcagtttactcctcttagttgctcctgacactttcctcaacaaattttctgtggaaaaagcaaacacgtcttcacagctacccaataacactttttctttttcctttttttcaagcttcattgaggtacagttggcaaataaaaattgtttatattcaaggtgtacaacgtgatgatttgatgtatgtatacattgtggaatgattaccacaatcaagctaaggtatccattacctcacatagttacctatttttgtggtgagagcacagaaggttactctcttaggaaattttaagtgtataatacttactattaattctagtcactatgctgtgctttaggtcttcagaacatattcatcttgtcactgcaagtttgtaccctttaatcaacatcttcccatgttccctacctcctgacccctggtagctacccttctactctgtttatgtgagatcatgcagtatttgtccctctgtgtctggcttatttcacttagcataatatcctccaggttcatccgtgttgctgaaaatggcaagatttacttattttttaaggcttaatagtactccattgtgtatatataccacattatctatttattggtcaacagatactctagttatttctatatcttggctattatgaatagtgctgcaatgaacatgggagtgtaaaataactctttgagatagtgattttattttgtttggatatatacccaggatgagattgctgtgttgtataggagttctatttttcatcttttgaagaacctccatattcttttccataatgcctatactaatttaccgttccaccagcaatgtataaggattcccttttctccacaccctcaccaacacttgttatcttttgactttttgctagtagctgtcctaacagatgtgagatgatatctcattgtagctttcatttgcatttttctgacaatgttgactaccttttcatatacctgttggccatttgtatgtcttccttgggaaagtgtctattcaagtcctttgcctattttttttttttttttaatgaaaaggcaactcacggaatgggagaaaatgtttgcaaaccatattatccaataagggattaagttccaaaatatacaaggaactcatacaagtcagtagggataattaaataataacccaatttaaaaataggcaaaggatctactttttttcctgtttgtttttcaaaggtatcctacctcctggaagggggcagcatggcccatgaagacttctgtggacacactggtaaaatgaacccaggagatttgcaggtatggccaaggacaaggaattgctggtggtttagtagtttttgggtgcacgtgcttgatcctgcccacttccagtacattcaccctttccacactctctctattatattcttgacttttccttttctacagattcttttactcagcctggaaaccacacaggtctcttatattcttctttcacactttccttgacccctcaatcactttttagctcccacctagtctttttcttacatttctcaaaagagtaatcaggaatgatatcccaacttccttatctttcattcgttttgtacttactgagatcagatttggcctctcagtagccccttccaaatctttactgaagctattcaggtaatggtcacttgtgatgtcccagttgccaaattcagtgattgtttcagtcctcatctttctagacctctctgctgcatttgagacaatgtattatttatcttccaactcatttgcagggttaggtgttatcacttaagacaatgacctcgagccctccatcatcctagtcttgtctgagatatgttacaattaaaatcccccaaaatacttgggtcatatttgccagttttgtaagtcgaaactctataccaggtactgtctgggattttatatgtatatgttttgaggaatgataaattcacatatttgaatcataatatttcaatgaaagtgaaatttaaagacaaaaaagcaaaagaaaaaagtcatggcaaaaagtcaatagtaacctctcactggagcagaacatgaaatgaagactgcttgcaaagatacatatgatgactggaaatgtcctgatcgtggaagtggtgacttctgccatctgcaccatggagctgcctagcagccatatgtgtgagacagtggtcaacacttcttctaccactataacttcacattgattaggatgatgattgcatagtgtctttcagtttattcagagtttttgtatgcatgatctctttgcgataagtagtattattattatctttttgagacagggcctcactctcttgctcaggctgtagtgcaatggtgcattcactattcactgcagcctcgacctccccagctcaagtgatccttccaccttagcttccctagtaggtgggaccacaggtgcacaacaccacacctggctaattttatttttttgtagagatggggtctcgttatgttgtccaggctggtctcaaactcctaggctcaagcgatccacccgccttggcctcccaaagtgcttgggttacaagcatgagccactgtgcccagcaaaaagaaccataatattattctcatctcatttttaaaaatgaggaaatggggatttaaagatgtttttaaaaacagatgcccatagcctcagagctagtaaatgatgaggatggaaagagaaccccattctccccttccagatccaatatataggccattttaggtaaagtattgccaaactagctcatatctaaaaaggataaccaaggtattgaaaatatgaagaaatgaactttaaagggaaaaggaaaatgcttaaaaatgggaggatgtctttgagggacaccaataactatcattagacagaagaaatgcagcataagagggtgtttaggtataccttatactgcattagagcagggtcaacaaattttttctataaagggcaaatgggctttggggaccatatggcctctgttgccactaccagactctgtcattgcagcatgaaagcagacatagacagtatgtcaatgaatgggcatggccgtgtgccaataaacttttacaaaaacaggtggcaggttagattgggcccccaggctgtagtttgccaactcctacattagaaggtttaacaasccttttcaaatgggagtagagggaaatctagacttcatggaagaaaaaaatctttaaagtatgcactggcctcctttcagatccttcaactaataatgctcattcttgtctcagattctttttcacatgctgttgtttctctgtggaatcctcttcctcttccccttcccctggctaattcttactccttgtttggatctcagcctgaagattgcaccctcagataagctgccttgaactgagcaggacacttcacgtgctcacagaaccctgtcattcttcgaagcrcaagcacaattataatggcaataatgatatgcatgacattgtttgtttaaggatttttctcctgatgagggctgtgtggaagatgctgttgatggcctgcctcatagccctttggcccaactgtgagttcaggtggtgatggtccccgtatgtgtacagtaccatctcaagtgctgttactctgtctgagggctttctccagccctcactgaccatatgtgggcagaccatatgtgtcagtgatttaacactcccatgggaactcttggtcagtgaaggatgggaattagagtctaaataccctagcttcccctcttctccatgcaacaatttcaaagtacatatatggttcccagtgggattgaattccagatgtccacagatataaccttctcattaacaactctttttggctttctcccttgcctcactcttccctactctctcacttgtgctttctgcatcactttccaaataaacaacctgcacatgtctttgtctcacaacttctgtgggagaactcaaactaagacaggtaggaaatgcatctatgatgttcataccttcatctccagattccaagatttagtctttggggctggtccctaatctgcttttaatacagacatgaacaaacacttgaagaatctgcataacagtggaggcaataattgtttctccaagtagcgagggttccattactggaactgagcaagtacagatacaagttaaccatccacagtatagtggatactggggacctccaaatgtatttgtaggcccacatatttatcctccaatgtctgggaacactggctgctgatggctcacaacggcttcccttcctaggaactgccctctgcagcagggaattgcctcacccaaagttgtgctttccacctggggatggcccacagtcaatggtttgctgatgtggggatataaaaacttggccacattgtctcaagtcgggacaattctgaaggttcatctcaactccagagctccctgttggattggctaaagcctctgtagtaactgcattgctggggagcttctccccctgcccaatcctgcttttttcactacttaagttgtatctcctgagaacacagcccagtatactatcttcctgcaactccccatcttagagcttaatctaagactcagggaagtcaaagagaggattcttccatttgtgggaattccagttccgatgtgttgatttcaagtgaggaagcacaggaagcatttgcaaaactggaaagggccccagcaattgtcactgatgtttattattcccctcgatgcccaggggctctgatagcagcactggtaagatgtctcacttagtgatggtgttgtaattgttccacctatagacttattaggagcttggttacatttccctcttgttggttttgtgtttgcagtggatgactgcgggccggggcattctgcacgctgagatgccttkctcagaggagccagcccatggcctacaactgtgggttaatttgaggagctcagagaagatggtggagcytcagtaccaggaactgaaaagtgaagaaatccctaaacccagtaaggatggtgtgacagttgctgtcatttctggagaagccctgggaataaaggtaagccaggctattgtgtctatttaacctgaggcatgcagtgacataaggctggccccttctggattgttagctctcactaggtttaccaaaattcatgtcccatgggatggacttgattcatagttgtcagaataagtgcaacctaagaaaactcagaaatttttcctgcctacaaacccatagagttaggaaaattacaagaaagcaagctcatataaagtttggtcgaggagcaattttcaaagtatgtcttaatatgtgtgctgatttagcctaattcctttcacttatagtgcaattttatgctttaaattatagctccttagtacagcaggattgctacctttaagaaacaaacaaccaaaaagcaagactaaactccacttcacaaagatttatgtaaattacttatgtccaacttagtaatgtaaggaaagcacactactacattgcagaaagtttatttttaaattttaacttgacaatttgtccaacccatacacgacatgccctgtacattcttttcaactgggactttatattatttggatttatagtctcacctttttgattaaataagtcaatttaggctaaagattatggacatatttgtgggaggaaaggggtgcggcaaatgccatgttaattgcacaccagaactgctcctggggagmataagattcctcacaccaaccaatctgaggtagtgtgttttcttaggtggggtttcccagaagcagaccctgagatgaagattcccatccaagagatttttaagtaagcgttcctaggagaacagtaaaaggaatcaggacaaattaggggaggaagtgaagcaaggctgccatctcaggcagagtcctaaagagggtggctttaccttgatcctgcaagggactttgaaagatcaacgtgcctcagagatgtccgagcccatccctggcaagggagccgggctttcatgctcccttacccaatggtcattggttatggccattaactttgaagtggaggcacagaaatggttaaaagggatctgaggggatctgggagaagcyttgacatcgggtactacacatggaacctggcattgagtgcatcaagatagtgggagttactctgccattctcccagtgcacaaccagcacttaaaactatctaaaactaacttctgtaaattttaattttttgatgtgtaccatcagggataatggcttggcagtggctactaaccaaccactcaatgggatgcatgggatggttaacagattggtcatggttattggttgggacttaccagtttttgtatttcctgaactataaccaaagttttaccgtttttatttttgtttttttgttttttttttttttacctgtaccctgcctaggtatatgattttgttttgtgtttctagtgcaaacaaaagtaattgaacaacaacgacaaaaaaatcaaagttcacaaagttaagcatacctgactgctgtccacacccctggcagacctattgcttactttgccattggaaaagaccctttgttgtgtttctgtgactcgtttctgttttgccaagcattggtcagtgagtgcccttttcagctgtttgtgaagagtttctttcccttgagctctgcagaagagggttaagatcctgtgaggacttcctggtgtagcagcaaaagatattgttcagtatagtatcaggcagagcggtctaaagggagctgaattaatacagatatgaagctgctcactccatctcacatggtattttccttccctgtttccaggactctgaggttttagggacatgcctttaggggatagtgagatggatagtagagggcaagaagcccccttctgcttcaaccaaagcagaagactttgcccgatttcatatattgtgattgtccataagatttgatttagaaaaagagttgaactgttggcagttcaaaagagaaatcagaccagtgatttagttgattagcaaagccagtgatatcacgaatccttagagtttacaactacttctcatttatagaaatcataaggcaatttaaagttggagccagtaaagcactttcaagcagcagaccatgtggtcttgtaatcacagccaaggataagaaaccagaggtaatgttttaactttgtaaaataatgtcttagtacctgccagcttctgttatttatttttgttgaataaaatctctgaagtgaattatattctcctaagtaaatgaccagtctttcttacgagtgaattttaataataacgcttcttggaaccatgggcagcattaatttagatttcaagaggcagygtggtgcagtggttacctgcatggactctggagatagaatgcctgggttagaatccttaccatgaaatagctgtgtggccttgggcaagccagttactttctctggacctcagtgtctcatctattaaataggactttttgtgaagattaagtgactttttatacattaaactctcagaatagtgccagacacattgtaagcatcacataagtggcagttattattttgattaatttacggtaacttgaacaggagctgggctgagatttatgtctgccatctaagctaaagggatttgctgtgatttgggaagggttattaacctgcactcaagaaaggacaccagtaagagtcattttaaagatagggagcaactggtgatttcgttgtgggtctcataagaaacatagttttgcacatctgaagccttaatatctgattaacaaggaatgactgggtcttaaaaggtctagacctaccataaaaagaaactgaagattgtttcgcatcaggaagacaattttaggttaaattacaaggtgaggctgagaatatatatttcaagagattagtgtatttataaccaatacagagtcaacaayaacttccatctctgcaactaaaatacctagaaaatggaattagcaataattccagcacttcttcaactttaatattcatgtgaattacctgagggtcttgataaaatgcagactctgattcagcacatctgagatggggtctaagagtctacatttctaacaggctcccaggtgatgccaatactgtggtctggggaccactctttggaacatgcataatgggtatgggatccaagacacaggagtttacccatcttgagaaatcatttgattaagctcctatagaagatgtcaaatgatctagtactgtgaattttggcaaatcttatttagcttttctggacctcagtcccgacatccacaaaaaaggtgaggggggttttgaataagatactgtcgcttttatgagcaacaaaactgcctttttgatactaccaagggtagctgtatkcctgtttcccaggttgtatgtgtctgagcatttattcaacccttggaaagccaagacagaacaagattctgccaggacagcatggtctaaagtgaaggctgaacagggagaaaaggttaaaatgggatagtttgaatagttcctgtcacttttggaaggtcaaaatcacatgtttatttcatgaaagtatgaaattctccaaaccccattccatccttatcagacaactaatcagcaatattattgccagctctctttggaacacagttctttttccaaaaacacgcctctacttgcctcctgctgctctaaattctgttgtcagaagcaaaccttgaggaggcctcagccccactggggttagagaaaggcaatctggagccagatggccttggttcaaggccagctcaccactgactcactctgaagaagtcacttaagattgctgtgcctcagtgttctcatctgtaaaatggagaagattataatgacccagctcagagggttgctgggaggattaggttggctattacttgtaaagtacttagaacaggtgcagagtaagccctctgcaagtggttgctattttcacttccatacaaaatctttgggcagttttcatgtggcctacaaatgtaaccaaaagaatctttcttctgatggacagtctgtatattcatgtgttggatgataaccaaactttaaaaaatttaattttcaaaaatgcctgctaaacatctcatgtaattcactcagatcataccactgtgcacttagcaccggaaacaatgcctgagagataacagatgatcaataaatattttcaaatgagtaaatgaaatcattaaaatatacatggatgctggaataagagaaatgaaggtaaagtagtaagaagatagacaatatagggattaagaatgagtgaaataagcttaaaatgagcttactaaaaagttaagagaacaataaaattagctaaattatatgttaaaataaaataaactatttaagggactaggaagtaaggaaataaaagccagattgatcttttttttttttctttaaatgtgaactcttttgcaggacccaaattgttcttgcaggtttcttcaagcagtgacaataatggtaaacaaaggttcagaggcttgtggttccccttggaagtccacaggcaggtgtcttcttatctgctttagcttcttccatgtggcttttcagggcatggcttgagctccagaatagtggatatacttatcagctttctaggcatttcttgtggatatctcccctcccttgccggtttagctgtacaagcattggaagaccccatgtccctcgggcaattctttcctagtcaacgagcaacctgcccactaattggcctgtgttggttgtgggttgacaagtaatttataatcaagcctgtaataatcccctgtgatttggagagctgatggagtctcctggccactgtgcaagccactgtgtgtgcaagccactggtgcacacacacgatttttcctgtaccagaactagagagaaatagctgcccacattttccaggttttgctttcatccaagagacttttaggggctggatgttatttgaaacactttatcaccaaaatgcaattttgtcagtattccttctaccttaacttgattaaaaatatattttatgtggcttttaggggaatacttttatagcacatgcaaacggcagtgggttttgggcaatcagaatactggaaggtaaacttaaaacatttttgcatcttagtaaactcagaacattttcaggggaaatttgacttctttgattatattgggcacatttaaggagctcctccctcacctgccttcctgcatttgcttccgtccactgtgtgatgtggagagagctggactcttcccacaggaggctgctcttttcttctcaagctcaggagaacaatattttgaagtagcattaaaaaaaaactattaaatcatggaaacaggtaacatatacgcgcacactttttttgcctttgaaatattccagcaagttcatggatctagctaaaaaaaaagaaaaataacagatactctcctaatggcagagagtgtgagaggggcactgggtttctgacatagggagcttgagtaaacaggctccagctgtcccagagagcaagcaaaggaaaaacaacacttgcttgggaaggaattctcccttccaaagacctctcttttaatttattgtatttataaatcagagcgctctgtgatagatttaaaaactggatatttaacaaatgttccctttggggtgagggtagcagggataaggatggacctgaaacttccctcagtatgtcttttaatttttacttttgaaagatagaaatgcttacatatttaaaatatcaagttaaaccagaaaagaaaaaagaaacaagtcttaaaatcaaaaacaaatagaaacaagtgaagaatctaaaattggtataaagatattggcaacataaccacacagagaaaacatttatttgaagggcttttaaacatgatgtcctggctgtatattttagtgggatatattctaaagacaaaaagaacagcaaaaaatattttaaactttactccatagtctttgttgttagtgttggttttataatttcataacaagttaatgtgtattatgaaataaaacaaattagtaaatttgttaatgtttatagaaatcaagattttcagtataagaaaaatggatacaaatataaaagagctaagaaaaatactgtaatattcaatgttaaattcaacattaaatagacattttaaaacattggatggccattatttctttgaggcagtttctggaaacaatatgattttatcattttaggagtccaagatttttgatgatgcaatttatgtttctttctgataacaactccattctccactgattatttccattgatttttttatggttcatgtttaattcaatgctatgagaagtgctttaaaaagttccacctaagaaattcacaatcaccctaatgaattctggtgaaattccccttttaagacattctataactgtattttaatggatagatagggggagaaagtaaaggaaatatccgcatgaatcagagagcttcctggtctctttttgacaccgggcaagggaggaagcagagcattttagggagaaagaattctgcaaaatactgtagaaaaaaaggagttgaggatttccccatcttyatctccttgcttctatgcaccaaggtccaacccaggtcccctctctttggtgcagccttctcagctgtcctggccgacaagcatctcaacttctgcccagattcacacagccattctgtcttcataactcatgagatttttgggcggacggcatttaatttacatgtcccatttccccttaattcctattaggcacctgctgtgtgtacatcatgcagttccctggagatacaatgtgaataagatacaaccactgtcctcaaaaatgctcacagtctagcttgggagagaaaccggcaaacagcagaagtataatgtgacacaggaaatacgaaaacagcagtatgtgaaaatctcatgatactccagaatagggagaatcaattctgcttgtgtggatggagcaagggaaagaaagattgggcagggatcacgtcttgtaatggcttgtataaagacttggatagtaagagtgcagtaactatttaggcatcctgatgcaggctgcataggcaaccagatacttgtggagttatggcagggcaagaggaaggaaatgatgcaaaatatggggatggagaaaaacccaagtttgtctacctctggattttgcctaaggccaacgtttgttgtatgcatattcttgcatccttctctcacaaggttttaaatagtagggcatgaggttaaggtgcagtggcctccccagcatgctatatgcagtccatctcatctcaggtttcatgaagcagttcattctacgggacgtgcctgctacaggccatgtagcctgagcagatgatcagcaacattccacagacaagtgcaaaacttggcttggattcactgttgagaataggcacaattaggtctgctagtcttgtttagtaaataggaagacaccaaagaaatgtacccagcaacttcaaagaacttgtcttgtggtaggcagccatagttggcacttcatttgcagttaggaatgtgcaaataaacagtggtcaggatctgctcaaatcagctggacaaaagcttcctcttgcccagggcagcccactcaccccagaaataccattcttggtgtgcacaaagggtgccagatgttcttattcattcaagatgtccctgctgacctaatccctaagaagtacattycagtcgtggcgacaagccctctccttccagtgaatgaagaatggataggtgcacttttaaaccagaagtaacaccctgtgccattcatactttgttggccctagtgatcaggattgtaacttagcagggaaatttagactaagagcataataaaagctattaaaaaaacccaaggtgtcaacttcaataaaggttagtggtcactttagcatattattgtaatcacttctatggccatcaagacttgtccttttaggatatagtatgtcttttcccaggaacacattacatattttttctaaccacagaaaaaaatgcaggacagcttcagagagctgtcttgagactcttgcatgttgcattaaaagctgagctcttatggatatgaataaagtggatgtcagtattttaaaaactggtatcagcagccgggcgtggtggctcacgcctgtaatcccagcactttgggaggccgaggcggccggatcacgaggtcaggagatcaagaccatcctggctaacatggtgaaaccccgtctctactaaaaatacaaaaacaaaattagccaggagtggtggtgggtgcctgtagtcccagctactcaggaggctgaggcaggagaatggtgtgaacccgcgaggcggagcttgcagtgagccgagatcatgccactgcactccagcctgggccctgggcgacagagtgagactccatctcacaaaaaaaaaaccaaaaaaccaaacaaacaaacaaaaaaacaactggtatcagcatatataaagctatgctgttgatagctgcaaacacagtacttcattttgaccaaagcagaaatccttgggatcatgtagcttttgaataatttgatcaaactcacactcaaatgtgttgagcaaattcgggttcagataaaattctgattactggaagcattagaagtttatagtatgtaaattatatctcaataaatctgttttgaaaaggaattctactcctgtggacaggtatatgtactccaagatagccaagtatttagacatttcaactcaaatgagctctaaatcattgatagtaacgattaaaggaacagcatgttctgtcataaaaatcacagggaatcatttttkgccatccattgcagatccgggggctgttcagtattcctttggcttagtaaaatgagatgagttcagcaaacatttactgagggccagctgcatgcaagaccctatagaggtatgaggggaaaaggtgaaaaaatcagggggctggatggatgcagttgaagggaaagacatatcaactgatagcatgagtatactgtggtgagtcagcacgctagaaatcatggcaggctaatgggaaagcagaggaggaggctcagtccaatctggaggtccaagaaaacaggcctaagtctaaaggagaaaactgacctggtgaagaagggtggaatgtctagatcaagcttattcaactcgcggcccaggacaactttgaatatggcccaacgcaaatttatatactttcttaaaacattgtgagatttttgtttgygattttttttttctttgagctcatcagctatcattaatgttagtgtattttatgtgtggcccaagacaattcttcttccagtgtggcccagggaatccattttggccacccctggtctagatggtgcagaaggagacagcatgagtagaggtgtttctgcacagagaaacagtgttcagtggtataaaccaatgctttaagaaggccttcaaaacacacgttcattttctaaagtatgaaaattggaaaagttcttatctttcttatgtaaaatttggtaatttgtgtgtttctctctcttagtttttttaaacttttcaaatttattctcttttgtttttagaaatatcttgaataggccgggtgtggtggctcacgcctgtaatcccagcattttgggaggccgaggcgggtggatcacgaggtcaagagatagagaccgtcctggctaacatggtgaaaccccgtctctactaaaaatgcaaaaaattagccaggcgtggtggtgggtgcctgtagtcccagctactcgggaggctgaggcaggagaatggcgtgaacccgggaggcggagcttgcagtgagccgagatcgcgccacwgcactycagcctgggcgacagagcgagactccgtctcaaaaaaaaaaaaaaaaaaaaaaaaaaagaaatatcttgaatatacagatgacgtttcacctgggctagtttctcatctgtattctttaccttttacctccctccctgagccaacaaaactcaagcacaatgctctcacgatgccatctaatggagtcttttgtattaatatggctgttatgtttggaatacaatatggactgattaagatctggctcctccaggtttgttgagaaataaaacaatgacartttacctctttttcgtaaaaccttaaagcccccttgctctctttgttttattttttaattattattatactttaagttgtggggtacatgtgcacaacgtgcaggtttgttacataggcatacatgtgccatgttggtttgctgcacccatcaacgcgtcgtttacattgggtatttctcctaatgctatccctcccccagaaccccaccccccgactggcccgggtgtgtgatgttcaccgccctgtgtccaagtgttctcattgttcaagatgatcgtttttaacattatggaaggaaaccatgatggtcataatttttctaccctagatcaactataaatagcaattagagaaatttaaatgcctcttttttaaaggaagccattttgatgtccagaacaaggctcttctgtcccactgccttcagtcacctgcctctgattaattttcttctcatctctgggctctaagaacaatactggcttccccacccaacctcccacccccacgtgttattctctagttacaaagaagcgatacacaggacagagggagagctgggcagtgaaaaggaggaagaaaacccgacactgtttctgcaccatcttggttcctttaacattgatttttgggcctttccaccctgtctccaccaaacagatttcttgtaaactgctccctgcctctgtttcattaggttttctgccaattgagtcccccagccagattcttttcctcagcagcctccactcctggctgtggcagctctgcttgtcaggagtcagtacccacctgtttttgtctgccttgggagactttgagtgtctctaggtaactaccaagacttggctggtggattttcccagcatcagatatggatttgaggccatctgttacatgtcagtccaaaagaagttttgagcaagagttctggtgactgtcattaagtgtttttgtaggttttaactgacaaagtctgtcagccaaacaaaagcagacccgtttattgaagagggcctaaaattcagtggaagtcaaatgtagggagttgaggttgagaagaccaaaaagaacacaggcataccccagagatattgtgggttcagttccagatcactgtaataaagggaatattgcaataaagcgaatcacacatttttttgcttcctagtgcatataaaagttatgtttacactattttgtagtctgttaagtatgcaatagcattatatctaaaaaagtacatgccttaatttaaaaatacttttgttgaaaaatgctaatgatcatctgaacctccagcgcgtcctaatgtttctgctgatggagaatcttgtctcagtgttgatgggtgctgactgattagagtggtggttgctgaaggttggggtggctgtggcagtttcttaaaatcagacaacgatgttgtttgctgcactgattgactcttcctttcacgaaatatttctctgtagcgtgtaatgctgttcgattatattttacccacagtggaacttctttcaaaattggagtcagtactctccaaccctgccactgctttatcaactgagtttatgtgatattttaaaacttttattgtcatttccacaatgtttacagcatcttcaccaggagactccctctcaagaaactactttctttgctctttgataagaatcatctcctcatctaatgaagttttgtcatgagcttgtagcaattcagtcacatcttcaggctccacttctaattctagttctcttgctattcccaccatatttgcagtgacttcctccgctgaagtcttgaacccctttaaagtcacccattagtgttggaatcaacttctaccaaactcctattaatgttgatattttgatcccctcccaggaatcacaaatgttctcaatggcatctagagcagtgaatcctttccagaaggttttcagcttactttgcccagatccattagaggaatcaccatctatggcagctatagccttatgaaatttataattataattattatgcttgtaattaataaaataattaattgatgatgattaatatcaattaaattattgaatattaattgttaatatgaattataataaagagtaattttgactttcaagtctgaaataataagacttgaaagttgaaattactccttgattcatgggctgctaagtggatgttgtgttagcaggcccattaatcttgcacatctccatcagagctcttggttgaccaaatgcattgtcaatgagcagtaatatttttaaaggaatatttttttttctgaatagtagggctcaataatagacttaaatattcagcaaaccatgctgtacacagaatagctttcattcaggttttgttcttccatttctagaacacaagtagtgtagatttagcataattcttaagggccctaggatttttacaatggtaaatgaacactggcttcaacttaaagtcaccagctgcattaacccctaacgagagagagtcagcctgttctttraagctttgaagacaagcatcgacttctctctagctatgaaagtcatagatggaatcttttttcaatataaggctgtttcatctacattgaaaatctgttgtttagtgtagccaccttcatcagtgatcttagctggatcttctggataacttactgcagcttctccatcagcacttgctactttaccttctacttttatgttatggagatgtcttctttccttaaacctcaataaccaacctctgctagcttccaacttttcttctgcagtttcctcacctctctcagccttcacagaagtgaagagagttaaggtcttgctctggattggactttggcttaagggaatgttgtgggtagtttgatcttccatccagaccactcaaactttctccatatcagcaattaggctgttttgctttcttatcatctgtgtgttcgctggagtagcacttttaatttccttcagaaacttttcccttgcattcccaacttggctaactggtgcaagaggcctagctcttggcctrtctcggcttttgacatgccttcctcactaagcttaatcatttctagctttttgtttaaagtgagagacatatgactctttctttctcctgaacacatcgaggccattgtggggttgttaattggtctcatttcaatattgtgtctcagaacagggagacccaaggagagggagagagatggagaacggccagttaggggagcagtcagaacacacatttatcagttaagttcgatgtgtcttatgtcggcacagttttgtggtgcatcaaaacaatttcaatagtaacatcaaagatcacagataatagatatagtgataatgaaaacgtgataatgaaatatggcaagaattaccaaaatgtgacattgagatgtgaggtgagcacatgctgttggaaaaatgacacccatagatttgctcaacatagggttaccacaaaccttcaatttgtaaaaaaaaaaaaaatacatatatttacaaagcacaataaaggaagtgtgataaaacaaggtatgcctgtacgtctttctttccttcccaagttccgaacgaattgagagggagactgaggagttggccagatagggatccaaatatcatctttcttaccagtaaaatctagataaaagcacacgacttatatctgagacctgttgggcttcttaatacttccccggcttcattaaccacgtccaggcagaggtgtacctacagtcacaggcatcttcttcagaggcaggcttacctcttgacagaagaagagagaaagagaaagaaaaagagctcagaagggcctgagctgagcatactcagtcccttgaattactcttaccagctggatcccacctcctgcctccccctcatcctcagggattagtgagaaaggcagagagcagctggcagtattgcctcatggggatattagggaggggtctggakgctccttcgaacattccctgattttttttctattaacatattagagtcggacgcttagccatgactgcctcctcaaggaaagagatgagaaatttatcagtgtggaccccctcacataaaaactaacttctgttctctaggatcaattttacccccagaatgatgtgaaatgtatatggagagttttttgttaaattcacaccaaggcatatctgtcttctagactgcacatttcattttatctaaatattaaaatatcacaaatttgaacataaacctctcctatcatcaaacttytaagacaaaagtaaagttctgatctaaaaccccttgcccttataaatcacattaaaataaactagaattaaaattgcattctaaataagatgccaaagcatctttatccaattttaaccctgctttgcttgggtagaataaggattttcttttttctttctgagcatcgtagcctgagttgcctcccctggactggatgtggctccattaggtctgccaaacttgaatccattcaacctcaattctcattcatttcactttaaaaatagtcccaaaaggtaataaaagacacatttatcacaataccggttttggttccatgaaattttattgcacaagcaaatctccaagccctagagcagtcatatctgtagaaaattgatgtacttgctcagttcagagcattaacatagttgggagaacaaaaccgtgtatccataccgtctccactctcttggggggagacatttctcctttgtgtaaagttctatgcttgtgttggtggtaactccaggcaccagatcttaagaaaatcctgtactcaactatggaaagctgataagaatatgaagaaatgttcctctcaccaatatgcagaaamatagaaatttgaataatatgctgccacttgacacccttcaaattaagaaaaaatacaaagttgggtactgtgaagtgctggcaaggatgggaagaaatggaaacttcatgtttggcaagtgggtgtaactgtgttcattgtggagagcaagttgacattatccaatgaagctaacactgaatatagggtatgccccagaaacttcattcctagtatttattccatcaaaacttcaccaagcagacatatgacagtggtcatcccagcatcgtgagtaatagaaaggagtcagagttgatataggtgttcaccactgagagaatgaataagtgaaatatggtggttacatatgatggaatatggtgtagccgccagaagcagtgggctgtattcacttgtagttattagctctcaggaaaaaaatgaggaataaatcagaaaagaaagcagtttagcacacaatactactcatttttcaaggacacccatatatctaaataaatacactgtgggtagattggaaggatgtccattacatatgctcaactgagagccaatggggaatggtcttgagatgggggatgatggaggaaaataacacaaagcaagaggggtgcccatggatgtatgatgaccctgtgccatggaatatagtgtacagccaattcaattccatgaacccagggccagagagacagagagagagagagagagaaatttgtgtctaacaccagcttttaacttggttggtgtaggtgacctcctgtgtggctgatttaagggattctaaaaagcccaacatatgacagaaaatctcactgtcatgttattaaaactgtaccattagagtccatccttcaacagtatgagggactgaaaggagcataggctgtggagtcaagcacacctgggttcaaatctcagctctgaccttgggaaatttgttttgagcttttatttcctcatctgccaagtggggatgataatacacagtccttgaggtttttgtagggtatttaatgtgcctagcaacatagagggtacttaataaatatttctttccttttcccttatctatcttttcttttcccacattcccttttatcattagtctttactgacagcaaatctctagaaattcttgggatgggaaatgaaagtggccaacatcttttatgggcttatgaggtgctaagttctaagtcagagttgtctaataaaaatataatggaagcaacatgtaacttcaaatttcatagtaaacatttaaaaagtaaaataaaacaggtaagattaattttaatagcatatttaatccaatatatccaaaatattatcattgcaacatgtaaccaatataaaattgtaatgagatagttcacactttttgttaccgagtctttgaaatccagtgtgtattttacacttgcagcacatctgtgcagactggccacatttcacatacccaatagccacatgcagtgagtggcaactgtattggacagtgaagttctgagttctttatatgtgtcaattcttttaattctgatttaacttgggttctctggaaaacaaagcccaaggcaagtattatttgcaatcccagggcagtgggagtgaaggagaagggaagtgagacagattcttggccatgtaggatgcctgttcaggaagctgtacctcagaactttctaagggagcaagaatttgtctgttgccccacatcttccattcctctttggtcaaagtttgcccatggggagctaattccctgcccttctggtttgtgtcacccggtccctgcagacagcctctgaataggccacatgtcccattctatggcttggatctgtatccaagtgtgggcatgaagagaggatccagagcctccgtaggtcacttaggtcaagcccagactctggagcttctggaactcccaccactgagaggacaatcaagacgatgtcagaacttgacagtcggctaggacaggccaaggcatctggcgatgtcaacagttgcaacaatgatggcacctacaggtctccataagaggccaagggctgaggagctataatgaggctgagcgactctgaggaggcatgtaaaatgtgtgcaattgaattctcacaatgagatagggaactgaaacatagtgaggttagcaacttgcctagggttacacatatagtaagtgacagaactgggattctaactggatggtctggctccagggtctgtgctcttaatcacatgctcacataggtccttcaccagtttggcacagcccagtagaaatcagattttttgttgagagaaggttttgtcttggaaacttttaaagactgaaaaggcttaagaggagagatacatgttgaagcgttcaaaaggaaaaccttggcccatctgtcattttgccaaggatctgaccactccctatttgcacaggaattcatgaatgatccctgacctgaattggggatatatactgatcccttgcatagtgctccagcctttcagcagatctggtcaattcttcaatttttctgagctggtgctgaatagcagggaactacttctcctcttgtttgtggatacacaggaggccatattcaatacttttaggacctatttgaatactgtatttagatgggttgatgtggtaaatttggggattggggagttgatcaaggaagagacagtttcatgagaagcagtaacatacaaactttatttgggcagtgctcagacaaggttgcgtaagagggaaagttcttcatagctggagattttccagagacagtggcacaaggccacccctcagaaaggaaatagggcaagagacctgaaggagtaggggaaatcagagaggaggcttacatgtccaggtgatatcactcaacagcaaggtgaggtttctctggattagagagttctgaaggacattagcagtttgaggtcttatagctggctagcagatgctggtaatagtttatcttatttctggctagcagatgttgggaatagtttcacagtctatatgaagtaggtaggctctaaatggctaaaattttgttcattttggaatatatttaaagcaatttggtgtgcgaaaattggagtttggcatcagtgttctttgggctaatggtcctatcctagtgtaaggaagtaaccaacatgggggccattttcacctaatatacaggggctctctctggcccatttatataatagttgtacagaaaactttcaattcattcattcattcagctcttccattgccataatggtgtattaatatatgaacaaagttcttagggcaacacgaatctagaattcctgatagaatgagatgcttttcaaagccaaccaccacttactgttccattttcttctggtactttcatttgaatcagaatgtcaggcagcaatggaccccaaagataagctctccaactccaccactttgtaaatgagaargctgaaacccaactaggcaaaaagtctttcccaaggtcacacagctcattgtgaaagaagaccagacccaaactcaggtttcctgaattttgtcccattttatttgaacatttcccctgccttatcacaccattcagccctgatgcataagtttgctgagtgtatctctctccagttagggaatgccttagctcattttcatggaaggaagcttcaaaatgaccatgtctctttctacaccaaaagggtaccttcaggcacatgcctgtacaagcagacacccctgcctgtctgtgtcagaacatcctgcaaatgatcacgtagaagaagccctagaccataataaattcccccttcattaattttaatcataaaattgaagaaacatatctatatgaaagtatccatacccagagctctatgaaatctttgccaatgagtttcccgtgttacatcttgatgcactttcctacaagaactcttaaaaatattttagtaaatagcaaatgtaactaataaatattagaagccttgtgaggaatattctagcattggttaatagatttgctgactcagtcttggaacacattacccatggattggagttaacaaataggaaggctctgtgttagcctatttgggggccatttgtggttttattatactgttgcctttatagggttgtagatggattatttatataagacatgggaatttgttctttttctggttttaattttccaagaaattagaacatctgtaacccaaattcaggcaaggatgctgactcaaagggtgaagaaatcaaagtccagtttcacaattaacatgtctctggttaaatttcagtactgtgagtccccgtcatcatctttattctcttcccctttagtccttctttcctcactactcttcccataaataaaaggtgagaaagagaaggacaagagtattactactgattaaagggctacttgaaaaagaatactatagactgaatttggctatgtttaaaattcttggtcagctagacagcttgatgttcaagactgtccacagtcttttatggttgatagaagttaaaaatgtttttttggccctctctaactcccaccctacaaagagtcattggcattttgcctaagagttccttgtcttctctttgtgtaacacttcatgtatatgtcaaaatatgattacagagttttaatccttcccacgatacctttggcactggggatggaaactaatctttcccattgcttatcagaattgtttaaaacaatcaagaattcagaattcaaagtgctttggattggatacagaagacatcattttgttgaagagcatcagcctattctaaaaatgagttagaagtttgctttaaacagtatggtaaatctacttttcacttcctcaaagccttaccatctccaggagaaatgagaaagtatggctccccatgcaggggcaatgggatctggcagtgagtctcctgagtgtgtatggtagtgcagagactaggtctgtgctgatgcatttttatccccagtgcaaagcccaacagatcacgagagtgggaaggtggtagaaggaagatgaggacattgggaagccataagaactgtactagatgatgacatgagctcctcatggagtagatcttactctattagttgggactcctgagctagtaaattaagtgaacacttggttttccccattgaggctcttccttgtaagtggtagaaggagaacctacctgaactagacccaaatatatatgcaaacttaacagggataaagaagattatcatcaattgaggaaaagaagaataagtcaactgggacaattggttaaccatttaataaaaagaaaccagattagagctcatgatctcacagttaattgtcaaaataattccacatagattaaataattttctttctttctttctcttttctttctttctttcttcttttcttttctttcttttcttttctttctctttttctttttttgacagagtctcactggaatgcagtgatgcaatgtcagtccactgcaatctccacctcccaggttcaaatgattctcctgcctcagcctcccaagtagctgggattacaggcgcccgccactacgcttggctaatttttgtgtttttagtagagacrgggtttcatcatgttggccaggctggtctcgaactcctgacctcaagagatctgcctgcttcagcctccccaaatgctgggattacaggcctgagccactgtacccggccatagattaaataatttaatgttaaacattttgaactagaaaaatatacacaaacatttatatgatctttggatggggaaagactttccaggtttaaaagcattggaaggaaaagatgaatagattagacccatgtcagaaaccttgtaaatgaaattaaaggccaaaaacaaactgggagataataaccttactttattgaaaaaaaaaaaaaacaaacctctcatgtaaattgatgagaagcaccaaacgtccttgacttcatagccgccaattttccattccctctcacagtcacacatcactgaagatgtgtctgcacatttcatctccactgtcctacctccttgatgttctcaacttgacatccacccacactggtccattgaaaccagtcaccactgacttccatgtggccaaaccagaggtggtaatctccttctccttctccctctccctctccctctccctgtctttcttctccttctccttcttcctcctcctccttcctcctcctttttcgttcctactcctcctttctcctccttcttttttctcctcctccttctttctccttccccctcctttttctcgttcctccttcttctttctccttccttctccttctatctccttcttctttctcctctttcttctttctcctcctccttcttctttctccttcctcctccttcttctatctccttcttcttctttctcctcctccttcttctttctccttccttctcctccttcttctttctcctccttcttctttctccttcctcctcctccttctttctcctccctcctcctccttctttctcctccctcctcctcctttctccttcctcctccttctttctccttcctcctcctccttctttctccttcctcctccttctttctccttcctcctccttcttctttctccttcctcctcctccttctttctccttcctcctcctccttctttctccttcctcctcctccttctttctccttcctcctcctccttctttctccttcctcctcctccttctttctccttcctcctcctccttctttctccttcctcctcctccttctttctccttcctcctcctccttctttctccttcctcctcctccttctttctccttcctcctcctccttctttctccttcctcttcttcctccttctttctccttyctcctccttctttctccttcctcctctctttctccttcctcctcctcatttctttctytctctctctttctttctttctttctttctttcctcctcctcctccttcttcttcctcttcctcttctgcttctccttctccttctccttcttcttctttctttggttccttcttcatgtcagctcttcctctccatggcttgattgctttgtccttctccacagcctctctttctttggtttctgagataatacattcttgtgtctctggttgctctttgctccttctcagtttcctttctccaggtgacaccgttttcttggccagacccttaaacactttagttccctggatctcagtcctgagtcttctctttcattgagcatctgcctaagtgagcttatttatttcatggatttagataccatgtatagtctgacaactcccagattgatattcacagtacaagcctcccctttgagctctatgtagattcatatctgccactgccaacttgacatctccatttgcatggtgcccaggcacgtcaaatttaaaatagcaaaagttgaagtcttgttctccccaccctcacctgtcttgacagcaaacaacttgtttctcttccagtcttctccatcttaataaatggcattatcactcactgctcaaagtagaaacatgatggccatccttatacccactgcatctagtccctcagcaaaaacctttctatctccaaatatattatttcaaatctacctatttctctcccatccctctctggcctactccagcatcctcttcaggagtctcctctcctctattcttactcccttccagttctttatatagtagcttaagacatctctttaagatgaaaattggatctggttcttcttcaatgtgttctcattgtattttaaagaaatcctaaatgccatactatggcctatatctgattgaatctttcctaactttctaaacttatgtcattcgctccagcaaccactttatgtctgccatgttgctctcctctcagtttctgaatacttcaagctctttatggcttcatggccttcacacatgctattctcttttttctgcccagaaatctcttaccctcaactcttcttattcaagtcttcactttaatgtaatctccctagtgaggacttcccttactctcctcattttattttctctctctgcatcctatttatttcttttytagcaagtaccacattttaaagttttatatttaatttgctaaattatcttcttcactagaaagtaatacttcacaagggttgagcagaactgttattcagcaatatatatccaatgactagcacattatagattcttaaccaatattttttgaatgaggaaattaattgataaatgaatgaaaagttaaataggttaatgagcagatagtttactgaaagagaaatgcaagtggccttaattaatacatacgatgcccctaaaatagtgcctggtacatactaagccctcaacatatttagttattgctatttttatattaataatagttactattattttaaaattaataataataatatcacccaaactaatagtcaaatttaaagagtaaggagataccaatttctgctttttaaatgaactacaatgaaaaaaaataagatgatcaacattttgatgagatgggcactttttaaaggtagttaccaagtgatttgacaaaaccaatttggatgaaagcaagttagttagtataacaagtgatcagatgatgatttgttcaagaacagatactgctagatgtgggttgttgagataatggtatttatactgtggaggtggtgcctttaaacttttttcttcagattaagcttgtttccttactttttgtccattttccaaaggttttcggggggggggtggttattttttaacttttaccttttttcagcaattaatttttccattctatgtttgtgacaaggaaaaaaaatgtgcaacaataggagatctgttggaatatgttaactttctaacaataggagactggatggggaaaaaacaatttagagcacataaagagttgaaaggctgccctgtggtgtagcaaaattaccaagactaggaaaagcagtgactagcagtagagattttcagcaaaattgctgtttaaccagatgattatgttgaacaatttgcttttggccacaatgtcttaacctttacatctataatttcactgtgaaggaaaaaaatagaaatgtaatcaaagatttatgtgcaaagagattcgtcgaaagttaacaatgacacacaaaaaccccataaaacacaatgtccaatattagaggagttgtccaaaatggggggtgtgtgtctaggaacaagtagaaacactgtttctttctcttataggatattggggattggcactcattaatatggttacttagagtaatttccttaagcaacatattatagtaagattgacaatttgagtgcatttcctgagaaataactaaatcataaagagcttttgaaatagttcccccaaagaactgtgaatgcatttattacattcacaatttattacattcacaaagcattatgacactacattgctgccacttgcttttagggagagtcaaagatggtggtaaaaacagcagcatttgggaatcaatgggcagcagttatctgtcaaaggagcaatggcaaaattcaagatacttcctttgccacactcatacatagcaacgtagcatgctgcattctttttcttggggagatgtttttaagccacatagcttccatgtggaagtgatttcatctcctaattaagatcacatttatgaataaaagcagaggaaggaagccagcttgacaagggtatcctaccaaaagccagggtaaatgggaagtctttgaaggacataagatgaaggtagttggagtttggaaggaagtggttttatagaccttgttttgtcttggttgttttgtggtcattattggagtggtgtctgagactcattatgggtttggttctgacatatttatagggaaggagagacaaggttttcctggatttggtagcagccctgttgtaggttagccaaaatgtacccttaatctcttatgaagaattgaattacttaccttctagaaatattccctgcataatatttgaaccataatattttaagccattaggcttttgaaatataggctaaaactttaaaggaaagtttcctaaatactttcaacacaggattgtgaaatggaaagaaagacgaaaggggaagagctttggattttagtacctctgcaggcattattaatcagaactgaaacagaaaaaaaaggaaaaaaaaacaaattcactaatagaatttgagtgcattagctctgtgcatgctgcaacggatttataggggaatgttttcttttagtttcttatggaccaatttgtttgactcttgtggaaatagattcattgatagctaagttttaaccaaaaaagaatgatttaattaaattatcattctattttgaggttctattaatagtttaatactatacataaaaataaacaaaacaacacaggaaacaatgtgcctaataggaagatttctttatggttgaaaatcagcagkgtatgtaatggaaagatggaatccaggtttgctcaaggtacatttgaggctgacatcatcaccttttttttttttcccttgagacagagtctcgctcttccgcccaggctggagtgcagtggcaggatctcggctcactgcaagctctgcctcccgggttcacgcccttctaccgcctcagcctcccgagtagctgggactacagacgaccaccgccacgcccggctaattttttgtatttttaatagagacggggtttcaccgtgttagccaggatgatctctatcatctgacctcgtgatccacccaccttggcctctcaaagtgctgggattacaggcgtgagccaccgcgcccggcctcattatagattattttaaatagaataatatacattcagttttgaaggctttggggtagtttattattcaagacatatgttatattgacaccctcaatgatccagttcccaatatgaaaagaatactagaattggaatcctgttttaggttaaagatgttgtgaaaaacatctgcaaaatgaattaaaaatttcctcttagactttttcacactgtgagacgatagaatatattttgtggctttattaaagtctctcattggtttctgtttaaaatttttaagatgaatacataaatgaatatagaacgttctgtgtgagtgtgaatacacctgcatgtgtgcttgtgcctgtgtagttgcaacttagagaggtagctactattttttgaacaatatggattaggttgagaagcaagagacaggaaggaagaaggaaaaagagccagccaggagggcagactgatgactgaagttgagggcaagaatacagcgagttaaccagagctttcccaccaactctccacagctctagttgccctccctcaccccagccacattctcacttctctttagctctagtctgagaaattggaagagaattttaaaaattagagtgtggaggaaaacattacttttctgaatcagaatttcagaaccagaaatagacttaaacaacagcaagtaccctcacaaaattttcagatgagcgaattaacccagaagaagataagtgtttcgttggtcagcagaaaaagcaatacctctagctgggcacggtggctcacacctataatcccagcactttgggaagccgaggcgggcagatggcttgagcccaggagtccgaaaccagcctgggcaacatggcgaaatcccatctctacaagaaaatttaaaaaagaaagagagagagagacagagagaaagaaagaaaggtaaagaaagaagaaaagaaaaagcaatacagcatgaaagactcctgacttccagttcaagattatttttatggccacattctgggagagtgctagcaaaaattaaagcaagaacctctttgtgatgcatttcttctctgttggaagggatactgcatctgccactgaggcagaggttgaaaaagatgcttaaaccaaacagggatctttatctgaaggacagcgaaatattgcctgaacagaggagtcattcgatattatatgaagtttacccttaatctttttagaggtaattttagaagtcctcatcagacaaaaccagcccctttccagatggtgtcttatacacctaatgatcctagagaatcagatcctgtgccccttgtgtgctgcccttcttttatgtgtgtttcaagctctctgattgattgtgaatctttggcctcaggttgcacttgatgtcacaggtctttctggtttcatttatatatacacgggggaatttgcttttctagtctttgaagctgtattaatgcagcttgaccttctaagccatgcaaaagtctaccagagcattttaaaccccaaagcttcaattggagacattcagaggaaaggaaaaaaatcttttgatagtcaagattactcacgattctttatttcaaaatttaatgtacagacaatatattttgaccataccaaattcacctgtcctgaagagaagcattttgctacatgtaggtgaagatgttgatgaataccccatatatatatatatgtatacatacacacacatatgcacacacacacacttgtgtgtgtatatatgtatgtatatatgtatataaaatcccatgtatagtaatacggttattgacagtatatggaatagtaatacagttattgacggtatatatatgtgtgtgtgtgtgtgtgtgtgtgtgtatgtactgtcagtacatatattcatatatatcttcatatatacatatatctactgtcaataactgtattactatacatggagttttccattatgaaacatcattcaataaatatttattgaacacctagcatttgacagacatagtgggttggccctgagaattcagtagtaacaaaggcagaaatgttcatgtcctcatggagcttgcatcattattctccacaaaattatgccttcatcaaggagagtaaataattctgggctccagattctctctttttgtctaaaaatgcatgtatttaatgaatgtaatcttttaattaacatataacatatacacagagaagtacacagatcaagtatacagctcaaagaatgtttaccaagtaaacacactcataaaagcagcagccaggttaagaaacagaacattaccagcccccagaagcccctttaaaatccttttctacttgctaaccttcccaagataactaattttgtgacttctgacatcataaattaattttggcttgttttgaactttgtagaaatggaatcatacggtgtatgatcttctgtrtctgtcttcatttgctcaatattatgcctgtgaaattcacctgagttgttgcatgtagttgagttcattcattctccttggtgtatagtattccactgtatattacatttcrtttatccattctattattaaagacatttggatgatttccagtttggggctattatcagttctgtcactattaaggtacttrtgcctgtctttaggtgactgttaggtatacacctatgagttggaatattgggtcatagattatgcatatattcgtctgtgctacacatggccaagcagcttcccaaagtgtttataccaagttatagtcccaccagcagtgtatgaaaattacagttactacacatccgtgccaagcttaaggttatgtgctttttcattttcatatgcattttaagtttataaagtagactggaaccactggagctttgtgataaacaatgagacatcataaagtttgtagcaacagttctaatcccttgaattttagtctatgccaatgattcaggatggtattatattaaattagaaactctgcttaactcttgatggaataaaagttactgtttataatggaaaatcctgcaaaagtttgyctttcttacatttggagttgtggctttttcaagcgagcagtgtcggaccatttttgttagccagagggccaagtaagaaaaaataaaaaatatgtgcaggccgcatttttaaattccaaaatggaaatggctttcttgagacatggggaagaaacatacatttggttgtgagataacctgccatatcaagtggaagactggaggtgggaaagttggagcaattattggccagtaaaatgttactattggactatatttgagaactggctgtagggagacagctgtcatcctgaaattagcttgtcaaccacattgtaaagctaggagggctaacttccagaccaagacctttaagaggggctgttttagcagcccacctcggctttaacacttccctaggaggaactatatatataatggatccaggtccaggcctattacagaagggccagctgaaggaaagaagaaccttattcttagaaaaaaacactgatggtttccttttccttttcagtccaaggtttacactcgcacaccaaccttatatttggacttcaaattggacccaggagccaaacattcccaacctatccctaaaggtatgatgggttctggggtttagtagtcacgtcaggaaaaaaaaaagaaaagaaaaaaccaacaagaggctgttttgcctggaatgtgcttgtttctgaaactcagcacaaagttctaagaactcttgtttatgtttaattgtgtttaaattgacaaatactgctgggaccttccaagttaagaaaatcaggaagaggccgggcacggtggctcacgccagtaatcccaccactttgggaagtcgaggcgggtggatcacgaggtcaggagatcaagaccatcctggccaacattgtgaaaccccgtctctactaaaaatacaaaaactagctgggcgtggtggcgcacgcctgtagtcccagctacttgggaggctgaggcaggagaatcacttgaacccgggaggcggaggttgcagtgagccgagatcgcaccactgcactccaacctgggagacacagcgagactccatctcaaaaaaaaaaaaaaaaaagaaagaaagaaaagaaaatcagaaagaactcacagaatgttagggccagaccttgtgggccataccactcaatttacaggtgtggaaggcctaaaagatgggtcacttgctcaaggccacccaaacacttactggatgaggtagggcaaggaaaacacccctgtctcctgactttccagctcctattgactcacagtgttcctgaaggcaaattcggacctgtgttacttatacacaagtgcatacttgattgagatacaggttttgcttgatataggtgttgttatgtaaaggttacctttagattgacatttgaatccaaagaataattaaaaattcccaagtatttaaggcctattttgttcttttttttttttaattctggctaatttttataattgtttttttctgtagacgtggggtctcactctgttacccaggctaaagtgcagtggcatgatcatagctcactgcagccttgaactcctgggcttaagtgatcctcttgcctcagcctcccaagtaactgagcctacagatgtgtgccactatgcccagctaattttttaattcttttgtagagatggaggtttcaccacgttgcccaggctggtctcagattcctggccttaagttgatcctcctgccttggcctcccaaagcactgggatttcaggcatgagccattgtgtctggtctatttttaaataatttttttaattaacacaatagatgtacatattttcagggyacaygtgacaatttaatacgttcatataatttgtaaagatcaagtcagtataattaggatattcatcaccttaaatattggtcttttctttatgctagaaacatttgaattattcttttctagctgtttggaaatatacaaagattgttgtaaacaatagtcgtcctactgatctatcaaacaccagatcttatttcttctatwgtatatttgtactcattaatcaatctctctttatccctcccagacccctacccttcatgtcttctggtaaccaccagtcttcatgagatctttatgagatccacttttttactcccatgtaagagtgagaacgtgcaatatttgtctttctgtgcctggcttatttaactgaatgtcctctccaggttgctgcagatgacaggatttcattctttttatggctgaataatatttcattgtatatttatatcacattttcthcattcatctattactgggcacttaggttgattctacgttttgtacattgtgaataatgctgcaataaacatgggagtgtaggtatttctttgatatattgatttctttcttttaaataggtacccagtagttgaattgctggattatatggtagttctatgtttagttttttgaggaaccttcatactgctttccataatggttgtactaatttacattctcactgactgtatacaagggttcccctttctccacatcctcaccagcatgtgttattccctttttgataacagccattttaactggggtgagatgatgtctcgttgtggttttggtttgcatttctctggtgattagtaatgttgagcattttgttcatacacctattgcccatttgtatgtcttcttttgagaaatgtctattctgagcttttgcccatttttaaattggatttctttttgctattgaattgttgagctccttatatattctggttattcatcccttgtcagataggtagtttgcagatattttctcccattctgtgggttgtctcttcactatttttttttttaagacagagtcttgctctgtcacccaggctggagtacagtggtgtgacctctgctcactgcaacctccacctcctgggctgaagcaattctcctgcctcagctttccaagtacctgggattacaggtgtgtgccaccacgcctggctaatttttgtatttttagtagagatgtggtttaaccatgttggccaggctggtcttgaactcctggcctcaagtgatctgcctgcctcggcctcccaaagtgctgggattacaggcgtgagccaccgcacccagcctcatgttattgattgtttcctttgctgtgcagaagcttttgagcttgatataatatcatttgtctatttttgctttggttgcttgtgcttttgaggtcttacacaaaatatctttgtccagtccaatgtcctggagattttccccaatgtttacttgtagtagtttcatattttgaggtcttaaatttaagtctttaattcattttgatttgatttttgtttatggcaagagataggggtctaatttcattcttcagcatatgaatatccagttttcccagcaccatttattgaaaagactgtctattcctcagtgtatgttcttagcacctttgtcaaaaatgagttccattgatccatgtgtctgtttttatgccaataccatgctgatttgattactatagctctgtagtataatttgaagtcaggcagtgtgatgcctccagctttgttcattttgctcaggattgctttggctatttggggtctttcatggttccatataagttttaggattcatttctgtgaatgagattggcattttggtagggattgcattgaatctgtacattgctttgggtagtattgtcattttaatgatattaattcttccaatccatgagcacagaatagctttcaattttttttgtgtccttttcaatttctatcatcagtgttttatagttttccttgtatagatttttcaattctttggttaagttgattcccaggtattttataatctttttttgtaaccattgtaaataggattgctttcttgatatttttttcagattgttcactcttggtgtatataaatgctactaatttttgtatgttgattttgtatcctgcaactttaccaaatttgtttattagtcttaataggttttttttggtggagtctttaagtttttcttastgtaagatgatgtaatctgtgaacaagactagtttgacttcttcctttcttatttgaatgccctttgtttttttttttctcttgcctagttgctctggccaagacttccagtattatgttgaataaaagtggttaaaatgggcatctttttcttgttccagatctcagaagaattcagtttttcaactgaattctttcaattttttcccattcaatatggtgatagctgtgggtttgtcataataaggcctttattattttgaggtacgttcattctatacccagtttgttaaaggtttttgtcataaagagatgttgaattttattgaatgctttttcagcatctattgaaataatgatgttttttcttcttgattctgttaatgtgatgtgtcacatttattgatttgtgtatgttgaatgttgaaacatctttgcatccttgggatgaatcacacttgatcatggtgaacaatcattttaaggtgctgttgaattcagtttgctagtattttgttgagagtttttgcatctatgttcatcagcaatattgacttgtggttttctttttttgttgcgttcttgtctggttttggtatcagggtaatgctggcctcataggataaatttggaagtactccctcctcttcagtctctttgaagagtttcagtaggattggtattaatttgtctttaaatgtttggtagaattcagcagtgaggccatcagatcttgggctttttttttttttatgggagacttattatggcttctatctcattactagttattgctttgttgaagttttctatttcttcatggttcaatcttggtaggttgtatgtatccaggaatttatcaattttttctgggttttccaatttcttggcatatagttgttcataatagtctctaatgattctttgtatttctatggtctcagttattgtgtcttctttttcatttctgattttatttatttgggtcttctctcayttattcttagtccagctaaaggtttgtcaattttatttatcttttcaaaaaaccaacttgtcacttcattgatcttctgtatttttttgtctcaatttcatttacttctactctgatcttgattatttctttccttctactaattttggattccattctggctatttaagtacagaaaaattttagattaatttgcttaaacataagccttcactatccgtgatttttataacattaagtgtatgtgtgctttaaccttttagtgcagtgcttttatctttaaacttttgagttgctttcctccaatcccttgtcctcccttatctatgtccagtaccctcactatatagatcacagatatatccttgaattatatcttgctgtatttttctccacacttatttttatacactgacatatatgtgcattcacatatatgcaaatatcaggttattttgtcattttaataaaatggaatcataactactcttttacgtcctatttatttgactgaaaaatacycatggaaatccttcccagtttacttatatagctccttttgttttgttttgtttaagagacagggtttctctgtgtcacccaggctggagtaaagtggcacaattatagctcactgcaayctcgaactcctgtgcccaagagatcttcccaccccagcctcccaagtagctaggactacaggcactcatcattaatggtggctccttttaacagtgatattctacatcatctaaatacatactmtgatgtatttagctattttctatcaatgggaattcactttgttcctagtgcttggctacagcaaactggtctgcaatgaataccttgtgtatctgccttcccatgtggaaatttattttgatgagacaggtttccagggatggtcaccagatctatgcatgcttagttttaaaagacattgtcaggttgcaatccaaagaggcagtcacactttctattagcagcatatagaataccagtttctccacaatcccactagcaggaagtgtatggttcatgttcatttttgctctgctctcagacatcaccttatattgcctcctgagagaacgtatatctgtcagtttccaaagctgtatttgcattttattttgtcatcatgaattttaaacctgagatttgttttcaatcatgttttgttgttgttgttgttgtcgttgttgttgttttgagatgaagtcttgctctgtcgcccaggctgaagtgcagtggtgtgatcgcggctcactgcaacctctgcctcccaggttcaagtgattctcctgcctcagcctcccgagtacctgagactacaggcgcatgccaccatgcctggctaatttttgtatttttagtagcgacggggtttgaccatgttgcccaggctggtcttgaactcctgacctcaggtgatccgcccacctcggcctcccaaagttgggattacaggtgtgagccactgcgcccagcctcaaacacttttttttttttgacacggagtttagctcttgtcgcccaggctggagtgcaatggcatgatctcggctcactgcaacctctgcctccygggttcaagcgattctcctgcstcagcctcctgagtagctgggattacaggcacccrccaccacgcccaactaatttttgtatttttagttgagatggggtttcaccatgttggccaggctggtctcaaactcctgacctcaggtaatccatccacctcggcctcccaaagtgctgggattacaggcatgaactaccacacccggcctcaaaaacatttttatagggatacaacaggaaatagcttagaattgcacatttagcattgagcgtctgtaaacccactttaaacaagtgcgttatgaacccagctatgaagcaaaagatcctttcttttccaatacatcacttttagttatagtgttctctctttctcagtctgtctgtctgtatctctctctctctctccctcccctatctctctctctgtcttacacacacacacacacacacacacacacacacacacacacacacacacagacttatccatgcttccactgcattaggtgacaaatacaaagtttgaggcttctctgtttagtgcctaacaattaattcaagtattataaagcactcattatttgcagctttgatagtcctggctgcctgtcatcagacatactggatggtaaaattatgctgtataaagtttattatgaagtaattcaaatcaaggtcmccatttgtcttttttttttttccacctttccaggtcaaattccatcataaactccaaggactgtctagattctttttatttgggtgctttgttgtatcaaatatttcgtgaaatgtgtaggccattggctgggtcctggacatgtttcgtttataatgttttgattgttttgttactcatggtaaagggatttgacatggatgtctggattatgtttggcttttggcataagctttgcagtctaactaatttaatgttgacttggttttatcattaacagactaattggatagcaatagaagcatacactgctaccatcctcyccctgatactgggaaaatgcatatattccaagggaaatccagttaagggagactgaaaacgtttctcatgaatcagactaggttttatctgagttccttcccatgaatactatttgaatcgatttttaccatctctttatttccttcaggctaggcacgtttctcttgggttgtgctaatcttgcagaaarcagatgtttcatgcagtgatgatttggaaggcagttgatatcaggaattgagctggacggtgcatcacttacaaagaatctaatttgtcgagtttctgacagtaccagattcctttcacattggccacacgtttttyatattagatcttggctaaaataagagtaagtagttttttaatggtgacttttaccatttcttgcaaggcgcaaggcaatctgactttccttttgctgtaaactgatttacagataacactgtttgttaccattaattatgaaggacataaatctatatttctaggaaaatatcagtcttttccaagaaacatgtgccttcttgtcctcatgtcccccttgtcttctgactgactgtatcacagtttggccctcaacagccactctgtttattttcctcatttccttttacagcacctttgcctctagatacttaaaggcaggatctggaatgttaaaaatggagagctgttatggaaaaaacttgattttatgaacctttttgcttttcctcaccttataacttttcctttacagtatatgtagatcaataaacaaaatttatttagaaaccatatagtctacccctctgtggtaggcaaaataatgtccccccaaagatgtccacgtcccagtttccagaatctgtgtatatgttatgttccatggcaaaaacgactttgcagatgtgactaagttaatgctgctgagatagggagattagcctggatgatgcaggtggacccygtgtcataaatgagaatctaaataagagaaacagggagacagggagtcagagtgagagaaggacatgtgacaatagaagcagaggtcagagtgatgtgattactggttttgaaaatggaagggcccacaagccaaggattagtggcaacctctagaagttgaaaaaggcaagaaaacaaatgtccccctacagcctccaggaagaatacagtcctgcttgattttagacctatgaggctcattttggggcttctgacctcaagaactgtaagataaaaatttttgttactttaaagcactaagttttagagtaatttgttatagcagcaataggaaactgatacaccaatatatttttgcttctgtgtttatggggaaaaaaaaggaaaggagctacatcttccttgattaaaaagtagattttaatgccatacatacagtagctacttggtaagtcacattagtatacatttaaataaatcttattgtattaattatctatatgctgcataacaaattacccccaaaactttgtgccttagaacaacatgtattgtcttgcaatgtctctcaacttagctgtgtactgttacaaggccacgatcaaagtgtcagccggaggctgggcgctgcggctcacacctgtaatcttaatactttggtaggctgaggtgggcagatcactcaaggccaaaagtttgtgaccagtctggccaacatggcaaaaccccatctctactaaaaatacaaaaattagccaggcatggtcgtgcgggcctatagtcccagctactgggggtggaggggggcggggattggctgaggcatgagaattgcttgaacctgggaggtggaggttgcagtgagccaagatcacccacttcactccagcctgggtggcagagctagactctgtctcagaaaaaaataaataaataaagtgtcatctgggactgtggtcatctcaaggcttgactgggaaggatgtgcttccaagctcacactcatgtggttgctggcagcattcagttcctcaagggttgctggctagagtctgctctcttgtttttggccacatggggctctatatagggcaactcacaacatggcctctgacttcatcagaaggcacaaagatgagcaagttggaagccagagactttatgtaacctaatctcagaagtgacattgcatcagttttgctatattctactggttagacgcaagactctagccacagcccatactcagagagagggaattayatagggcaatacgggaggcaggatcaggcagacgtcttagagtcgacctccacacttatgatcttggttgaaagtaccacacatttttccatatggtcaatgactcgaaaacaagtagtgattttttttctctctctcatttgtgacttttaaaaatgactggagtaaacctcgaaaaatgcrtagtgattttttccacaggcttcttgcctgttttttcatagtctttctctacttttaaggagaatgccccaaacatgaatgattcatgtagaattttacattttgagtcttttcatagaacgcaaaagccgatttaattcatgagtaatttttttgcagagctctctacttcccagcagtacattagactattcaatcacagttcccttcatacttagaatatatacataacagttatggatgtaaatctataggtcttcagaacagtgattaacgtgaatcagagcctgaaatatcaaattattcaggaagaagtttaacatcattttcctttgactgggttgtctttttcatatygatttgtaagagctctttatatattctgaatactagtcattgtcagttatttgtgttgcaaatgtctttcctgcttttttttttaacctttctatactatgtttctctattttaataagtaaaaatgccttaaatgtatcaattggctccttaatgattagtgctttctgtggcttctttaatcatctttccctaactcaagatcataaaaatgtactctctactataagtgctttgttgttttgcctttcatattgatacatttatttcacctggaatggtttttttaattgttttttaaattgactgataaaattgtacgtatttatcttgtacaacttgatgttttgaagtatttatacactgtggaatgactgaatttaactaattaacatacattacctcacatagttatcatttttgtgataagaacactttatattccctctcttagcatttttcaagaatacaatacattgttattaactgtagtcaccatgttgtacaatagatctcttgaacttatttctactatttaactgaaattttgtatcctttgatgaaattggttttcatgtatggtaagatacaattacattttttaaaacatggtttgaaacagaggaaaaaatggcaaaaatccatgatggrgaatgccatgaacattttaaggggttcacagttcactgaatcatcatatagtaataacaatcattatagctaacatttattaaatgcctactctttgccagaaactgctctaagaaccttccctatcctaagaattaacacctgtaatcctcacgaccctgtgaggtaaggattatgattacctcatttttcagatgaggaaactgaggtacaaagagattaagtaacttactcaatatcaattagttagtgagtaatgggactgagtttctgctaggactcttaactgccatcttgtcctgcaccaaacaaaaacatggacctttagtgaacagtactctattagtagtgtcttgggcatattggtaaataaatccaagatttygyacataggttagaaaaacgactattcttgaaaattttaaatgagtaatatcatctcattgtgttgtgtttttctgttatgtcacctttaggagaaaacaggttaaattgatgatcaatgtaaactaaaaacctattctaagaatttaaatatgtttcaattttggcaggggtgtattttttttcatattttacaggggcttttaaaaaatatttttctcaggctgggcatggtggctcacacttgtaatccacacactttgggggactgaggccaggagttcgagacaagcctaggcaacaaagtgagactctgtctgtaattttgaaaaaaggcctctttctcttaaaaacagttaggtgtccaaatacatcctgaagtaatcttagggttatttatgactttccctgctaatttcaggtttctattattttttgaacatgtatttaatccttaaagttctgtatatttcagatcttaatagtctataaacgtggcttcaatctaagttcgaatgcctaaactagtttctgttttagagtgctaaaatagaattttatgattatgtctacattatttgaattattttctgattttttttctgagcaattaaaaatcagttgtgaatactgtgtgtctgaagaggagacaagttctgttcaaataaaaccaagaaatagtagtagcatatattactttagttaaaaactttattaaatgtcttgatgagaaaacctcaatgcatcattgtgcacttagtctctaaagagcaggatacaattattatgtgtcgattttaaactttttttaaagaacaggataagcttctagggcattctaataagcttctagggcattctaatacatttgtagtactattgtattagcaagaaaataatcagcagggtttgccctccagcgggctaggcttcattctgggcatgcagaaggctgtattctgagtttacattctaragagcttatattgcttatatatttctcattcaaaatgttaaatttcatttatttcttagctttcctgttagcttctgatgcaatgagtgttcagtattatgaatgtggaccaaaccataagacagggttctcctataggctgcaattgtgcttacttaaaataygggatcctgagggatggctcttaatgttatatgcccatggcttataaacagcctgtagtatgatcgttctgtaatgtataaagtgcattctgagtctattttattctggaaaactaactgtctcaagtgttttgatgtgtataccattttgttatatagtttggcattttattattggtgtcactcatcaaatttggtaaaacgggcattctcatttttttccaatggaattctcacaagttcaggtaataacctatctctcagattgtggagttacaaagttgacatttctttatcttgctgtttatattcagttataagatgggggttaaatgcctattcttggcaagctagtagatcttacggtgagctgtyacttgctgtatgatcagacaacccaacttatgtcaccaattctagtctgcagtgtttggtgggacacagacagcatccttaatgccrtgaggttcttgatgaggacgttttgggagacgtcgcaaaaatgtagacttcttttgggaaatgatgaccctgctgagctttgctccgcagtcgaagagactaattggcttggtgtgaggtgggtgcagcagggagcttagggccatctccatagcaatgacccttctctggcctgggtcacagcctcatcagaattgtgtaacgtctccacatgcacagatttgaaggaaagtggaaaaagaagaaaggggcaggaaaatgaactgatatttgttaaatacctcctaagtgcctggcattgtgtagagaagattaaaaacatataayacacatatgtatgtacagatgtataaggacatttatatatgtttatacagacatacaatagaaacagtatgtttgatgtttcctcattagactgtgytcatcacaacagctctgtgttatacgtattcattccttattttacaaaccagcaaagaggcttgaagagatgaagagtctggtcctagatctycctgagggtgatgcactgatgttgaaacaggaactttctgcctgtaatggtgtgtgctcatttttgttgctgtttcatggttgcttagttggtttgttttccgtggttctccacaaagcctcctttaaggtttgctgctgcgctttgtttccccactccccaagagagagytgcatggatagaattaaatatggaggcggggcaggcagagaggccatgatactggagaaatgtaggaccatattgagaagagtttgtctgtcagaagtttgggcttgtcctgggagaacagggagccattgaaggattttaagtggagattctaaaaaggtgcaatttacgcgtgtagaaaatggattggcagcaaccagttaggggactttttttcacctgtatggtttttatcttaaagaaaagatagatatgaaataagtatggcaaacatatatgttcattatttcatcctttgtgctcttctgaattaaaaattaaagtattgaaaataaatgaaaattctctaaatctgggagggacagggattagcaaacaattcagtctaacgaagaaacatcaaataaacccaaactgagaggcattctataaaataactggtctgtacttttaatgaaagaaaaagactgaggaactgtttcaaatgaaagaagattagacatgacaactaagtgcagcgtgtgatcgcaggttgggtcctggcctagaaatttatttctccttttccataaaaagcattactcagatgactgacacaatttgaatatccgtacatagatagtagcattgtatcaatgttaatttcataatttccataagtgcactatacttttgtaagaaaatatctttgtttttaggaaatacatactgaaaattatttcaaggtaaaggggcyacatgtctgcaaattactctcaaatagttcagaaaaaaaaagaatgacatatatttatagcaagaagaatgataaagcatatatgttaacatgttagctttgggggaatctaggtgaatggtgtacaataattctctgtagtatttttgcaactttttgatatgtctgaaattattttaaaataaaaattaaaaagaatttggtggaaggaggagcgggagggaagaaccaggcaggtctgcctcttgtcctaggaggccagggttgaggtcctagatgaaggagttacctgccaaagctgatgtggggacttccggtggcgggggggaggttgcgggtatgggaggaggatcttagggaccagggttgctttgcggtctggcaattatgtgatccagagtttgtgaagggttgcaatctctccttagcccagttgcccttatctctgttaatggtgttggtgtgtcaccaggccrtgtttttctattttttctgcacatacaggtgtaaggaatacttgtaagttcattggaataatgaactccaagactgaggcagaaggaaaatgacccgggttaaggcaaggaatgtaggctgaggaaagctctcactagggacgtttgcaagaattaggagcctctctggaaatgagagcaactgccacagaaaatgatttacatattttttaaaagttttgggtttttaatgtttggctaaaggaggtctgacttaaaatgcgttgctgacttaactgtcctaggaggccagaacgaaaatgtgacctccctcccagctcattttattcatcactgcccaagggaagggaagagcttttcagctgcaaagagacagtagcttgcagaccatatttgtaggagaaaggaaaatgtagcagggtgtgaactctgacaaagcaataaaaattgggggatgacatcaattcttggtgcaggacataaaagtgggaggagaggtgagggaagaaagaaagatgagaaggacctgaaaatctgacaagagatctcttctgtggctgttgttaaacatatagtaagcattcatgaaatttggcatttgttttcttttgcagcaagctgaagaaacaaagcttagtggaaattaaacaaattaacagaagcaagtgcagatgggcatcatgctaaaaagaaagaaaaaagtaaattgccttcatttctattccatgccctctaacactctgtgctttccaatcagcaacatgagttgtgttattactggcaaagatggacactatatcctagcagaagacttttacaaggagtaaaaatatatgaacacacttagtaaattgacttaggccattcctttaagcaaatgtttggtccttccagatcatgtaaaaagataaaaaaggaaaaaaaacagatctaggcaattatttgtggactagatttctgcttgaagggtgaacaggaagcaaagcaggtggaggagaaatgagattagaacaatcaaaatgaactcaaataaaagcctggttgaactattgagagttttgaggttttgtcaaatgtggtaaccactttttaatacctttaaaccgtgaatagaggattcgttgtataaattatgacatgtccttacaatggaatgcatgcagtttttcccaaggatgagttacttctctatgttttgacatggaaaggtatccaaaatagaatattgagttagttctagtttttttgttttgttttgttttgttttgtttttttccgagacagagtcttgctctgtcgcccaggctggagtgctgtggcgagatctcggctcactgcaacctctgcctcccaggttcaagcaattttcctgcttcagcctcccaagtagctgggattacaggcacgtgccaccacgcctggctaatttttgtattcttagtagagacggggtttcaccatgttggccaggctggtctcgaactcttgacctcgtgatctgctcgccttggccctccgaagtgctgggattacaggcgtgagtgaccgtgcccaacctgagttagttctagtttttaaggaaataacttatagtgcataaaagaaaaaaaaaactgaaaacacagataccaaattgctaacaatatttatgtcagggtaggaatgaagattgcagaaagattttcagtttagatgtcccacactttcatattcttaaaatatttttaaattaatgtgtttttttataatcagaaaaaatgaagctattggtgctctgaaaaagaaaaacaattgtggcgaaacttttgaaaaagcagagaagaaaggggtttggttgtagagtatgattacaagtcaggctaaatagaagtagaaaagctcagcattcattagaaaacaaagaaagaagtgctccagcagagccagcccatccagataagacatgggatctggctgtaaattattagtgtgtgttttcagcatctaccatggacctccccccgccaaaggtgcacaatttgcacaccccggctatgccttattcatttttgtatcttcctctmaagtacatgcccatggtagatgttcagtaaatgatggtagacaaagctcggaagactaaatatgagtgggttaagatgggagaaaaacgcctgtaatcccagcactttgggaggccgaggcgggtggatcacgaggtcaggagatcgagaccatcctggctaacatggtgaaaccccgtctctactaaaaatacaaaaattagctgggcatggtggcgggcgcctgtagtcccagctactcgggaggctgaggcgggagaatggtgtgaacccgggaggcggagcttgcagtgagcggagatcgcaccactgcactccagcctgggcaacagagtgagactccgtctcaaaaaaaaaaaaaaaaaaaaagggagaaaaacgagtaagctatgaataagtaacattactttyagagagcttaaactcattctagtaaaatctcagagaggaaaaactgtgaaatagggggatgggaaaatattctctggcacttgctcatgtgtgtttgttttgccatccttcagattttcttagtgagacttaatttatgttttctcagttatagcttttcttttgtatccagttgaacgtttcaagccatctgccatgacagtcatatctttggaacatattttggcctccttgctccttctgcactcgcctttgtttaccctgtcatcacgctgactcctccagagactccagtgtgggctctgtccttccagcattgaactgtgccctgcattctctttccagatctccttttccactgaaggcacatggagggatatcatgattccatttcgactgtgccttttctaggttcatatctctcagtggaaacacagcatctcttctgagccatgggtacaatatataaacatctatgaaaatcaagtgttggtgctgagagtgcaaatagcctattgtgagtgattttgatttcttggccccatgggtcatggtaggaatctggtgaattctatatactctctttccagaaaagtgtacacacttgaaaaactgtgaacaattccagggagttcacaggccatcctggagcccatttatatccctaagattatrtattcctgcatccctggaactgatgcatattctgttaggatagaataaaagaaggagttcactggaaccagaatgcaactagaatgcactggaactagaatgcaactaagtacaaaaaagcaggccgggtacggtggctcacacctgtaatcccagcactttgggaggtcaaggcgggcggatcacctgaggtcaggagtttgagaccagcctggccaacatggtgaaaccgcatctctactaaataattttataaatacaaaaattagccagatgtggtggcgtgtgcctgtaatcccagctactaggaaggctgaggcaggagaatcgcttgaatctgggaggcagaggttgcagtgagctgagatggcaccactgctctccagctcaaaaaaaaagcatatttctagcatcagcttcacacttcagacacactggaggcacaacaaatggaagataaagccagactggagtgttgcagttactatcataacattacaactggaaggaatagtttgtttggtaatacagcttgtagcctatagatacacagccaagtgaattgtacactgtactttgggtgcttcttaaatatttgggaccaagtcatttaggtttaggggtatgtctgtgtttgtgtgtgagaaagagaatgagtgtcagtgtatattttaaacagttcacagaacttaaatcttaaaatgtctatctaaagggaaaaaaaggatttcgtctccaaatttatctttgtgtttgtaatacgtatatgtctttgttccttttggcattatggacactaacatgttaatgttgctggtcctttccagggtggacaagcttcatttacacgatatctggagatgtgtatattggtaagttatggctgtgtcacttagggctcaattgcaatttaatttaaactactgaagggagaaaaggtaggatgacaccattttatgtaattgaatactatgccaccttctctccyacactagccctctctatatcccagcacaggtatgcccagggcagggtgcctttcagcttacagaacattcagtgagggaagagaatatgaacaccagtcatgacacatcctgtgcacagatgaaagtccaggcaccattatgtgttttgatacctcgctaagacgttggcaacctccatactgataaagggatggagctacagtggactccaaggggagcaggaatctgcctatctcctgggagaaggaaatggaaggaggtgaatttgcaatgctagtttcctctgagaaaactcaaaagtggcttttttctcttcttccgagggttgtatatatgttgcttgttgagtctaatcaagaaaagatgtttgagacctaaccaatgctcattttatagatgaggaacgtgaaatctaagaaagttgtttaacttaccagggttacgcattggtggatgtgggaccagaatcaaggtctcctcaatcctgctctccacgcttcaccccataccttttgtycaatgacaatgcagagatagcaccatctaacttgtcttttcaagtctaaatcccttagcgaacccagcagcagaagggacagagcgggtgggagagaggggcttgcagagcagcctggttcctgcctgggtctcctcctccccttcccatcctcctaaaagcagccatgggttcccgtaaaaggctcttggtagcactgggagaaaacagctatagcagatgctgttggtaccccacccacacccctgggcccttrcttcctgagtgcccactgaccaactaataatagccagtatctgtgtcacttygcttgaaggcttttctctgaaaccaatcagggcagcatgaaagtactggagaattaacattcccagaagctacctcacccatcagacaggataactctgaagcctgtgtgaaaagccatttactagtttcccagtgggattacagccaagccacctgagtgtgcttgatgacatacccttcgttgtctgtcttcccttttctgtctaactctcctgactctggactgttgtttcctgagatcatctcccagataaattccttgtaccagaatatatgcatctccagttatacttctgagacagctcagagaaccagcccctcgttttctcctcctcatccccacagacggttatgggtggtgtggatggggtggggcatctcagggtacaggccaagaatccccatttctgagaccctctgcagctgggtgctctccacccgctcctgcagggatgccagcactgcactttctggggccctaacatggccacctccttgggcaatacactcccagctccaggcagctggctgacagataacatctgctcagggatagaaggccacacccagagctatttaaaccattccttktattctccaaaaaggatgttcaattgcctgaaattattcttctggaaaataattgtaatgcaaactcatgcattttgaatttattcctaataaagtacaaatgggcttagttcccttttcagtgaatagcatttcaattaggggtcaggagcaaaattcatttagtttagcactggagaaagtgtgaaaaaaagtcttgtagtagtatcataagtttatatgtacacagcttaaactatattaaccatctggaagagatgatatatcatttgtttttatgatcttctgaaaatcctgagaaaaacatagtgctttataaaaatagaaaaaaacatttttatggaggtagtgctcccgacttatgatttcaagagcaacaaaataatctacacaaatggaaatgaagaaagcacatgaattttaaggtggtaaggataacagaaatgtttgtgcagaatgagaaaaagcagggagaagcaaactttctgtaaaaggacagatcacaaatattttcatctttgcaaggcatatagtctcagttgcaactacttagccctgcccgtgtctcacagaagcggccacagatgatacataaacaaattgggtggctattccaataaaacttcatttatggtcactgaaatgtgaatttcatgttttttcatgtgtcatgaaagrctttttttaagtttgtttcaaccatttataatagtgaaaatttttcttagcctgtgggctctaccaaaggtgacagttgattttggtttaaatgaattgcagggaatgaaggggaaagaaattaacgagtaattgccaaaacctgttttaagcagtagttagagccttgtttcctgacagacctttagcctgagaagttaacaagtgaaatgctctgcagttctcggggtaagaatgacccacacatccacttgtttttcttgagatgaggcaggattttcctgagtcatttctatttactgacctggtcccccctcgtgaccatgggccacagtgcaaaacatctggcaagggatgggtctgtagccttggagcaaagttgcatctgtctagaataaactggactgtgaagagaatccagctcacacaactggcctcttgggactgtgctttaaccagtgagtggctggctaaatgacctcatttgaattttatctccttcccttcctcctaccaacaccctaatgggggggcggttaatgagaaaaacaaaagggcaagaacaaatcatcagggaaaaagaaatgacgaaacagaaatagctcttgaatatgtactgacttataaaatcaatagagaaaatccagaaaatgttttctgacttcactgcctcaattttgtcttgcttataaaactaggttggcaccaacgaaccacagatggcaggaagtgataagcaaggaattgtctttttcgaaatgtcaaacatgttcagttgaagtagatgtaatgaatatatatatacttggtgtatcgggctggaataaatgggctgcaacttgggttgaggaaataatctgaggagactgcataaaatggaaatttaggagggctattaaaatattaactgattacaggaagtgcttaaaagacattgataaatttagtttgactacaaacaggtggagttttgaacattagaaaatgctccacagccgggcatggtggttcacgcctgtaatcccagcactttgggaggctgaggcaggcagatcacttgaggctgggagtttgagaccagcctggccaacatggtgaaacccctgtctccagtaaaaatacaaaaattagccgggtgtggtgatgcacgcctgtaattccagctacacgggaggccgaggcaggagaatcacttgaacccggagagcagagtttcagtgatctgagactgtgccactgcattccagcctaggcaacagagcgggactcttgtctaaaaaaaagaaaaaaaaaaaaaaaagaaaatgctggatgtttaactagttgtcaaagtaagtcagtcattttaaaggtaaaggtaagtattgtgaggctatgtaattgtcctctaatgacaccctgaagaaaaagagttaacagagctaaaataagactagtagaattctcattttcttattcaaagaaagtattcatttgagactcatctgaaagtactcactttatgcttttcaaggatcttcttaatttttaatatatttgctttttccaacaatgaagagccttctaaactgactattgaatagtaattttaaaaagtgtgcaatagagggagagacctttgacaacaatcttttgctaaggcaaaaagttctctgaccagcccacagctggaatctgtgcatcatatgataaaaaaaaaaaagtcaaaagaaaataaaaaatacattgtcagaaaaccagtagatcccacagatactagtaccaaatctcttccctgcagctgtgctggaaattactttacacattaatgcagagatcaaaaggatagaaaagtttacatcctgtatccttgtagcttggtacagtttatcagcttgaattctagtcccctagaaggcctgatatcaagtatactgttggtgcttagaaaatatttagaaatctaaaaacatttgtttgtgtttagtgaaatgaactggcttacaaaggcagtaaaatgttttgaattcatttaaataactaatgattcacgcttagtttgtgctaaygttttgagcacaaacttctgtgctctggttttgggtgatattaagcagtttgaaacgggctctggatcttgcagtaaaggcggggaaacacaaatgtgcaccagcaggcctcataattgacctccatttatccaactaacygaattgcccagtgctcttcattctatggtgaatactttgaggaaggtgcttgaacacccaggatgatccgctcctccctggtctgcctgctcatagctgctcccatcagctgagttgtagtggacttaaaggcacctatgtttgttctcagtccatttatgctagttgcaccaataattgaaattatgtaatttaattraacagttgtaaattaattaaataaatgtgaaaagagagttggtatttccagaacaactaaggcagatgctttgtaaaagtgaattgctaaaggaaatgcctttgacacggaaagacaaacatcayatgttctcagttctttgtgggatctaaagatcaaaacaatatgaactcatgaacatagagagtagaaagaaggttaccatgagttcatgaggctgggaatggtagttgggggctgggcagggggaggtggggatggttaatgggtacaaaaaaatagaaagaatgaataagatctactattttacaacatggtgactatagtgaataataacttaattgcaaattttaaaataactacaagagtgtaattggattgtttgtaacacaaagtataaatgcttgaggggatggatactccccatgctccacgatgtgattattctgccttgcatgcctgaatcaaaacatctcatataccccataaatatatacacctactatgttcccacaaaaattaaaaatttaataataagaaaatgcctttgaatttgtgaaagatttggggaaactctaataatctaatgggtggtgcattatgggtatgcttttaaaagaaaatgcttcaatcaagtcagtaaacccaccttaactgtatttctttctttctttttttgcattcaagcactcctcccacctgtctcctgagtagctgggatgacaggtgtgcaccaccacacctaaaaatgttttgtacagacagggtctccctatgttgccyaggctggtcttgaactcctgggctcaagcaatcctcctgccttggcctcccaaattgctacaggagtatttttaaacatttacaaacaaatgcacatttatgctttcgtttaaaataaaatgtttgaagcagtttgactgtctttttcaattaacaatctcaattgcatcagataagaaggcttcaactatacatataaaattgataatatcaaacctatgatagaagtactagagtgtacggaacagagaataaataggacagcaattcttataaatagaaaaaaaggaaaagaaaaattggcatttgcagaaaagttgtacagcaattaatcaggcactgaagatgcagcactaactttacaataggttttgaagtatttcgcccttttatgactatttaggcaaaaaaattgcaattaaattgttttcagttaattttttccttaactgtgctattaaatttaacattcttggcagtgattcccagtggaaactatttgttatctgatttggctctatttatcattgaaagtagtcagaaacaataagatatattttttgagacttattttaggttcaggagataaccagatgggcgaataacataaaaatgatctggaaataaagatagaatcaatctttgctttctgtgactgtgaccctgttttaaacatttcatgtaataatacagaagctaaaagtacacttgcagttattattaacctggaaccctgactccagtgtctataagaaaggtttaccttggttaggcgcagtggctcatacctgtaatcccagcacttggggagactgaggtgggaggattgcttgagcctaggagtttgagaccagcctgggcaacataataagatcctgcctctaccaaaaaaattttttttaattagctaggcatggtagtgcatgcctgtggtcccagctacttgggaggttgaggtgggaggatcacttaagccccagaggttgaggctgcagtgagctgtgattacaccactgcacttcacacttggcaacagagtaagactctgtctcaaaagaaaataaataaataaaaataaagatttacagcagggcgcggtggctcacacctgtaatcccagcactttgggagatcgagggggcagatcacgaggtcaggagatcaagaccatcctggctaacatggtgaaaccccatctctattaaaaatacaaaaaattagccgggcttggtggcacatgcctgtagtcccagctactcaggaggctgaggcagaataatcgcgggaggcagaggttgcagtgagctgagattgcgccactgcactccagtctgggcaacacagagagactccatctcaaaaataaataaatatataaataaataaataaatatttaccttagagtggagcatttcaaatgacctctttagtatcaacactgagattgcaaagagaatgggcagaaattgcatcccacatacaattagagttagagccccttagacaagctaaactttttgttgctgaattaagatttcctcacagaccaatgaacaccatagtcaagcaagctcccctgatagggggtgcagagaaataccaattcagcattatttttgagcactcttttgccagctcactccattaaaacatagcgaaggggtttataaactgttttggtatatgtatcacgaaacatcctacatgacaaaattatgggccaggagtggaccacgtgggtaatgggtgttatacatgaattagttgaagataaagacatgtttcattgctcccaggggatctcagtaaagcacacttaatgaaatgctgctctgtatcacagttgaaaatattactcaactctaaatgagatttttttaaactcccagacctctcttctattgccaaatccctgcataagtggaaaatcaatggagttctatcatttgtttccatgacgtttgttgacctaaatctttgatggaggagaaacctttagtattatgctggggctggctcttgctagcttgcaggagctgattgtgtgccttccctggcctcacatcagtaggttgaaattggccacagtgggagtatttacaccacagatattggcacacactacgggaatcaggttagttctcccctttactcctgaaagccaactgttaaacattatccagcacactacttcctctgggacagaagttgttaatctttttactgccatggacctttctgacatctgtgaagcctcctgcctcctcaaataatgtttttaaagtcagtgcagttatgaaaatgttaaaagaacaggtttcggatatagctatatgtgtgcttctttaatgacatttgacataacatgatctagtagcaggcctgctctaaattttaagtaataattaacataaactatattttgagatatctacaaaaccataatgtgatatgaaaatatctatgatttctgctggagacaaagtcatcagcccagctaatactactgtggcttgttggctacattcatgattgaaggagaagatacgtttcaatttaggtgttagtgaaagtaaacatgtaatttatctcctatcaaagtccacccatgccctgaattgtatccatagaccccccttgggaggacattgactccacgttragaactcctgctctgttagaatcctatttcatgtttgcaagcatcagaatgaaccctgctgcctcatattggttatttccaaagtggaggtgagaaggtcttctctagaaaatatagttgtttggactccaacaaatatgtccaaaattcacaaattatgtttctgtttacataataattgctcaagctattgttttcatttaaataagcatttccttattgattattcagctccaacttgtcacatgaatgcccttatttacatcccaaaagggcatgcaggtgtatctcccaagacattttatgggctgctcattcaatttgaaaccttctctctcctgcccattaacatatcagggtttttcccaactgcaagacctaatccaaatctcaccccctctctacagccttctgtggtgcactttggcctctccagtctgtagccttctcttgcagaaccactcttgcaatcttcaagtcactacattcttctgctcctagtgagaatcatgttagaattttctctctccaactgttgccaaatcctttagatttctttttcaactccacctgtcaaatccatccctatctttctgttgccactttctcaattcagagtgtaattcattttcacttagactgttacagcaaactcctaacaggtcatcctaacttcagtgttgtcccctccaattcactccacattctgccatcatagtcatttctccaagacacagatctggtaatttcacacacacacacacacacacacacacacacacacacacaccctccctcctcaagggctgtcaattttatacagataaacatgggtttaaaggctttccctgatctgaagacagcttacatttccatcgttcttcccaaaagactgttccaagaatggtagaattttcactgcaatcttttctcttgtctagaatgccctttcccccagatttccctcttgtggtttatctaatcctacagarctctgttcaagtcttacctcctccacaacaaatatctgtggtccctagacctgcacaagcccccatcacccctgttctcttattgaactttgcttatgaatttatcgttgcctttaagagacactttcatttgtattattttatttgtaaacctcagtatagaagagatggaaatgtatctgtcctgaatattcccacaacatttagaacagggtctttttttaatactttaagttctagggtacatgtgcacaacatgcaggtttgttacataggtatacacgtgccatgttggtgtgctgcaccgattaactcatcatttacattaggtatatctcctaatgctatccctcccccctacccccacccaagggtcttattcagagttcaatagctattattcaatagctgtccaacttacttatttttcagttgaattattctctgattattttgtgtgtatagatttagtttgctccagcaggattttgaattatttctatgaaaggaatctactttgcatgtctctgtattgtcccatagtgctaggcaattgtaggtactcaattaatacttgtggaaatgaattaattatggcatttgataatttttctaactatttttaattcttataaagtttataatttacctaaggaaacatgagcacataatgccaaggactttgcttatcaattaaagtgtaaatggaaacacaacgcaggattcatctccttgtcctttttcaaaattgaaaacaaactagtttcaggctttaataatagcaaatataattaaccaagagattcaaggraattastaagtccattatttctcaaattaaaataaatgttgtggtgctatatagttaaccaaataagtaaccatataacaaatgtactataatgggtattaaattagtgtgtcattggttttgtagggcccgatgatgcacaacaaaaaatagaacctcatcacacagcagtgcttggagaaggtgacagtgtccargyggagaacaaggtaagtatgttattttcctttaactttcttaacatgtactttctactggtttccaagaaaatgcctaaatgttgtggataactgaaagtttttctctcttccttggagaagaaattataccagaagtttatcatgtcttttcattaatttctgctatttctatgggtttattttaaagttttatctttattgattctttatcttcagaaatcatataaagtccctattgtttacccctggaaatttgaatctggaagcaacacatctttgttgtctcttaattttctttctttatacaattgatttattttgtttttagcataagtgaaaatagatcagccctatagaagtagaaatataaatctacatgcatactcacatagagccctttgaaaagratccccaccttggccgggcgcggtggctcacgcctgtaatcgcagcactttgggaggccraggygggcggatcacgatgtcaggaratcgagaccatcctggctaacacggtgaaaccccgtgtccactaaaaatacaaaaaattagccggacatggtggcaggcgcctgtggtcccagctactcgggaggctgaggcagaagaatggcgtgaacccgggaggtggagcttgcagtgagccgagattgcgccactgcactccagctgggcaacacagtgagactccgtctcaaaaaaaaaaaaaaaagaatccccactttgaactgagaggaagataggatgcatttcatagtctttttgtgatgaatccctgctctttaagtaaagtttctgatattttaggagtcttgggaggtttttattcccaartttccargtttctttctcatgtctatttcattcccttgagtaattcagtcaccatgttgtgagtctgtttagtcaatctgactgctttatgtcattcttataaagaggattgaggagaaaattgtgcaaaagctcctgaaaaaaacaaactttgaaaactattttagtgtgtggatgactagtgccgaggcagtcggactgacttctggccttctgaccctgcctgttgttatagaacacagtggatttgaggagttattagatcttagcccacttttctggcagcaatctactgctgctttaatcatctgcagcaccaccatgaactgtgaggtaaacggaagaaaaacctgatgagcactagaaaaatgcatatgtcagggtcagtgccctttaatattagactgagccatatgaaactgcgacttttgaccgacaaaaatgtctattttatatctttcaatccaatacaggaaagaggcatgaaagctacacataggccagaacctactaatatcagaatggtttgtaacattatctggtttaacttggcaacctcagttcttcctataatacacagagagcacattgcagataaggagttggaagctaaaacagaacaccagaaagaagtgatgaagggagtcagaagaacaggtgcagccaacatagaaaagagtcagctgaaaccatcaattcactggcaagcagcactcctggctccagtggcatcgttctgttatgtgcaattctgtaattgttgctgtgtataagcatagcctgagccatcaaaaccttagaaagatttctatgaaaaaattgatattaaaaaatcagcatttaaaggcagcatgtgtcacttatatccacacaatagtagaaagtcccctttagattacagcagaaaagaaattctgaaggtttgaatcttggctttactgcttgttagctgttgtgactttggacacgtttgtaaagccctctgagcttcagtttctttgtctgcaaaattaaaataatactgccaactgcaagtgattgttagaaagaatatttgagattacgtatattacaagtctactccagattgagcatgggggtcagtaaattatgtycaataggccaaatccaaacctttttcataaagttttattggaccacagccacacccattcgtttycatattgtctataggttcttttatccaataacagtggaattgagwagttgtgacaaataaagcctaaaactctctggccctttacagaaaaggtttggtttactacgttgtagatgctcaataatggtaactggaaagtttatgaatccaaatatctmatttgatagtcataccacatrcatgttacctaataaggatttatacagtagacctgaaggcttagggcacataacagtttctacaggtagaagaaggctccaagagaccctgactcactcacrctccaagccagtgttatcctcacttgaacctagcattagcctgaggatttgataaagaaggaagatgtgactgcccagtgccgcgccaatcccatttccactaaactgtggtcaagaatgagaagctgattttttgcctggctttttttctggctctgttcttcctgcacttttactactcttcctttctgtgttctccaccatcacacccatttgactactggttgaccagtagtatgggcagtatctcctatagtggccaatctccaggacaggagaggaggacaaggaagggatgatgcaaaagactacagcttctttctgccccaggtttccctgttccatcttagaactttttcagagttcttagagattggaatcaactccagactactctggacatttaatcctggactggtaccagtcatcccagaatagcttctgtttcaagggctaaggcttcctgtgctgctttgacctactgatggtactctggactttctcttaagatgatggtttccctgatggctccacgatcaggagtactagagtttgatatgaaaggctccatctcacccttaggcttatgtttatagtggtatactattgagaaggtcttaagcctcatggattagcaaactcacccgtagtggaccaaggaagacaatcaatacctcactggctgtcatcaaagccatacttcactgtaacagtgctttttaactggcactattcatggaaaactcattaatataataaagattaacatttgactatatatagcatttgattaaaataaacattgaaagacagaaataaaacaaaacatcctgttaaaactagagaaaacttttttgcttgtttagtgtaaaagttcatgatgaaataaaccactaaatttttaagctgataacagttacttgtttgatcttttcattggcccaagaagtataaacaatgaagtctggtaggaacaaatgcatgcaataagtcatgctaaagcacagtttctttctggtaatttttttcaggtaatatatcactataatcaatgttattgatgcaaaaacatgcccttcgatcagcagtccccaacctttttggcatcagggaccaatttcttggaagacaatttttcctcagatgggggtggctgggaatggtttggggatgcttcaagcgcattacctttattgtgtactttatttctattattattacattgtaatatataatgaaataattctataactcaccataatgtagaatcagtaggagccctgaatttgttttcctgcaactagatggtcccatccggggttgatgggagacagtgacagaaataattctataactcaccataatgtagaatcagtaggagccctgaatttgttttcctgcaactagatggtcccatccggggttgatgggagacagtgacagatcattaggcattagattctcataaggagtttgcaaactaggtccttcacatgtgcagttcacaacaggatttgtgctcctatgagaatccagcaccactgctgatctgacaggaggcagagctggggtggtaattcgagcartggggagtggctgtacatacagatgaagcttcactacctcacctgccactcacctgttgtgcagcccagttcctaacagaccaccaattggtactggtccatggcctgggggttggggacccatgccttagattcatactcagagtcctactgccatcttgagttttatatttatagttgatcaaactgagtagctactcatrgtttagaagttatcaacatattaagtgaaccataaaactttcatctgggctttgatcatttattgttggtatcagcagaactcgagacatatcttggcaaaaatacttatggaataacaagagcaacttaaaaaagtaaattattaagtaaacccagaagagcttaactctgtaccagaaactctgaaaaggtgcaccaaagcaaaagacatggtgccaaaagatggtgaacgttagttggggtgaagtagtaagtggacctctgctacttttgtatgggtttttaaaatcaaatcccataaaggcatttagaaccatgcaaggacttgggttttaaatgggtatttaattctcttggcttttgcatgattttcatcatttgacaccatagacaaagtcatcatagacaaggacttttcaagataacagcaactgagactttcagccacatcatcactgtattttctggaatatctggaaagatgattagatttcaccaaagaaggcaagttaaggaaagaaaatgtcatctaggttcatgtttgcatattttgacagctagttgggttatggataagtaaagtgatggtacataaataaatataggccttgcaatggttaaacagagactttttaaaatgtaaagaagtgatcaaaacatcagctttgatttaaaaagtattaaatgaccccagccctgagattgtagggagtaaatcaagacttttgaagaaaccattctaccctacagtcccatttattttttaagttgaaggcaggaaagggaaacaaatttctgtcatgtcaaatacggtagtttttattaaatacatggaagattaaggaattaattattaattttattgaatccagtaatcttctggaactagtaacattacaataatttctaattaaagagctttgcattaatagaagtatgatatagtataatattgacttacatatttagaaatatgctatattattagaattggggtgaagtttcaaaaattttgaaggcttcattttaaagtgcgtaatcattttggctttgtttattgttttattctaaataagatatacctaaaagaagcctgaaaagagatatataatgttcagttatctattagtgagtaaccacgctaaaatttagtggcttaaaataacaatcatttattatttctccatgtggtggggagttctaatgccggtttctctggggtcactcatgtggctggcaggctgggagctgggctctgctggggctgttgtttagagatgcctgagttctgctctaggtagcccctccatttggctagtttgggattcctcgmgagagggcagtcacaagacagcttcccagagagggagcatttgcttatgggaggagctgtggaaatgaagataggaaagcagaagctggggaatcagagaagtcaccaaccagttaatctggaatgccaagcatattcaggcactaaaatgaggccacaaaagaagtctagtggagaagtctgtagttctgcagcttagtgtctagggatggagctgcggccgttcttagcagaattagcagtcaggaagaagagctggacatggcatgcaggaggatgaggacaagctaaagtctagcagcacctctgactacctgttacaactaaccgccacattgtctcaacttaactaagttaccagggcacaaaacaccacatagaagtgtatctaagtacatatgtaattcacttctgacggaactacagttctccttaatttyaaatcaaacacccatttctaacaaataaaattactgaaaagtgtatatatgtatgatatacgtatgattttgatagataggactcttacaattataacatgtgaattacttaaaatacttagttttatataatgaaatgatctaatgattgttaaaccagaaatgcatttgattacaaaacaattccccaaacacagactttagaaaatatatattttatgtttccttttaacttttaaaattagcaaatttttgtagcaatttgaaaataatacagaaaagcataaagaagaaaataaaatttgctttaattctcattattcagaaataataaatgctaatattttagtatttttaatccatagtatatacataccattttgtgatatttacaaaacttacaagacattatgaacattttattacacacttaaatatttgttgagaaaatgaattttaatagccacttgatagtttttcttataaacatataattatttaaccaacccctcacttttggagaaatgttttcaatttctgctgtgataaatagtgctacgacagtgaaattcccttacactrtatwgctaaaactgtcattactggatcggaggacattagcaatattgggggttttgagtcatattgtcaaattgctctctggaaggattactgcaccagttgaaaatctcccaaacgatatatgaaagtgtatttttccctgtatccatactagcactggatattatggttaatattttttccagtttcaggaaaaaaattgaatccttaattctaagcaaaaacttttagagactttaacgtaataggacccttttggagggaaatttgcttgagcagatgtcccttggatgctctgtttttataaggttccatttagtgcaatatttccggggcatattttacattattagtaataattttcaaaagtaayaaaatcttattttggatttccataactaatcttcccttttaaaaattatatggtaactgagaaatcataaatcccatgataagccatttaatcacatggtttgtcgtgaagatatttccagttaaagaaatcttaatttaagttctccttcttaaatttgagaatgttaatattttggtggcytggacttattcttgagttctacttgctactaaacaacgtaagaaataaacatgtctatattgagtgttgcacagaaaatatttttgaaaattatattcagaattaggaacatcgcctatttggctagcatgtcaatttcaaattgttcacaatttgatcttcraaaataagcctgcttattgtttgatgttttctttgttaactttaggatcccaagagaagccactttgtcttaattgctggggagccattaagagaaccagttatccaacatggtaagaccaaaatgacaatgattttcttggttgattttccttttctttgaaaacagtatacatgtatactattgttgggaagaatagctggttttttttgtcctgtctctccatctataaatctgaggattgtttaatttttctgtcatcagagggaaatatatatgtgatgtttattcatctcttttttttwaaagaaacatttcttagatacctattatgtataggatattgagtttggaactgtgggaagaacaaaaatagtatttttgtattatgtcatagggaattttaacttgaaaaaagagtctacagtctactgggaactttaacatcctttttatctttatcaaaaataaaggtgatttcaatactgtcctgtagtctattgcatttttagtaaaaaatatgaaactcttaggaatagtatttttaagaaaatagttgttattttttgtttatttaaaaaaatgagtagaggtaactgatatagccgaaatagtactatacttagaggcagaaaatcctggcttaagtacccataacgattacttcaactctttgggttttgacttcttcatatcattgttgtttgattaaatgaggaacatctaaaagcaattaaaacccattttattatttagataaatgcttacaaaacataygtccacttcaccaattattaaattcaacgtgcattaaaatcccattgcatttccctgccttgcatgaattcccaggtacacacaatgattgcagataaaccccagctgctcatgaatttaaagaacacggattgctttaaaaatattcttttttgttctactaactacttcagggggaacattaaattgtaccctgccttgcctgtagcatttgacaaccattttgtrcgcatccgatttccattccaaaggtttgtggttcttgtttccttttctctcaactgaaaagcactgcaatattatagtttgtttttctggaaaaagccttcagacaaactgagtagggtcataatctttattcctagtaactaacatttaggtgggaaaaacatgtgtgagatggaagtcttattttaggcaatctcctctgtaccaataatgaaaagcaagagtctaactgaattaggtgacagatcaaaggagtgggactgctcaaagscaccctacactggggtcatgtggatcctctcccagtggcttggaacasagggacactaggtatgcctgcacatacaaactcrgagtaatcagacaaaataaatatgtcccttgaaagttcagttactgagaagcaaagcattttgtttttattttttaacttttaaaaactcagacatttaagtttttcttttacttatgtgtgtttaaaggcagccacaaccatctcttgattgggaacttgcacagatctcatgaattacctaagaccctttctcctcttatcatcgtgtgtccttaattattcatccacagattaagcacaggaaatcatagaatgttaggatagaaaataaccttagccatgatgtagtcatgcctcttttatagatgaggaaaataaaatccrgatattttatttatttacttaatggatgcttgcatagaatttactatttcctagacattggttaaagcactttcctaatgttaatccgtctaaccttcaaaacaaccctatgaggttggtactctcatgcccattttacagatgaagaagcagaaggtcaaaggttcattggcttactcaaggtcacatagctggattcacactcaggctgtctgttttccaaacaccctgcccttctgcctcttaccatgctggtcgtccattgctctgccctgtagcttctctaatggaaagcgattgttagcagtggagctgggactcgaaccctagtctcctgaccccatgtcttatgttcgctccactataccaaagttctacataacaagaggttagacacaccattttatacaagaggggggcttcagaggcttaattagagaagtgatgaaagctataatttgaaagagaattataggtaactatcaaataattttcttgttcacaacccttgtagttgatcaatttaaaaacatgctttctggattcagttttctccttgaagatttgaggagataagcttcatcagttagctttaggggactctaagcttccaatgcttccctgtataacagaggttatacttgtttcctaaagtgtggtccatggaccagcagtatcagcatcacttgggagatagttagaaatgcagaatctcaggcctcactccagacctcctgaatcagaatctgcattttaataagattcccagctgattcatgtgcacgttataaattgagaaacatggcagactaccccagaaagtgtcaaaatggaagcctagaagcacaccattcttacagaaaacagttgggggatgggagtactgctccacaagtcccaaccatagcaaaattatgaggcacaagaatttggtccttgactcagtacctgctcccatcttccaagttgcatttccctttcccctgcgtgtcctttaaaaagttgtcttccccagggtaccctcttgggtttattgtttattctgcatatgttaactctctttttctttcctacctgatatagtccaaacctccatttccagatgaaatttctctcatgagctccagatccatagtttcaacaatgtaccaaaaacctctgcttgggaaaccactttattgtctctagtacttctatgttaaaatactcagaactgggccgggcgcggtggctcatgcctgtaatcccagcactttgggaggtcgaggctggcagatcacttgaggtcaggagtttgagaccagcctggccaacatggtgaaacccaatctctactaaaaatacaaaaatttagccgggcatggtggcacgtgcctgtaatcccagctactggggaggctgaggtgtgagaattacttgaacccgggaggcggaggttgcagtgagccaagatcgcaccactcaccactgcactccagcctgggcgacagagcaagactcggtctcaaaaaaaaaaaaaaaaaaaaaaaaaaaaagwaaagaaaagaaaaacaaaacaaaaaatatccagaactgaacaccttgctccatccaaagcctcccacgtcctgtatctcaaatacccttaacaattccaccattgactcagcctcccaaattagacacctgctcttctaccttgatgccaaagtcttctttaaaaattataaatcatattatrttactccctacttaaccttacagtgattcataatcacctgcaaaagtaggtccaaacttcttcctgtagattgcatccaaagcccagaagggtctggtttcttcctatatttcagatcgccattttttccgcctttgatccctccttccaccactgtacccctatcccctccagtattcctccagcatactaagcctgaacatgcctttcctccgtgtgtgactgctcaaacatcactccctctgtgaatcctttcctggatttctcctcctccccctttctgtgttgattttatagtttttacacttttatccttccatatttcaaacagttttgtaatgatttcttttcatatctgtgtgatagatttgaatccttgaggagagggagtctgccatttatttgtctttcatctttatgtctctagcttctagcacaatgtctgtcatttaatgggcattcagtacataatagataggtaattgaatgaatggatttagatgcctgggtgttttctttctacttgtattctattccccacatcctctccaaagatttcagcatcatcaagacatattatcctgtgtcttccttctgaagatttaaattatagtgatcaccaaatccatgttgatatgataacaatggttaagaagtttgaatatgttattttctctaagcaatacagttgtatattaatcagaatctcccagagaaagccccttagagcaggcagttccataaaaggaatgtcaggaacttctgcaggctggatgaggacatacactgagtgaacaagtctgtcaactgctctaaagacactgtcaatgccatataaaagctggccttgttcatctagcagatcatgggggtgagacagtccagtgcctctctgcccctacaatatatgaagaaaggggaagaaacacacattgcctcctggtagattaggggaggacttcttgtacatttttagcaaaatcygagttcagacccagcaattagacaaaagggtcagcaaactatggtcgatgggctacatctgcccactgcatgtttttgtaaatgaagttttattgggacacagccatacctattcacttttgcattatctatggctgcttttgcactttgatgaaagagttgagtagttgagacagacactgtttgacccacaaaatctaaaatacatactatctagcccttcctagcaaacatttgccaacccctagaaaacttttaaaaaatgatgctcttcgacttgaaatttttataatcttctgtttattgtcaataggtgctgctgattttcaaaaaatgacttagaatcctcaaataagtatacagccttatatgctgcttagacaccaaagctatgataagatttgtcagttctttgtatcagatgggttcaattcttgacatcagctaatgttataaaaataactacaaaaatggttgtaatagaaccaaatctaagactctttttaataaaaaagatcaccattgctggtgagaaacctatactgaatgggtgagatgccattgcatttatctgaagtttcgtctttataatcaataatcatatacaatcctagtcaagaaactcatcttacagtccttggggattgaacactgtgaaaataaacttttactcttyggatgtgcttggattttgttttaaattaagaactacagaaatatatatcatttctagtggtagaggaaaatattgccacccagaactttctgaatgtctctttctgccctaggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattscacactaacgtgataacatggtttttgtaacaataaatgtaggatatttcctggcacatgcaaataaacctaatcattgtttctttaaaaatcagtgtttttcatttgagatacctaagttactaagcttctgtttaaaaagtcgttttgtgtatgtttgcctttttttgcatgtatggatggatgtttttattatttttgtgcatgtgcaggttttaaaaatcatatttgattgctttctgtgtgtcattggcagcagatgcatgagcatctgaggtcccttcttaagcaatcccactgagatacaaaggtcaaagctatgtgctggggtttcatgttacaggttatctgctttaaaataacggcagccctgaacatttgagtcagttcttaaaactgccctgctattggtagggacgcaacaggattacagccaagacttctctgcattttctgccaaaatctgtgtcagatttaagacacatgcttctgcaagcttccatgaaggttgtgcaaaaaagtttcaatccagagttgggttccagctttctgtagctgtaagcattggtggccacaccacctccttacaaagcaamtagaacctgcggcatacrttggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaaggtaggtgagctcaatttttaatgtgatgaagttctttttattggctcatacagaggactttctttgccctcactatttttgaaacaatataaaaatgcagaaccatcctagtagtggactggacaggatatatcctgcatttcttggtgactgttctgtttcttagtcttattaaacttctggccatgagtatttgaaaatgctggggtgggggttggttgttttttgaagttatggtagaacatgagcagtctggaatctttttggatggagaagtttctcctcggttgcatatgcagatggcacagtggttttttaatgaaacattgatttgtttttatgactgataactttgtgggccatttattttcaggtctttgtgagcagcagaggttagtttattcgtttggtaaattgaaaattgcagtgctttctatgaacattttctatctgcttttgcaaattaccaattgctgccatccagaaaaatgttttctcagagagtgtttggttttttcgcttcttgaaaggtgtaaaattcaacactaatcaaatctttggttctgtgagcaagcatcaaatagagcttaacgaacagagagtaatgcaaaaaattaaccagaatgttgctgactgctggaacaatacttagcccaattttatgcatttcatggattatatatattttaagcttctattttgaaaatgattcggatgtaattgttttgactgaagtggtgctaaatcattattgatttaggaacttctggccttgaaaagacaattaaatgtgagtttgagtttttgtagctgttgtttaggacgtgcattttcaacaggggtgatatcgcccccagcaggggaaaattggttcgtggagggatgaaaaagttttacccttttgatacatcacgcacagacgtacatacagtacatatggtatgtagtttaaaatacgttatacattcaaattgcatagggggaaagtgtcttcaaaggctcctggctggtgttggtggcctggcgagggtgggggctgatatttaaaaatgttgaacactgagctggaggtgagtgggaagtcaccttgtctggcagccagcacttttctaacttctcaaattccaaatttacatgggagaaatcacagtgtttggctccattttactgccaccagccttgatattggatctcaaggccagattgtaggtaaatgggaatctgactgtaagcataggtaacaggagaaaacggtctgacttgtttgaagcaagtaagacttttccgactgtccagctttttcgtaagttcatgaaacagaaatcctttagatgtgctgggctcctcgagttttaaaatatttccattttccttgtaaaacatcactttatctgatggtataataaaggagactgaattgttggacataagtcatattctttaggttgctcagctctttcaaagagcacaagcaccaagaatgtctcaggtgtcctgggcactgtgaagttttatttatttatttatttatttatttgagacggagtctcactctgtcacccaggctggagtgtagtgatgcaatctcagctcgctgcaacctctgcctcccgggttcaagtgattcccctgcctcagcctctcgagtagctggaattataggcacgtgccaccatgccgggctaattttttgtatttttagtagagacagggtttcactgtgttagccaggatggtctcgatctcctgacctgatgatctgcccgccttggcctcccatagtgctgggattacaggcgtgagccaccgcgcccggctggcactgtgaagttttaaatgctttgaatgtactgttaatatataaatttgttgaatggagtaacgaaggaaagcagctgaatttgcatgtgacagaaaacaagttgttacacgtggaggatgcagcattatatacttactaatacgattagcaattttttttcagaatatatcagaatttcctttaaaaagtgaagctacatatactgaacttatatccaccctacccctcgctcaattaaattatttctgatatgaaggaaaggattgcctatagctaaacagaagttttggcatagatatgactgagtggtaagggataatgagatatataatattggttatagttttcttttttccccaacttttaagaaaagaaaatctaagaggaaataatgtttctaaatgttaaagttcttcttgttaaaattaaaatgtagtgtgaaaacatattcatggtggtaatggtttagggtggtggtatttgaattttttgtttttttttttttactttttgaaataaaatgttttatttattataagaaattcatggtcttcctcggtacttggtccatatgtatttctttctcctcaccctcccctcttctaaccacctcttttccagaatggatggtgatgccaattttgctcctaggttgtcctccagccacccccagcccagttttcactttctagctttgaagattgtccagttttccagcttagactagcattgcctctacgatagttctaggtatctgtgaagatttttttttttcctgtagcaatcatgaaatagctactagtgctctggacgattgtgcttaatgccatttgggtgtaaggcctcctaatttcattagtcttaccacttgtgyttgcaaggatagctgtttggagtcagcagtgcatggaacatgtgaactgagacaaatctgtttgaaaatctcaacttaagatttcaaatccactgtgtatactatttagctgttaagtttctcagtctaagaagaacacgttttcctctagaaataagcttaacccagtacctatgcatcgttcattaatataatcagattacggcctagatgtggaatttatttctgtttctattttctccagctttttaatacagctcagacagtcatatacagttgtacacgatgtgcactgcacaactctagggtgctccatgcatatagacatatctgtatgtgacagccctaagtacaatgtggtagacactctggacatttggtaaataagtatctacatcctcactcttctctcattcacattggccttctggccagcactatttctggtttatttaataaacaattcttgtcccccagaaattctgtgagtcttctgaagatgctggggaaagccagccttcataaatcttttcaatgtcactaatgaagacatgtcactattgcaacaaaggaataccaggccatagtaggctttcacaacttttttctgacagaatttgtttctttctgctttatcttccctgtgtactgtctttttttatccaccctctttcttaattacactggtagaagaatattggtgggtgatggagtcattcacattctgtgtaagactagaatcagtccaagatccacaggaatgtgggatacttctttcatgagaagccacatggctcacaagacttctttacatttgtgttacttgccttctcctgaaattgtctctacagtgaatcaaataacaaggactgaggtgtattttccatatttaattccaggaagcagtcccactccttctccctgcccgatttccagttccaaagtcatgtacagggaagtccattgactttgatgttggtcaaatggcccagcaagcttttgtccacttttctgtcagacacagtccttggcacaaaagacatctgaaatacttcccattaatttcttctttatttatgaccttgtagttaagtgtgttgaattatatgcttctatacacatctgttttaatccagttactcacttataactggtgactgaaacttttatatcactatagcgtattattggtacccaggatacaatagaatcctcaatatcttacatcttcaatatagtacttccttgtatgacttatttcttaacataaaaatcctgttttagacctgtggataaacctttactataaatcccagagacaatttctggaatgagaatatagtatttgtccacacacatgattccatgtagaacttggggtaataagatctgggactcccagatacatttattattaccacaattggatagaggtgctacagaaataggcacacaaatgacagtaaaattgtttctgagaacatttctaggctcaacttttttctacaacttaggatgaacagagagagtggaaactgtatataattgggaatgtgactgagatgagacaaagatgacatggaagcatttcttcttcccttgcttttctggtggtaagttcactcttctgtcttccttgccactagttcttgcagtccctaccaagacactagggcattatacagcaaacacaccctgaggccccctgctactgcatcatgaaagccttagctggttgtgatgtcctagttcataaagaatctgcctagtctctcattagagctttccaatatttgacaattcattcatttatttttttcaacaggtatttattgggcaccaatatatctaggcattgatctaggggctgggaatgaagcaggaaataagtctaggggctgggaatgcagcaggaaataagacaatgtttcaattctcttggaatttgcattccaagtgtgatgggtagaggcagacaatatgcaaatgtgtaacatgtcaggtgtgataaatgctatgaagaaaatcaagtagggggagcggatacagtactgaataaatcagaggagacctttctgattcagttatgtctctacagagtcctgaaggtaataagagagacagaggcaaccatcagtgcagtggccatggtgggcgcagcaagttggcttcgatgtctgggtattagccagggagccggtgcagctggaggtggggtgagtggaggccagaagtgcagttgttgaggttggagaagtagccagagaagatcatgtaaggtgtgactgtgctcccataaaactttatggacactaaaaattgaattttatgtaattttcctgcatcatgaaattaaaaaaaaaa

SEQ ID NO: 12169 - DNA, 209822 bp, Homo sapiens
  misc_feature (1)...(209822): n = A,T,C or G, or insertion/deletion polymorphism (see Tables 1-2)
acatccaacatttaatgatttaaaaagaaaagcctggtaactagagtggaaggaagcttccttaatcagagcagctgtgaaaaatatatgggaaaaaatcttatttagtggtaaaacttttcaaacattcacattaaaatttagaagtaagttaaaagatgtctagcccctaccttctgtatcgtattagagggcctaaccattgcagtaaaacaaggggctaaacagtttaagacgtaggaaaaaaatctgaactcactaataaatctcgacatctctaaaagtgggacagtatgtatatgccttctgctatgatgcaaggaagtacctatgaagtattcttgcaaaagcaaacaaaaaaccaaaaactaatcaagcctctagatgtcactggcagtttctggaacaaattaagcatcaccatgaagatgtaatcagcagaatcatgaagtgggaaattctataggaccaatgacttagattcttcaacaaatggcaggggggaagaaatggagagggaattgtcatgtgaactaaatgcaatgtgacaatcttgttggatcctgattttaactaactgtggaaggaagggcatttttgagacagaaaactgaacatggaacaggtatcagatgatattaaggaattattaattttgttgggtatgataatgggattatcagtatgttttttaaaaataagaaaaggcaggctaggtgcagtggctcatgcctgtaatcccagcattttgggaggctgaaacggatggatcacaaggtcaagagatcgagaccatcctggccaacatggtgaaaccccatctctactaaaaaaatacaaaaagtagctgggcgtggtggcgcgcgcctgtagtcccagctactcgggaggctgaggcagaagaatcgcttgaacccaggaggcagaggttgcagtgatcacgccactgcactccagcctggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttcaagactagcctggccagcttggtgaaaccctatctctactaaaaatacaaaaattagctgggcatggtggcaggcacctgtaattccagctacttgggaggctgaggcaggagaatcgcttgattgtgggaggcagaagttgcagtgagccgagctcacgccattgcactccagcctgggtgacagagagagactccgtctcaaaaaaaaaaaaaaattctgggaaaaacacagaacaaaatgaaaaaagttgtggagaggagaggtaggatagataaaacaagaatggcaaattgtttaagctgaagctggatgataggaacacagggatttattatatcatctcttgtatttgtttgaaaattttcatactaagtttattttacaaattaaaacattaaataaaatagaatttaaaaggttggtgtttgcataatgttctgctaaataaaaaatcctaaagaactttagacaaatttttttaaagtcatttttattttatcacatactagtttccatctaccataatatgatttttttttttagagacagaatcttgctatattgcccaggctagccttgaacacctgggttcaagcaatcctcctgcctcagcctctcaagaagctgggattacaggtgtgtaccactgttcctggcacagacaaaatactagaataacagaattcaacaaggtttttggtacaagattgctgtacaaaaatccacagtgttgctataccccaataatagccaaatagaaaaaaaaagatgtgaaaaacaaaactataaaactatgaaaatgaaaatgaaaatcttagtgacctcaggagagggaaggatttcttaagaaagctacaagtcagctatcataacaacagattgataaatttgactacattgaaattaaaatctagagaacaaatcaccgtaaacaaagacgacaagtgtcaacctgggagaaggtatttataacatataccaagcgttaacttaaaaaagcccaacaatgggctgggtgcggtggctcatgcctgtaatcccagcactttgggaggctgaggcagaaggatagcttgagcctaggagtttgagaccagcccgggcaacaaagcgagactctgtctctctctctcttttaaaaatgtatatattaaaaagccccacaatgaataaatttagaaaagaaggggagactttatggcctgcaaggtggccatcctgcaggctgggaagcgtgcctccagaaacaggcgctttgaaggaggagggcttggagtgtagttcaggctgaacaggttggctaaacctacattttcaccaggttacaggaagagctatgaatattcatgaaagtggtcctgacacatgcgtattgaacaaaaactcatgtaacatatgacccatattcactttgggatggagacttaacttttttgttgttgttgttcagacggagtcttgctctgtcacccaggctggactgcaacgatgtgatctcagctcactgtaacctccacttcccggtttcaagcgatactcctgcctcagcctcctgagtagctgggattacaggaacctgcccccacgcctggctaattttcgtatttttagtagagatggggtttccccatgttggccaggctggtctcaagctcctgacctcgtgatcttcccacctgggcctcccaaagtgctgggattacaggcgtgagccaccacacccagccaagacttaacatttaaatgtattacgagccctatacgtcaaaaggtctttcaggacatgaagccatgcaaatgtgcgacctctgtagaccagccagaaccagtccatggccagtggtcttcttacctggagaaagttactgaaatcaacaaaaagttgtccaatgaaagctgtagctatggctggtggaacggggactgggggtcagtaagtcagcatctcgtggagctgcacattattttaatattgtttatctttaggccagtacttgtttagctgctagagaagaatcttgtggcagttagaacacagtttattctttaagtataggggtgtgggactaaaaccttgcctggaatggctttaggtcttttttataatttggcatcttattgccagagtctgttctgtcagtcttatcatctctgttttaacattaatgctggccagttgttgtgttaaactacaaaagggagggagtataacaaggtgtgtctaacctgtcccatcgtggtctagaactcagttttaaggttttctaggatccccttggccacaagggggcctattctgttggtggcggacttaggagtttagttttactttatacaggtgaatgaatagagcaggctatctaatgacgtacacatcatttgtgaaagaaaactccatagcaaactttataaaaggtaagagtggacagttcacagaagaggaaataaggtttcataagtatggaagaatgcaccactttgttagggaaatgtaaattgcaattttcacagcggtaaaaatggtaagagtctgaccatatcttgtgttggagagaatgtggaacaaagagaactcatcaatgctagtgagggtgtaaactgataaaatagtacatacattatttaagacattcttgaggctgggtgcggtggctcacgcctgtaatctcaacagtttgggaggcagaggcgggcggactgcttgaattcagaagttttgagaccagcctgggcaacatggtgaaatcctgtctctacaaaaaatacaaaaattagtcgggtgtggtggtgggttcccgtagtctcagctattgtggggagaggcatgaggatcgcttaaacctgggaggtcaagctgcagtgagctgagatggctccactgcaatccagcctaggggacaaagtgagcccctgtctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgaatttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgyggcaraagtagtttgtctttamtaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctytcacaggctggatgaagattggggtgagtgggatctgagaatgtaccagkgtggctcgggttygcgtctaaaggtttcttcctccctacttccgcccactcgtggtgacaggtgtggaccaaccctgcctggggagtgaggcccctcgtcactcctgttcgtgyccctggaagagtctgggagtatcgttcggcttctgtcctggccacagggagagtagaatattgtctaactggagttaactgtcgtttttcactattcccrctggggaagtaccgggtgatctttttgtgtggctaacactggacgtctttaggaggtttagagcaaaatggctgggaccgccaaaaaggctacargctatttcctgagtgtgaaatgtgggcggtgagcacaatggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctracagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtmggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtgtgcaggtttttgtgtggacatgcattttccaattgtttgggtraatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttstgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgattcctggatcactctctttcacttttytttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagrttttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgtttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcytgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaacygggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagytagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgarccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagraaaaraagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgntgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggrtatgaggagtttcatagttatgtttcagtagtgtaatgaatgaacagttcatatcagaaatagaaatagtgattttgaattatgaataatgtctctgtataagattaacctgagaaccagacagggcttagggaatsaaagggaagagcctgggttaccagaacctargaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctaccyctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttgrtgaccttagcttccatatctgattgaattttaaaagtagattttaccttctttcttgttcattttattataagtttttattgtccagtgggtaaaacctttcctccatgttttccagttaaagatattaaggcagaaccycagccactttctccagcctcctcaagttattcagtctcrtctcctcggtcagtggrctcttattcttcaactcagcatgttcctgtgagtagccagtcttttacaatgattttgsttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtacgttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtwaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtgrtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatakatacagtttctaatatacctttcctttgaagttaccytgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcascggagccactgaaggaagataagcctgtcactggtyctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagatatgggagtcatttccgtatggagatctcttaggtagwttagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatrtgtttctaatttttatttgcgtatttggcctaagcatrtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcasccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtstaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgtyttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtcttttttttttttttttttttttygtcctttttagggatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacrttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtrtggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcatttgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcttttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacraagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagwtctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgttttaattttaaaacttaaaatctgaaaatgggagctggaatgggagcaggtattttcctttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgaygtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccycccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagwctaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttaraaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagaggtaagtgttagtaatasggctgagtcgagatgggctaaagtatyctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttckcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcytgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagaygyagaaagctgaatttggcaattatcaggtcagttgtaatcttggaaagcagatttagtaggggtaggcatgaagtctgtattaaaattggttgagaaattgaaaggagttaaaattgaataatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaarctaaatgggagagacgcatagggtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccatttttttttttttttttttgagatggagtctcagtctgttccccaggctggagtgcagtggtgygatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagactttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatcyagcaacatatcaaaaagcttatccaccatgatcaagtgggcttcatccctgggatgcaaggctggttcaacatacacaaatcaataaatgtaatccagcatataaacagaaccaaagacaaaaaccacatrrttatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcraaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcstgraaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacktattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaagktaaccacggagcatatggcattgagtttgagtcatgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgkctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacrtaatttcagctttttgtgtgtggctctccaagycacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaaygtaaataagataatttttgtgaagctcattgaatgcgtctgagctccttaactcaaaaaaggctaaaagttactgaaatagctatggttaagggtatattgtcatyacaatgtgataatcattaccaaagtgggcactkggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgayctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgttkataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcraacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaawttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatrtgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtmcttgacwaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacmcacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagayatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaayacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatycatttctatgtttaattaatttctatgtttaattaattaaactatattttawaggttaaatcatgaacttcgaggatgggttcatagacatgaagtagaaaggaccaagtcwagaagaatgacaaataatcaacagaaaacccgtattcttcaggtatgtttctgtttgtctttgaacaatagttggcgtatttgttggaaggcttctcccagctgggttactctcttccctagaagkttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacrccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtgraaggggtgcttggtattctttawtcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatataktgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtartatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcayggtacataagtgccccccaaaatggtaaatgrtaatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcrtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacwtataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttrcaaaataktgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtgraacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggygggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctrtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtarccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcrtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaaygaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagargcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacaraatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacmgctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttygaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtakgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctrtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcmtaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcayccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaawcattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaacygtatataccattgaagatgttttgggtataaaagggaatttccataataattacatagtaatcttttakagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacayagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctrtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataatraacttaggaactggtgttacaatayggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtcttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaattttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatakaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttrtttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtggtaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccrcccttctttatctacctcttttcatctttccaacttccagaccttttttttctgctgataactcataccttttaattaaactttaatttaatttaatttaatttagtttcttccaactckgctctccaccacttccttgcccctagcacacacacaattaatcagcacttacaaaaacaaaaatttacctctttacaaaaggtacaggsatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgattctgatatgtatctttygttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgwcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacratttaattggagggaaaraaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattrtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatrtaacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcraaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttytaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctccygagcasctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccragtagctgggactacaggygcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagytgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctctttttttttttttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcacgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattasaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtrtctcttgtaacggaataccaagtaattcttgactgatgaatttcattttctttcctttttgttagatactaccagcsccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttttcattaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatrtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtcwgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatygttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcytcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccayttttgatccatctgccaatcctattaactttaccttcaaaatggactccaaatccaaccacttctcatcagatctrtcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgyaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggstatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccactcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttttttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccrcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaatyctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctrtaacttattttctttattttctgtatccaccctctcactctctttttttataagaattaagctccatgaggacaggatttttttttcygttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattgrtagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggagraaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggyggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaaygcagattagtgaacgtggattcctgctgagggagtgcatcccataatatggcaataattttcagtttctccaacgaaaagatagtgaaggaattaaatcttttgtcctcccatggttaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactcccyttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggractgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttrccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaratgaggggacaggattctcctaagggtagagtttcaggaaatgagtgaaaggcaattgacaaatgcaaagaagtagtcactttttaaattgcyggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttkgggctgacaataatacactcttgrgaagtgatggtagagactgatgggaatagtctttctgcctggttgcaagtcccaaatttttaaggsttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaartctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaarcttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcrgccatttgttctaatatstgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaacttaccttgtttattctgtatgtagaaagagagaaaaaagcccccaaatgaatcttcagtgttggggggttagtaatgggaaaggaagcctgaaaaggctttgtggcttgtgttactgttcagatgaaactgttgaactattttccactcttctcccaagcctaattaagtaaaaatttcctttatttaagtgtccagatatttaaactacaatcttatcaaggaaaaaaaaatctaaaaacccatattttatctatgtcttcaggaaagtgggttactcggtcacgcatcttgtcctcaccaaaggcctcttcccagcttgcaatggcaaatgccaccacacctgaagctagtcactgcagactgacagcaagggatccatccaggagtaattaatgcaggcatttactgagcacccaatgattacctctgacactggtttattaactatattatcttatttcaatcgtctctacatcctattttgtaagatggttattaataagtagtggagctggctgggtgcagtggctcacgcctgtaatcctagcactctgggaggccaaggcaggtggatcacctgagctcaggagtttgagaccagcctaagcaaaatggtgaaaccctgtctctacaaaaaatacaaaaattagccaggcatggtggcaggtgcctgtaatcccagctacaagctacatggggagctgaagtgggaggatcacttgaacccaggaggcggaggttgcaatgagccaagatcacatcactgcactcctgcctgggtgacagagtgagaccctgtctcaaaaataaaaattaaaaaatagtggcccaatatttgggcccaggcaattatgtgaattattcaccattatattattccacctgctgatacatagatctggcataagttcatgccctaaaagagctcacagtcagcccatggagccatatacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaaagagaaatgggaccaaggaatagggctggagactaaagcccccaaggggagtgtcatgaaaagaccccctggtggcaggagggcaaaggacttttacaaactgtgatgctgaaatgcaaatcctcttcattgccccaactcttcagtaaaagcagatacacagttttgtatcaatgttgccttgggagtgagagactgaaggtaggactcaacatgatattactagtgaagaagaagacagcacagcaagataattcatacactgaagtgtcagtggacgtcaggtgaaacagggaaataaaaacttccaaccccccaccccgcccccacaatctttatggcattgtcccctgggacttctcactctatgtgggatatggttcaagccaatttttgaatctcaaagggtaaccacaaatgacatttgggttatataatacatggtatcatagatagagggcctctttagcatttaccctgtaatttacctaactggtccaattttggtagagatttaaatcacttccaatgttttgctcaccataggaaacctatcgcatatttcactccgtcgtattcattcggcatgatctgtgcaaatgcctgaagagaatcgttctcttagttcagttcagagtaggagctgatgcttattgaggacttaaccttccagacatcatgctaagcctttacaagcattagctcatttgaactttgcagcaagccttcatcatcgacataataatacctatgtctgtgaattacagatgaagaaatagtcacaagagattaagtaacttgcccaggatctcacaactagtacatagcagagttgagatttgaaatgaagtctgtcatgattttaaagccacattccttctactatgctacattgtcattcatcctttgaagtcataaagagacaaatgagtgaggaagaaaccaagccacacaacacaggcaaccagggtattgaggcatgttcaggaaagagggagagtcgctaagaggcaaggtccagcagtactcgagggttttctatgagtgactcagaaggcatacactcgatgctggctgcatgcagagcccatgctgggctgctgcaccaattcttctagacctcagtccttgtagtccccatcttggacgagttacccagtggggtggatacaagctggctcctccataattgaagatcctaggctctcctaactctcctactctactcatatccaaaagcccacccaagtgtggcatccagctccatcccaggatgtatccactgttttccctgtgatcacaagttctatagaaagttttcactgcagaattaactgctgatgtggatgctggactatgaaatagagatgcttgtgtaagagatcactaatctgcagacccaaaattgaaatggtttgtttcagaagtgaaggatatatctttaaaataaatacaacacaccatattaataaatggatcatcttgtaagattgagtgcagcagtgtcagtcctaaaagctgtatccatttggaaggcggaccttgcaaggctaacagaaaatactgttgccaattgtttacagtacagcccatatttctgcaaacatcaactgggtacaaaggaagaactgagaacctcaaaagccatctcagatgctccttccctaggtgtcctgcttgacttctgaagcctccgagttatctccatttcctgagcacccaatggagcttcgattcttgggctgcatttcttcatagtgggctagaggcaatggccctggaatttaaacatttgccactagttctaagtgttgtgcgaagctccaacatctaccatggagctgtaggaaaccatacagatgaactagacaacatccttgacatgtcctttacatgtctagacacatgagttatgtctcttccatgggactatgtggtcacccttctgtccccacagaagagtaaagatcatttccaggtgagggtaagatttctggtcagcctgaaaaagaaagttcagttggacacaagctactctcaggagagtttgggggtgggaggttcatggccagcatctttgccatgggcacagatctcacccactcacttggctgctggccccaggacatcaaatgatccatttcgccatattgtctctggtttcctggagttgctggaattcttctctgctaagccattcgttcacatgagatcgacatgttgtccccttccgcctggcaacctttaggaagacggaattacagcaacccccacacatccaactaggctgtctccatcaaatcaccagctagggggaacaggaaattcgtcttaatttagacaatatgagcaggaaagatgctgaaacacttaatctcttgttttaaatgactctacaggtcaccacccaggggagcacaactagaagcacattgcaagtagcagcacggttggggccgattccatcttcccaggatttatcatctggtacaaggcagcagggctcaaatagtccaaggaaggaaaaggccactcatagaaagattgtttttgttgccatagcagcatcttgtacttatcccttcctaactcccatcgcctttgcaattaccaggtaaacatttatcatccctgtgggacagtgagctccagaagagcaggaaccctactaatgtcttgaattcgatttttttcctccaaaagtgctgtggatatagtgtgcttgggacatggtggtttgggcattttaggctaaatcaggatttcgttgaattattgagcatttagaaagccacaaatatacactgtccttccaggagtctgcatgatagactggcatttgtcacactgcactagctaccgcaccctattcagatattcacagggcacagaagttgcagtatgtgcgatgcccagtgctgaggcaggactgcaagggaaaacagcagagatccctgccttcccttaaaagatgaggcatcatttgttttcctcttccccttttcttttcttttttttttttttttgagatgaggtctcgctctgttgcccaggctggagtgcagtggcgcgatctcggctcactgcaagctctgcgtctggggttcacgccattctcctgcctcagcctcccaagcagctgggactacaggcgcccgccaccacgccctgctaattttttgtatttttagtagcaacggggtttcaccatgttagccaagatggtctcgatctcctgacctcatgatccatccgccttggcctcccaaagtgctgggattacaggtgtgagccaccgggcccagccttccccttttcttttcatcctattgctttttcctctggcttcagtctgtggcatattagaaatgggcctggaaagaggatgtaaaccagcgagtctgcaagcggggccctgagactgcagcagcacctcaaaacttgttagaaatgcaacttttctggtcccaacccagacccattgagtcagactccaaggccgggcctagcaccctgtgtttcaacaagttccccagatgactctgagaggggactgagaaacacccgtgtagttccctgtcagcaagactggagaatgggaagatgcagactcctgccagagatgaaccttcccctggctgctgatgttggggtgggtggtaatatcaggatcacctgatgtcaggagttcaagaccagcctggccaacatggtggaaccccgtctctactaaaatactaaaattagccaggcttggtggtgcgcgcctgtaatcccagccacttggtaggctgaggcaagagaattgcttgagcctgggaggcggaggttgcagtgagtggagatcgtgccactgcactccagcctgggcgacagagctagccagaatctgtctccattaaaagaaaaaaaaagcaaagaaagaaaaagaaagaattgtgtgtgtgtgctgcatttttggaagtccacaggggttacatcttcagcatccacagcctccatccctgctgctgccaccctgggtggctgcactcccagctgagaggcctgaatcaggcctgtggatatagtgtgcttgggacatggtggtttgggcattttaggtgaaatccaggttttgttgaattattgagcatttagaaagccacaaatatacactgtccttccaggaatgtgcatgatagactggcatttgtcacactgcactagctaccacaccctatgcaaaaagaaaaagaaaaaaagaattgattaaggaatcagatgcatgcactcagccaagtcagccaccatccaggctcgggggatgcatccaggacgagaggcggaaccggctgcttgctccccaacaggtccacagctctcctgggcactgaactcctgggagcccctgcttcgaaccagcaccctttgctgtgggagggggccgtcagcctccctggagcaggtcttcactaggtggctgggagaacccccagcgctgggcaggggcaccccagagagaatgctcgtggcccctccttcgcagctctgaaggcaaggtgtgtgccccaggctccatgggcagagttggctaaaggctggaatccccttcacttcagccctagcttggtggttctcaaactttgctgcactttggaaccacctggggacctttaacaaatactggtgcgtggctcccacccccagacattctgactgaattggtagagggtgtgacctgggcataggagtgtgaacatttccccaggtgattctaatgtgcagaaaagcttgggaaccaatggacgctgtcttttgaggtctagttctgatgtttatggagcaacaccatcctagaggttgagggtgg

SEQ ID NO: 12170 - DNA, 16220 bp, Homo sapiens
tgaacccaggaggcagaggttgaagtgagccgagatcgcactactgcactccagcctgggtgatagagcgagactccgtctcaaaaaaaaaaaaaagaggtagccgggtatggtggctctcgcctgtaattccagcactttggcaggcagagtgaggtgggaggctcacttgagtccaggagttggataccagcctggtctggtatcaaagggagacccggtttctacaaaaaattttaaaattagccaggcatggtggtgcatgcctgtggtcccagctactccggaggctcatgtgggaggatcgcttgagcccagcaggtcaaggctgcagtgaaccatgatcgtgccactccagcctggacaacagagcaagaccctgtctcaaaaaaaaaaaaaaaaaaaaaagagagagagacagaagacagatatttttaaatgctcttctaaacacacacacacacaaacacacgcacacaattggctatagaattgccagtttgcaactcccctgactttacacgttgttttccctgtgacgtcttacctacttccagtttcaattaccagctacaactcggacctctcagattctggacattagtccagacctttcccaatctcagtccccacatgcccctcggtccccctaggccgctcatatgcacagattcccacattgcactcagcgacatttcccaaacctgcttgccctcctgagctctccatctcagggacagccccactgtgtcccagtcagcagaccatacgtcccggagccatccaccgatggcggcaccccctctctccctcatcaccctcatcaagccccaagctctgccttcctgccccctgagtctttgccccatgccctcctctctgtgtcccgaaagccctgacctggctcaggccactacccctcccgctcagacgctctctacagcctcctcccgagctcctgttcatcctctcccagccccagaaagtttttccacacccagagccaaccccactgctgcggtgatgccccagctcccaaggacaagatcccagccccttagggtggcctctgacaccctgcaagctctggccctgccctcctctgcagcctcttctctcatgacagtgctccctgcaccctgaactttgattcatattcaagccaaaccatatggtccttagcaaggactttgcacatgctgttcaaatcacttttttctttctttctttctttttttttttttttttgagatggagtcttgctctgtcacccaggctggagtgcagtgatgtgatctctgctcatagtagcctccgtctcccaggtttaagtgattctcctgcctcctgagtagctgggattacaggcatgcgccaatacgcccagttaatttttgtatttttagtagagatagggttgcaccatgttagccaagctggtctcgaactcctgacttaggtgatccacccgcctcggcctcccagattgttgggatgacaggcgtgagccaccatgcccggccccaaatcgctttccatgggcctctctccagctcactttcaaatgtcacctcactagccactcttcctccctccagaaaccattagtgacattttgtgtcccctcccagtcttaagcaaacacctcctcccagctctcacagagcccagtggctcgtctttgggagctgcaaccccttgccttactataattatcttctgcgtttcttcctcctcaggccagaccagagtttcctaaattgtcttgaccacactgacctatcagtaaaaaggttttgagcactcacgtccaacaagcgcatatctgtttatttatccatcatttacaagccatactgcactaatatatagtcataacaaaatacacactgaagtaggaatgtggatacttcccgcaccccaaaaactgtcttgaaaaacaactagagggctgggcgcggtggctcacacctgtaatcccagtactttggaaagccaaggcaggtgcattgcctgagatcaagagttcaagaccaacctgggcaacagggtgaaatcccgtctctactaaaatacaaaaaattagctgggcatggtggtaggcacctgtaatcccagctactagggaggctgaggcatgagaactgcttgaacccaggaggtggatgttgcagtgagctgatatcgcaacactgcactccagcctgggcgacagagccagactctgtctcaaaaaaacaaaaaacaaaaaactagaaagcctgggccaggtgcggtggctcacacctgtaatcctagcgctttgggaggccgaggccggcggatcatgaggtcaggagatcgagaccatctggctaacacggtgcaaccccgtctctactaaaaaaaaaatacaaaaaattggcccagcgcgatggctcacgcctgtaatcccagtactttgaggggctgaggcgggcggatcacaaggtcaggagatcgagatcatcctggccaacacggtgaaaccccgtctctactaaaatacaaaaaattagccgggcgtggtggcgggcgcctgtagtcccagctactcgggaggctgaggcaggaaaacggcgtgaacccgggaggcggagcttgcagtgagccgagatcgcgccactgcactccagcctgggggacagagcgagacaccgtctcaaaaaaaaaaaaaaaaaaaaaactagaaagcctggatccgcttgagaggccgtcactgaagggcgggagctcctcgcggacgcacacaccctatctagctcaattggtgtccccggccaccaagacagggcccgcccgcggtaataattgccacctcccagtgggagctgcagatatttcccagcgtcctgtgctgggcgctgtgccaggaatatcacaagcattaacttgtttaattctcataataaccccaggagatcaagcctcttttgatgctcagatgagaaacgggacccagagaggtgaaatgatttgcccgaagccacacagcacgtgtcccaggggaaattggaaccctggcagggccgttgaattaggctaaagggaccttgggagcgctgagtgagggtttcttgcatggatggatgaatgaatgaatgaatgaatgaatgaatgaaacagaaatacccaaaagggaaagacagagacacagaaagtgacacgaagagacagaagcacatagaagagacatcggggaggaaagaagcagaaccgagccctggagcgtctacactgaccctgagcgggagaatggcgaatggggaatgaggggtgtctacacagacccaaacgctcctagagggagagcgtcggcaaggaacgcccttgggaaggtccccgagtccaggaatggggaaggagcagggctggggcgtgrccatccgcgggcggggtcagcgggccgcggaccctctggggtcagtccaggggcgaactcctcaccccggatctgtggagtcaactatgaacgtcgtgcaggtcttcttcttgaagatcttggggatccagctctggggacaggaacaaatgtaggggtggaagtggggtgagagggcacccagttctgtcctatgggacacagagccacccaccccgtgcgctccccacggacacaggagtccgggcccccagcgccctcccgctccagactcaggagtctcgacccccatgccctggaccctggaacctggaccctcccatccccctcctccgtctgacccaggaatctgggtgtccagcgccctcctctctgggagcctggaggcgaggtccccagctccgcgctcccgcagaccctggtccggcgctcacctgctccttctccggcaccaccatgctgccgcggccgccgcaacctcctgcagcccagggccccggcgctccctccgccggctctgcttccagacccgcccagagcaaaccggatcctccactttccagcctagcctggggcggggcgaggtctggggggcggggagtcttggagacgccaaagcgggaggcggggagagggcgggtcccaggccgcgataaggggacagagggacagcgacctggggggtgcagaggcccgggccggggggagagagacacacaggggagactccaagggcaagcgcgagatgggaacagaaggagttgggggccagtggcggagagggaacagactcagaaaggaggatgccagacagggaggggacaatttaacccaaagagggggagacaaagacttaggggacagagaatcagaaggtggggcagcagggacccagggatagacagagagagagggggacagagacccacagagagagggggacagagacccagggagaggggacagagacccagagagagtgggacagagacccagagagagtgggacagagacccacagagagagggggacagagacccagggagaggaggacagagacccagagagggggggacagagacccagagagggggggacagagacccagggagggggggacagagacccagggagaggggacagagacccacggagagggggacagagacccagggagaggggacagagacccagagagagggggacagagacccagagagagggggacagagacccagagagacggggacagagacccagagagagggggacagagacccagagagaggggaacagagacccagagagagaggaggacagagacccagagagagggggacagagacccagagagacggggacagagacccagagagagggggacagagacccagagagaggggaacagagacccagagagagagggggacagagacccacagagagaggggacagagacccagagagagggggacagagatcccagagagagggggacagagacccagggagagggggacagagacccagagagagggggacagagacccagggagaggtggacagagactctgagacagagggggacagagactctgagagagagtggggacagagacccagagaggtggatgccagagatggggaggagacaccttgactgaggcaaggggcagagggggatgcaaaaaccaaagaattgggggaagggcaggaactcagaaaggaggggccagagatttaggggagagagagggacacagacttgggggaggactgacactaagataagagtgggacagaagcccagagtgagagggagaggcaatcccatggaggagggacagggaccctgagagagcagatgacagaattgaagagagaggaggacccgtgaacaggaaaggagaccctagtgggggcagtcatgaagggtgaggagtaggaaatactgacacacagagacgggcaaggccacttgtctcctgccagccctctgtgatggggacagctgtggcctccgtaacctgagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccrtcccaggrgtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacrcttctgtcctctgggctggggtggccagcctgctcctcccccyggccatgacccagcagctcagaggggatgggctrggcttcagaaaccggaacaacarcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtckccaaggaatatgggcacctactcccaggccacaggtcccaagaccacaaagtcggagatgagggtgtctcaggtgaggaggtctttgcagagcatggtgggcaggcccgtgggcacagaggccaygggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttyggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcraggaggaaagcggtgaggacacaggtaagtggcctgggctggtgtgggtgggaaggaaccgagtcagcctgggtcactgctgccctcctgtccccgcaggtccacaggatgctcaggagtatgggaactaccagccagggtccctgtgtggctactgctccttctgcaatgtatgtccccagcccagatccacccaccaaggtgtccccagaatctgtcccaggggccctggggtggtgctgtgggagggctcagagcaagggcaggccagggtcagttctgaaagaaaagagatccttctgcaggcatgtgaggtgaggacagactgatgaaggctgggaggctggggcagtggtccaggaaggagaggacaagacccaagctgcatcttggggtgtggggacagagacaggggtctgtggcaaagagagtcgggggaaggagggatggcacaggggctgataggctagggggagaataggcagagagcgggtggagagagcacctgagcccaccctgacagggagacatggggtcgccctgagatagaaaaccaggggcagggccgggtgtggtggctcacgcctgtaatctcagcactttaagaggccagggtgggcggaacacgaggtcaggagatcgagaccatcctggctaacacggtgaaaccccatttctactaaaaaatacaaaaaaattagccgggcatggtggcacgcacctgtaatcccagctactcaggaggccgaggcaggagaatcgcttgaacccgggagacggaggttgcagtgagctgaggttgcgccactgcactccagcctgggcgacagagagagactccgcctcaagaaaaaaaaggaaaaaaagggaaaggaaggaaaccaggggcaggggaggggaggggaggctggtttggggggcagatacagagctcagtgttagagataaagagggtagagtctggggaagcgtccagggtgcaggggtgggccaggggcgggtacctcccaagtggcgttagagtttccatctaaccaggctcccccggtccccagcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggwaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttggaagaaggaattagggaaaaggaggtggagctagcactaatctcgcacgctatactgagtggctgcctaattttgctcgtgcagtacccctcaagcctcttttctctgctgtcccacaggaagctacgttgactatttctcctcgtccctttatcagtaagtgtgtaaaaggggagcgtgtaaaagccccgtttagagaagtgcttgtctcgctatgagttatcagatgactctgggactccatttccccgtccatgaaatgggcaggttaatgatctctaagcgtcctggggtgggctttgaacaccagctgtctaacttctggcgttctcgtctccagggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggctcgaggtggttggttgaacagccccccccccccccgcaaaaaaaaaatcagtcaacaaggaagctttttgaaacagttctctttacccgtgatcactgagtgacgcctggggcggggaggccgaccgagagtcgggggcgagggctcccccaccgtccccctgcccccacgccacgtcgcccagcggmatcgtggaaagaggattctcccatgcaaaccccggagccagaggagaaggggaagcgccattctgcgccccctacccccggggcacggacacggccacagcacggggggcggtgaggccccggggacacgagacacgggggagggagaggggamcccgcccgcagatgacccgggggaccggcgaccggacgcggcggggcggagctgagtggcacagggggcgaggcttgtagcagcgagtcccccctcccctcctttcggacgaagaaggaagacttgggccccgcgactgsgcaggaaaaaggggagggagcagcctctccccgcatgcggcccgggagggaagccccgcccccttcccgcgggtaaaggacacccgtctcccaacagaaactgatcaataaattacaaagtagagaaaaggaaagcggacgtttggggcgggatttcttcctccccgcttcttccccctctcagtccagttcatgtggtttggtccaggccccggccctgtgcgaggcgggcgcgcgcactcccgctggtctgtacagatggtccagtcctcggcgcgagctcccccgcccgctctccccggcgaggccacagtccgggcaggagagggaacagcccagcctcgggaagattcttccgtccgagtgaggtcacctgcatgacgccgggcagcgcgtggagcagtgaagatccaccgtgccgccccgcacccccaaggtcgcccagcacggtcctcacctggaggcctgcactagcaggaataggtccggaccgaaacgccgtctgcccgggaactcccagaagtctggcctggagggagagcgagcagcggttcagcctggagcaccctcctccctgttcctctccaggattcctccctttggacttcccttcccgatgtcacaacgatcgccgggctccacatgggtttccctcccttccccgcagccaaggactcaaactcgcattgggcgagttcactcccgccctgggaagggggagtgggatttatccatttcatcctgacgggggagtccggaacgttggagcagtccattcctcaggggtgggcgagaaaggactaggccattccagaacccggactactgaggtggtccatgccccaccctagggaagcgaggaagggctgtcgcatttgggagccccccaccttctggctgcagcttgcggagagggagccccggagagcccagggctcccgctgcagccgaacgaaagttggggggcaacatctcagctgagtcgggagttacgcctcggaggtccttctcccggaacatcttccgccaggatggggagcggctgaaagacttggcgctgtcctaggtataggagccggacagccggtgagggactcctgccttgtctgactccgccccttcctttgactccacccctctccgggtctcacctctcctttaaccccgcccctctcctggccccgcctccaaccgtgaccattaatagtcaggccccgccccctcagctcagcctctcgaggagccgctgggagcagagccctctgagctgttgccgcgcccacctcgtccagccgcctgtctgtgcctaaggagataaggttgctgaattccttctccagaagctgccgggcctggaaagaggaggtggagggggcggttggagcgtgcagtctgcgaggtggggacgcccagcatgctccgggcccagcggcagctcacctgtgcattctgcgtggggatctgcaggagcaaggccaggtcggagtagtcgaaggtctcgtccagggcgagcagtgccccgtgtaccccgctctccgtgaggttcgtggcaaattccttcaggcccagcccggacacccaacccatgacccgctcattggaccacaccatcacgtctggggacggaagggaccctcagccgtgcccctcccgtggcctggagagttcagtttagcccatacctccacctccatttggtctcttcgggccacgccccccacgctggctccacccccacggttatggtgccaatttgcttctccggtctccccctaccccctctcctccccatccagctccacgccctccacctggctcccaaagggacccttaggctctactcacctcggatctgggtctgactttcttcccgcctccgctccaggtccttccggtcatagttgagccgtttcaggcacataatcccataatgtagactcaccctgagcagcaggggaagtggagtcacggatgagctttccagtcccctagactgctgctcctacgggtccctccccactggctgcgctcttcttggaaagggtggggagctgataagttctattgactgttgatcccctcaggaggtgaggcattttcaataataggcacttcctactggccagcctggaaggggtccagggttaactagccaagccatttcaggatctgaacttttcctgtggaccatctcattggtgaaaggagcacagagtcaggatttcctgagaactcaggctaaaagggccaagataagcctgggaatctcccatggccaatcctattggccaaagactctctggggtggggcttccctttggactgtccccactggccaggcagcccccacctgtgaaagctgtccaccatcttgagttggccccggagctccttcttgttaaggtgatctaacattcgagcgtccaccagcgactccatgaagtagctgcggtaytggggcagccccaggctgggcagccagtcgttccccacccactcgtggttcatgtcgccatatgccaggatctggggccatgggcaggtgagggaagagtcaggccctctggccccttcccactgtgcatgagaggggtacagtccaacctcccaatccaaggttttttcccaccccatggtaggacaatgaccaatctctgctcaggataatggaccaatccagagttgtctcctagcccttcatgacagcatatactcttggctactcaaacagttgtcctgagacctagagcgtcaccatcacctgtggacttgctggaattgcagaatctcagaccttactccagacctactgaagtcggtatckgcattttcacaagaccctcaggtgattcgaaatatacattatatttatttttaaatttctttctttctctctttctctctctctctctctctctctctctttctgaaagagtctgctatgtcacccaggctggagcgcggtggcacgatctcgtctcactgcaacctccccatcccaggttcaagcaattctcttgcctcagccttcgagtagctgggattacaggtacgagccaccacgcccggctaatttttgtattttttagtagagacggcgtttcaccatgttggccaggctggtctcaaactcctgacctcaagggatccgcccacctcagcctcccaacgtgctgggattacaggcatgagccaccgcgcctggctgtatttgtttattttttagagacagggtcttactatgttgcccaggttgacctcagcttcgtgggctcaagcggtcctcctgcctcagtcttccaagtagctgagactacaggtgygtgccaccccactacacattaaatttggggaagcactgctttaactctgtctcactgcagtccaacgtcactaaacccccaagtcaggacaatggactctttcaaggcagctctcccactaagaaagggccatcactcttgcaatgtcctgaaaatacttgtctaatgttatatctggcccaggacaatattccagatgagtcccaagtccctcactcctttcagtatcagcacaaaatccacgcctccccctggctggaaatatgtgatctatgaccacagtcaaacataattcctccgtggacagtgagttcatgcctcttgggtttttttgttagtttatttgtttggtttttatgagatggaatctggctctrtcacccaggctggagtacaatggtgcaatctcggctcagtgcaacctctacctcctgggttcaagcgattctcctgcctcagcctcccaagtagctgggattacatacgctagccactgcacccggctaatttttgtatttttagtagacacagggtttcaccatgttggccagactggtctcaaactcctgacctcaggtgatctgcccacctcagcctcctaaagtgctggaattacaggcgtgagccactgcgcccggccgcctcttgtttcttgagaacaaagtgtagctcctcctccccaacttctcattcagcctggctgcctcaccaccaccacagccagtgtgtcctccttggccctggtacactgagcagtccactgtagcccccgccccctccactatagggacaccggctgctcagtctctcctgagctacagaattgaagccccttagagcccccacaacccacgatgatgaaatggtccatgcataaggctgactatgcaacagtctgggcttccacatcgcatcccctctaccctccccaccgccaagccataatggaacagtccagagccaagcttggcgcagcgcccccccatggggatgatggcatgttctggtgaaggcaggggcagggctcggaggaggggcatccatgcrtcgtgcacagcctgttcatgcgctcacgccccgccccgcgccccctacctgctcccagctgatctccttggtctcctgacccgttagtaggaagaggggagagaaggggtgagttaaggggcaggcagaggaggacgcaaggagcggacttagggatggccacagactcggtccccgcccccacccccaaagaaggttagtgccacccccaaggcggccggcagggggcactcacgggcttggtcgtggccgtaagggactccatctcctcgtgtgtcatccacacgtttcctgtggactgaggggcagggagtgttaatggatggtgggagagggcttcgcgtgggggagaggaaggagggtgtcctcctgaaggccctgggccacacgtttatgtccctcctgctttctggggcaagcagtaacagagaaaaggaatgattcttattatagggcacctgccatgtaccaggcaatgtgactttggagttgaacaaattcaggttggaattgggaccctgccatgcattttgctgtgtggccctgtgcaaatgacgtcacctcgctgacctcacacagaggtacagaatgaggattcagaagtgggggacagacacagccatggtgcaaatgtttagggagtatggcggggggggttcacatttattgagcttctgctcccaacaacctcacgagttaggaatccatacaaggataaaaacatttatgtacttctggtgagtgtcaggcaccagtcaccgtcatagggtgtgggatatggcaagggacacgacagacacttttcgtcctagtgggggagaaacaatgaacatattttaagtatgttggggaaatttgaatacagagtgaatagtaaatgaaattaacaactgtggccaggcgtggtggctcacacctgtagtgccagcactttgggaggctgaggcgggcacatcacttttggagattgaagactagcctggccaacctggagaaaccccatctctactaaaaatacaaaaattaggctgagagtggtctagcact

SEQ ID NO: 12171 - DNA, 37331 bp, Homo sapiens
ccctaatttatatacaaccagtatatcccagtttccccccaactgctagtttccagttcccttccacctaattttgtcctgcaatcttgtaactcaaacctaaaatggacatcccagagaacccgggcctggctttgttctcrcccaggcaacttccctctgaccaaccccagaaccctaccctccagaacttgccccccgamcatcgatccctggaaacacatgtgctgctgccacaggggcttccacctgcccacaaagcaggccccccaccatcagacccctctcacctttgttcccatgccctgtccctgcccaataccatctctccaaggactgattggactttgtttcctttcaaaagggcttgaatgaggagtagctttgccacatcttgatctgctcagccctggaggtgccagcaaagccccatgctggagcctgtgtaacagctccttgggaggaagcagaataaagcaattttccttgaagccragatcctgactccagactcttcttcactgmcctgaggaccyggggatggggtctggactaggggaggtggaaatgcaggggagtgggggcaaattcaaaggcctggcctaggaggccttcgtggagcagcactgaaaacccctttcacttcccccaaaccagccaaatgcagcagaggcgacacctctcctcccagccttctccctggtccagccaggatttaaaggagatttagggagacccctaaagttcacctagagcaccctgagcccatctactgtggacctgcaccccagcttccgtcaaccctgccccacccaccaccatggatactgcccagggctgggcaaagggcagcggttcggggtgtgggtgctggccagtgccctttctgagcccgcagaagtgtgaaccactgggccaggtgaggcaatggctgcctaagtgccagtcccaggcgagtctctgagagtacacaaggattcacagctgtagcctgcatccccttttaaatagagccaccaccctctccagccaccgccagaagccagcataccccctgcccaccacaggtgggagaaacacaccctcagcccacctgccgtcctcctcagctcctcctggtgccgagcccccttggcccagggtgctcccttcttcccactcatttcttcccattgtaattcccattaccaagccctttgtcctctgggcttgtgggaagatggggttctcctggcccatttatggcaagccatcttgaggggaggcagacagatgaggggctggggaaggttatgtgtgaacaggactctggggagagggagggaagggatggctcccgagagggccaggaggtggaggaaagagtaagtctcctccaactaaacaagttcagcccctttggagttcctgccacagctggrttgcttaggcaggcctgggactgtgggccacagaggtcaggggcttgaaaggcactggggctgtcggccccactgggaacctgggaagcagtggttcagccctggactggatctcccccaacccaccaacatacccactcggagcccactcctgctctgtacccagctctgagctcggagctctgaggactgcggcagccagagccaagggccctaagccggagaaggagaaaccagtactggacaatagcaggtgacagcagaggagaaaaagggggtagggaggggacaaggaaagacctgagggggtggcagtggacaaagagattgagcaaccacaggacaaggtaaccagaggaaacagagacaaggaaaaaagatgcaggaaatgaggaggccccagaaagatccgcaggcgccgccacctttctcctcatagccacctccattctccttccctaggccaacccagacagagctccctcaaaccagggatgcttccttttcatttatccagctcaattgaaccacacagccccagaggccaaggtaattcagttctctgtgatttctaggattctttcagcctttttgtttttgtttttgtttttgtgacggagtctcactctgctgcccaggctggagtgcagtggcacaacctcggcttgggccgagatccctagggccattcctctggctaggaacagacttggacagcaatgaagagataactagaaacaaaggagagaacccttgaaaagggagctatgcagagagacccagggcacctaagcaaccagagcaagagagaccgcaagagatacagatcctatgagaatggtcgggggctggatgcagacagcagggttgagagaggtctgagagccaagccagggagaaggaggggtgctgagggggatggggagagaggaaaagagagggagccttggagggagaagcttgaagagctgcgggtggtgatcccgagtgaaggaaagaatcctgggtcacttgcaaatgcaaggagagtcaggaaggcgcaaggagattggagaggaggaagagcctggagcaagatgtggaggcccagggcgagagaagaggccagctcggagagggcagagcctcatgttagaccctgagccgggtggagacacgggccagggagaatcggaggcaggccccactctgagatggagaagcaggcagagggaatgaaggtgagacagagacagatgcaacggggagccaggcagaagacaggcaacctgtgccagggaggccagccttgcctccttggcaccctcacctgtggccgaagcctccatccctgtccttatattccaggactcccagcagaatgaggagctgtgtgcaaggcagcttagggaggacggagagcaatatgtgagagcagggagagaaggagcctggggaagggagaggacggtacagcggagcagacgggcagggcctggggctgagtgaacaccttccttcctcctccttccacaggagcgggggactaccccccaccacctccactccccgctgccctgccaccaccacctataccaagtgaggcctgctcagagcacagggttccctgaggacaaagcctggtctttgtcacctgaccccgacccagactgacctggcgttctcagctccttatcatgtccccagagctatgggaaccaagcagtgacgcactggccatgggctaaccccccggctcgaattctggggcctcgagtaacctagagctggggacaggtggcctgcatcccctgggggtaatgatttggcataagcacctgcagaagatggggatgtggggtcaactaaggtccctccaaggacattgagaaaaggtccaaatgctctggaaagagaggtgtgttcctgagcccaggaatggggtggcagcgtcctagggagctaggggagaggccacatcttaatggaaagtgctcctacccagagaagctgacccctgtcgtcctacccacctccacaccctggagctatattgagaggtgacagtaaactggtgggaggggggctgggagggtgttcctgggtgtgagggtggggggaaggccagagcaggggagtctggctttgtttcctgaacacaatgtccacttagtcataacaggaacagcctgctgaagacctgacacctacagcctctgagagatggcagcattggaggatggggagcggggccttgagggcctagggtgcttgaggacacccacaaagaagggaatgtgagtataagccctggagggcttggaaaggggcaacaaaattctgcctggggagggggcaggtggcagagccccaccccgatggaatgcagtgcctggggaccagatggtgtaaatccccaggcctgccaggcacctgcaccctctggcagcccggtgaggcagaaggggacagcccctcacccacccccctcctctctcaggccctaggattagcaccatcttcttctgcccaccccaccccaggagcagagggtagcaggggagggcaaaagcctatgtgtgcaaatgcggatgtgcaaatgtgtgcatccatgtacacaaaagaaagtagaaaagaaatctgcaagcttgagtgggtaagtgtgaaaaatctgcatgtgtggctgaagatgggcacagacacggtcaagtctgtatgtgagagtgctgaactggggttctgtgtgaaaatctgcctgaggcggcrgggagaatcactgccattgygtgagcaggttggatgttggccactctatcaggagcattagggaaggggtggggactccagacgtgtccccaaaccagggtggcctcaagaccttgggagaacacttgtctgaagacttggggaacagaaggagaccaggcatggcacttatgcagactgaggccaggacagaatttcctgacaaaagaaaactgagccatggagatggacaacagatcccttccctgggcaccatactgcagcttttagtccctagcactgggggctccagtactaacagcaggaagatgctcccagcctgggactgtgtgagggaggtcagaatgggaaggagaggctggggaacaggggaggaaagcccatggttgggaggcggaggacaggcatttggcctgcaggagaaggtgaccctcacccatgttttcagttcacccttcgggkkaaaaataactgaggtaagggccatggcagggtgggagaggcggtgtgagaaggtcctgtcttcccactatctgctcatcagccytttgaaggggaggaatgtgcccaaggactaaaaaaaggccgtggagccagagaggctggggcagcagacctttcttgggcaaatcagggggccctgctgtcctcctgtcacctccagagccaaaggatcaaaggaggaggagccaggargggagagaggtgggagggagggtccctccggaaggactccaaatttagacagagggtgggggaaacgggatataaaggaactggagctttgaggacagatagagagactcctgcggcccaggtaagaggaggtttggggtgggatgccctgcagcccgtccacagagcccccaccgtgagggacctccttcaccaggagtggggtgcaggtcagttggaggcctaagggctctattaaaactgcctatctccaggcccagggaagttccccctgacacaaggaggttccacaggaaacccagaaacctcttttctccttctctgactctccatttctttctctgcatcattctgagtctcctacatgttgtctccatctttccatcttccttcctcctttggatggcttccttcccttgatcctggttttatcttgcctcttggtcttcatcgacacttgtcacaatcatgcttctttgtctctctcccttgtccttccttcttggcacktgttctcacctccctgcctctctgcttctaaccctgtttccacaccccgtccctcgcactcatattgactcggtgccctttcttttctgcctctgcgtctttccctttctgactccctggtctgtcctgcctgtctgcgctctggggctgcctccatccccgggtggcctgcctctgttgttcttcactctcctcatctgttcttctctctgcccggctctacctctgttgttccttgctccacccacggtccagattcttcaggattctccgtgaagggataaccaggtgagaactgcccccattttctctgcagagactggggcatgcttctcctgggagccggattgctggaccaggggtctgctgtcccaagcactcagcgccaacccttagcatactccagccaatgccaccccagggaaaccccttacagagattgtccttcagcatcacctcagagggcaggagaagcagagccctgagtaggggagggtgcaacagcaggtgcctctcccagggtggaggagaggagcgggggtagggaggggggctgcagaggacaaagccactcgctggagcctgggctccctcaggagtaacatagccctcctgtctctgacccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagrgaggcaaggtcattgctgaaaccgagaatgggaaggtgagtagggcatggygccggggcagaagggaaggaggtctgggaaagaagatgcagaggtggagccacttgcagggggagctgagagggctggagaaaasccaagsccagtggggatgccagsacatgctcctttgaggascccagaatctgatccctctcaaattgacctgagctggtgcaacaggtgccacccagggccatgttccccctgccagagaggatgctgaggaagaagracctcagtgttcgcctaagaggggtsttgtagataaagagggcacagacacagcattaaatgatgcccccttcttgcacttgtatccctcttccctgtgcctcagtttcctccatgagtccactttctcaaattmmgttcacccaaatcaagagtaattcttagacccagatgaacacaaagatcagaaacttttgagctgagcactctccttgactggcactcagaagctctggtccctggtttgctcacrccagccaagagaatcacccctggttaccagctgcggctcagggctgtgtgcctcatgaactcgttgactgaatgttacaacccattgaagtgtagaataacaggccacaatcccctggggcttttgactctgatcccagctctgccacccgctagtcactgtgcaggcaaatcatttagtcatttagagccacggatttctccactataaaaaacactggaatacctactggcaggatctaatgacatcagggcatggcaarctgactgctgccaatcaaaccacaccaacagtgatggatggggagtgtggagtagatgggtgaactacttttccagcaggggtgaaggtttgccctgagcaacagataccctaaagcgctgcccgcgggagacagcctcggggtcagcataaggtgtgcacagatctgagagctgccaatctccaggtctgccccaagacccttggaacatagggactgaagagtgatggtcatgggcacagggtgtccccaggatggtctggggatctggcaagagaaaggwwccctaggacagtctctaggatgggagatacaatgggaagggaaattacctggggaaaststcccaggggacatcggggtaggggccggggcactggtcagagcaaggggagcaaggccaagtccctgtgtcctgggaggaggtcagtgggcagtgctggcaagggtccyggaggrrttgtggtcactcatcctcctgcttatgcgccccctccagacggtgactgtgaaggaggaccaggtgttgcagcagaacccacccaagttcgacaagattsaggacatggccatgctgaccttcctgcacgagcccgcggtgcttttcaacctcaaggagcgctacgcggcctggatgatatatgtgagtrgctcctgcacactgcagaggcttcctgtgctgcgtggaggcctaaataagccaggggggctctcccaagaagagggggagagactcccaagggacccaagtccccttcccccctccacccctagtcagctgcaggaggagtagagccagctggagtgaacagggacatgcctggctgccaccactgcctgtcccaggctctccccaccaacctcatgcccagccttgtctcctgctccagacctactcgggcctcttctgtgtcactgtcaacccctacaagtggctrccggtgtacaatgccgargtggtggccgcctacmggggcaagaagaggagtgaggccccgccccacatcttctccatctccgacaacgcctatcagtacatgctgacaggtgagcctggtggcccctggtctctgctcctcctcccagacacccacccagatcctcagccctgaccccattgcttctcctcttttttcttccagatcgggagaaccagtccatcctcatcacgtgagcgagtgccatcctcccacagaagggactgggctgggggcatacacgctgatgcctagggtgtagttgggaggagaggtttaaggctgggattgcagggagcmtggggcactgagctctcattagaggggtgccagagcaatgaaccatgtcaggcaaatcctgctgggtgctgggctctgatggccrggctgggaaggggagcatgtgatgctgagccctgtatggagaacagtaggaatcctgagttttgattggtctctgtggcccccaggggagaatccggggcggggaagactgtgaacaccaagcgtgtcatccagtactttgccagcattgcagccataggtgaccgtggcaagaaggacaatgccaatgcgaacaaggtgccatgggggacacaggctcggcagaacaggggttggggggcaggctgacccgagttacccctaaycctcccctccctgtgacgtggtggggacagccacactgagctgggctcccgatggtcagcccagtatggaagaccttcctgacaggagacactcaccctgaggtctgggtaggatcctgtggagtcgcagacccactagcggttcacccagccccgcacccccattcctcagggccagggcagcctccctgccctctcaccactgcctggaggtggatggaggatgaacccatgcagttctgctcctttcatagggcaccctggaggaccagatcatccaggccaaccccgctctggaggccttcggcaatgccaagactgtccggaacgacaactcctcccgctttgtgagtgcctttgaccactcccagtggcctcatccagccttgacaagaaaaagggggtgctgttttgccacacccagttgattgtactgtatctggctttgggatatcaacatgcacacgttggtgggaagagagcataggctttggagccaaaggtcygactttccacttgctcagcaagtccttacacctctctgagcccyagttccttcacctgtgaaacaggggractaatatccaccctgcagattactgggaggattaggtgagatcatatgagaggtatgagcaggaggcattctgtatgtgttcccctctgggccgaggttccactaggaggtccctgcacagtgtgtgagggtggcatcctctgcccggcttcacttatactcaactgagacaccaaagaggtygtttacatttccagaaccatccagggcttctgggctgaacagagggccaggatttcactctgtccttcccrccagttccctcactctgtcccattcgtccccaggggaaattcattaggatccactttggggccactggaaagctggcttctgcagacatagagacctgtgagtaccagcagggaggctgccaccctctaggtccccctctgccttctctccctgcctggcggccagtctcatcattcctgccatctcctgttttgtctgcatttgcctctgggctttaggatcctttttatttaagccacatcttctcgcctggccctcttcatcaagctgtgggtgccccctgccctctgcccccatggccrcctttttctggctctactctctttccttcctcacctgccttcctcccctccrsccacctcagacctgctggaraagtcccgggtgatcttccagctgaaagctgagagaaactaccacatcttctaccagattctgtccaacaagaagccggagttgctgggtgaacctgcctgccaccccccacccactgctgtccctgctgcacaccccaacgactcctgcatgcagggcagggccctcctgctccccactgtgccccaccttgctgctcacttcccttctccctccactcactccgccagctccctctcgcttccctcccaagaccacctgcgtctcctctcgcctccctgtgcagtcacacacctcactccttctccacccttctctccactcctccctcggcttgtctttgccttctcctctttatttgcctccccatctcccatgtgtcactcccctgccaccctccctcctccttgttactggagcccctgccagggcccctcttctaccctttcacttcctctgggttcactccttggtccttgctgacttctcttctctccctgctccctgtcctcccttcctccattcaccccgtcccttacccctccctgcccctccctccctttcccaactctacctgccccttccctgccctccgcctgcccccttgcccctgcctcaccccttgcctggtgcagacatgctgctggtcaccaacaatccctacgactacgccttcgtgtctcagggagaggtgtccgtggcctccattgatgactccgaggagctcatggccaccgatgtgagtkagggggctgctgcggccgttcgagggaccccaggagctcctggggccaccgctccaacccccctctttgtctctcgctctgtcccagagtgcctttgacgtgctgggcttcacttcagaggagaaagctggcgtctacaagctgacgggagccatcatgcactacgggaacatgaagttcaagcagaagcagcgggaggagcaggcggagcmmgasggcaccgaaggtgggaggggcaggcaggcagccctgggaaggcctgaggtgctgaccaggctctctgcgggactcagatcccagagactctgaggcttgtggggcagtggggtgtgttgtgggatggtgagggacagggacgtgggagacgtgggcagacagagagtccaccacaatcccaactcctcaaccccagctgcactcaccagaactgaggtggggaattttcctcctgtgcccaagactcccccagccccaggaagcacagcccctgagctctgcacatcaccatcactaatgcagggcctttgcctgcccagcccttgggtaagcccctcgtgggctcataccatgttgtttgggaggcagtgggccaggggtcaggacatagcccagggcattggtgtgtcagtttcctcctcagtgaaatggatcaacaatctttcctcactcctctggtggctactgtgaggtcctttgagaaaatgtgaaggtgcaaacagtgctagacaggtgcccaagaacattcctccctaccttcagggacccttctccaagtctgcccagatcaaagtgtcaagctggggttcatgataacacaccaacagttattacaacattcttgaaattacaccaaataactcctcctctaaacagagaaatacccatgttgggtggcacatttggatggctgggggtaggagcgtggtactgtctgatatactctcagccagtcagattgggtaacatgtggatggagaagacagcatggccagtccagggctagacactggggtagagaacgaaggagacagggagcagaggacatctagcccctcagccacacccttgccctggagaggcgagggatatggtgaaggtggggatatgcccacagcagtgcttgtgaaagacctgacccagagatgcyacagatgtagagacagagctgagaagagccagttgtggcaagaggccatgggccggataagggggctgtgctccagcctgactcaggcacacgttggttgagtaaccaaggcaagccctgtgctcttccaggccttgatttcttcctctttaaggaaaagaaattggacctgatgcttcctaaagtcttggccccaggacagggaaggaggctcactccctgaaagtgttcactcaggccaggtgcagtggctcatgcctgtaatcccagcactttgggaggccaaggcaggtggatcacttgaggtaaggagtttgagaccagcctgggcaacatggtgaaaccctgtctctactacagatacaaaaattagcctggcatggtggctcatgtctgtagtcccagctacttgggaggctgaggcaggaaaatcacttgaacccaggaggtggaggcygtagtgagccaagatcgtgccactgcactcaagcctgggtgacagagcaagcctctatcttaaaaaaaaaaaaaggaagtgctcacttatcctttccctctcaaccagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatyggggctctggccaaggcagtgtatgagaagatgttcaactggatggtgacgcgcatcaaygccaccctggagaccaagcagccacgccagtacttcataggagtcctggacatcgctggcttcgagatcttcgacgtgagtwgggacccctgggagtgggagaacaatcactcgcttgctcctacattcaacagccatttgctgagagccagctgtggaccagacatgggaaggcagtggggactgygtggtgacagaggcagtcattgtcccygtcttcaggggaagccctcctccactgccctgacatggaggggacagccataccctgctgggctcggcacagtgcaygggcacagccccartggccactcacacccactttctgactgctcccacccctcatgccccctgcagttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaaggtgcctccttggcctcaccacctatgccccctcctctgccatccagacaaagtggtggctgagtcccttctacacccaagaaactagagtcccaagaatcccaggcctttctccaggcccagcttctccccactgtgaagtcatgggcatgaacaggatgatccccccactcttcctttcccaggaccttgcactttatgcccctttgtggtggtcccctcagtgtcttaagagtgagatgtagtgaaggagaggcccctggcccctctgaccgcccatgagaagcgtcattcatggaaagatcctaggctgaaattagagatgtttggcctcccaccaccttcctgttggttgagaaataagccagtctccagccctcttgcttatgggcattcctcagaagagacaaggccgcaggcgggaggccccataggcyrgggctgacttgctctcagtgaacctctgctctttgtcagcataggccagagcccggattgtctgacccacacccagcccagccacggccttcatgaaatgggagcttccccacatgctttgggtcattatccagattcttaaccagagttctcatgtttcagagccctcagaatgccataaaactgtgtgtggaaaaaagcatgtgtacattcatacatacatgtgtgtgcttgtgcatgtgtgtgtgtgtrcgtgtgtgtgtgtacatgcgtttttctggagagacagtctttagcttcaacaaattcttaaaaggattcctgccccaagaaaaatcaagaaccaccaggtttttggaagtgcagagtgtggtaaagaacctggatccttctatctaacccttgaagaattgctactggtgtcatacagacagagcctggcccggtgcctctgacacacatctgtccctgccctcctgcccctggggcagtgagccatcagagagaaggggctgtgctgtgaggcactgtgggccttgtggggggtgattaggagtgcatgactctttgttggacccactgggcagaaaggaggaggaaggggctttttaaattccaggaatattggcttcctgttttagggtaagaggtaccagcacagcgccccttcagcaggccagcgctactggctccagattccttttcctgtcagggtatgggactgtggaagcctgggagtgtgytcagtgattctctctttgcctcttcaccctgccctcagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggtaagcaggcagcccctgcactgggccaggggacttctgaagacacaaagggccagggtcctgctgcttcaaagcacatgactccataggcaggcacaggggagcccatgagtcaagccacctcctggctcacctcaccacagtccagctgggcttctgtagcacctgccgttctccactttgtgttatgagtgttgatatagctgtctcatgtttcctcaagatggggagtaactggaggtcagtgagggtggcacatgcatccctgtaccatgcccagcagggaacgatgcatgtgggagttctcaacaaatgttgagaggacactgaacaaaagagcctccagttcagaaaaggaagagaaaggatgtggcttgaaatgaagaggataaagtgtaagaagaaaagtagaggttgggcacggtggctcacgcctgtaatcccagcactttgggaggccgaggcgggtggatcacaaggtcaggagttcgagaccagtctggtcaacatggtgaaaccccgtctctactaaaaatacaaaaattagcctggcgtggtggcacctgcctgtagtcccagccacttgggaggctgaggcaggaaagttgcttgaatccgggcgacggaggttgcagtgagccaagattgcaccactgcactccagcatgggtgacagagtgagattccatctcaaaaatagaaggaagaagaagaagaagaagaagaagaagaagaagaagaagaagaagaagaagaagaagaagaagaagaagaggaggaggaggaggaggaggaggaggagaactagaatgtggaaagatataagaaggaagggcaagtagagggagagctaagggcactgatgtatgtcagtgcctactatgggcaagcaccagtgagctgccctacaggcgtggtcttatctaatcctctttacaactttgggaagttgttactgtcatcctcatggtaaactgaatcttggagaattccttgcccaaagtctcagagctaccaagcgagcagcagagctctgcctctgcccaagggctcctttattttccagctcctgttgattatttctcctctcgctgtttaggggacagtggtaaaagcaaaggaggcaagaaaaagggctcatccttccagacggtgtcggctctccaccgggtaagaagggcccaggggtgccaggacacctggtggaayggcccagcccagagacttctggctgcaccacctattctgatgcttgagtttgatgaggaaagaagctagggctacgtagtygttttttagtgtgtagattccacaaaagcctgaactcaygtcacaaattatgtggcagcccctgtccctttgatgattctggtggagagtgtctggggaccagggtttaagggcctaagggatggtccttgtggctcctaactccccaccttcatctgcctccaggaaaatctcaacaagctaatgaccaacctgaggaccacccatcctcactttgtgcgttgcatcatccccaatgagcggaaggctccaggtgagccaggagaagaccttagtctggggaggacagctggcatccactttaccctaaggctgaccctttccccttccctcctgacacaggggtgatggacaaccccctggtcatgcaccagctgcgctgcaatggcgtgctggagggcatccgcatctgcaggaagggcttccccaaccgcatcctctacggggacttccggcagaggtgggtatgagggtgcmccagagctcatagaacagggggagccaggctgccctgatgggaatgggatctgcaggtgaccctggaattctgtgggcagagcagatcactgcagagcatggrtgactctggacacttccctcctcaggtatcgcatcctgaacccagtggccatccctgagggacagttcattgatagcaggaaggggacagagaagctgctcagctctctggacattgatcacaaccagtacaagtttggccacaccaaggtgagtctagagccccaytgggtggttgcagggcaggtggccatgttgagtggagcagagaggagtttaggaggcagaagcctaattctggcttccttatcaaccttatcaagggctgaaacccaggcttcattccggtcttgtttgtcaaatttttactcttacttctagaaggcatggggtgatgggtcacctgggagctcatccagggtcttccaccctggatactcccctctgaggctgcggcctgttgcatctaccccttgcctgcaggtgttcttcaaggcagggctgcttgggctgctggaggagatgcgggatgagaggmtgagccgcatcatcacgcgcatgcaggcccaagcccrgggccagctcatgcgcattgagttcaagaagatagtggaacgcaggtgagacaggaggaaaagggaggcatgcactagagatgtagaggcagatccgcaatgtcaactagtgtgggtcagaagacctgggttcagacctaccagctggcctgggcaagttactttaccacttcgaatctcattgcaaattcttcttcttcttcttcttcttcttyttttttttttaaagaaacttctctataggaaaatgcaaattaagacaccaatgaaataccattttaaaacactagactttgcttgctcagatggtctacaaattttaaaaaatgaaagaaacaagtagataaaaataaaatgaaaggaaaaataatttttaaaagttttaaaaatcactagactgacaaaaattaagaagcctgacccactgcttacagatgtgtaaattagtgcaacttcctaggaaaacagtttatcactatcttttaaagttgaacagctgcaggccaggcgcggtggctcatgcctgaaatcccagcactttgggaggccgaggcgggtggatcacgaggtcaggagatcaaaaccatcctggctaacatggtgaaaccccatctctactaaaaaaatacaaaaaattagccgggtgtggtggcagatgcctgtagtcccagctactctggaggctgaggcaggagaatggcatgagcccgggaggcagagcttgcagtgagccragatcgagccactgcactctagcctgggcgacagagcgagactccatctcaaaaaaaaaaaagttgaacagctgcatacttctccattccactcctgagtacattcctacagagaaactcttatacatgtacaccatgacatgaaaaataatcttttagcagcattggtcataatagcaaagatcttraaacaacttgaatttccatccacaggggaatgggtaaatagtattacagtcattcagtggaatattataaaacagtgaaaagatgtgaactccarctacatgatacaatatgtttgaacattaaagcatattgttagtaaacaaaggcaaatcttggaaggatacatacagtatgatgcaatttttataaagctcataaataatcaaaaccagccattcattgtttaaagatacatacatatggctgggcacagtggcttatgcctgtaaccccagcactttgggaggctaaggcaggcggatcacctgaggtcaggagatggagaccagcctggccaacatggtgaaaccccgtctctactaaaactacaaaaattagctgggcatggtggcaggcacctgtaattccagctactcaggagctgaggcaggagaatcgcttgaatccgggtggcagaggttgcagtgagccgagattgtgccattgcactccagcctgggcaacaagagtgaaactccatctcaaaataaataaagtaaaataaaaataaagatacattcatatgtggttaaagtaatttttgaaaaagcaaggaaaggaaaaataagattcagagtggcggctgctcctggcggggtgacaggggtgtaggaaggaacgcacaggtagatcaatggctggtaacatttcagctcctgtttcagtggtaggttcatggatagtcattttgctttcatgctgcataacttacatacttattatagacattcttatatgtaaaccccyacataatttttaacatatttgaagttmttatgagaatagaaaaaccaaacagagtagacattctataagtggtagtttccattaccactaatatcccagctgggaggatataaactgccctttcatcaaattgattaataaatatttatcaagcaactccatgttcagtgtagtgatgttggaggtgggtgtgcacaagaaggaagtctacrtgcctacgaacttgcttagtagggcccatgattgggaagctctcttttatagtgccccaccctgcctccaygtttccttgccagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggtgaggccacgtgattatctcttcagccctctcctcccctcccctagattatagcccatctcacaaccagggactgggagtctaggagtgccagctctttttaagaccctaggtctcctctcttyaaccatcagcttcctccctgttctcttctcccaggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagytggaagacgagtgctcagagctcaagaaggacattgatgacctggagctgacactggccaaggtggagaaggagaagcatgcaacagagaacaaggtgagggcagctccctctggcttcagcccaggtctcctcaagactcccagactagagtgttgtcctggtccttggcatggaggtccccatagatgtctccaggctggtgatctttgaccctaaaggggatgggtttttggtcggcaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatgtgagtagtaagaaccatgctcctgctctcagagcaagattttgcaggcaacaccaatggcccagaaagtcctgatccctagaattaacttctatggcccctgaagcttttttgctctctgtagttcctcactacagtaggtctctgaatcctttgtgcttgcaggatttctctgtyggtttgacttccaatcccactggacttcaagtttagaaggaggcaaaagagcatacactatggatttcatgttttccacactttgcttattttcttccctccaacagctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagtaggagactgtggtggccaggaggggctaatggaggtgtctggcctggtagatagagtgcagggtsstgcgcctccactggccacagttgccttgggtatgctgggaataaggtcaatcacagccctcttccgccactttctgggctggcgaggggagggggaggtgccgattctggcatactaaggccaagaagagaatgagccccagaggaaggaaggctacctgtcactcccccacccccacccttctcctgcaggaaggagtttgacattaatcagcagaacagtaagattgaggatgagcaggygctggcccttcaactacagaagaaactgaaggaaaaccaggtgactttttttcccagtgcatgaaagtgggagctcaatagccctgaggtaactgaggctgcagcagctgcttagggttctacacaatatctggaactccaggcagcctcataracccaaccatccctgacttacaggcgctcaggaacactagccttcccccatagagcaagaatacattacgttagcaaaactgtttgagaagggggactcatacctactaaagggcttctccttctgagatctgctctgcctcagggactttctactctaagacaaatgatagagctctattctcctctaacccttcctctggtagttcagccstctgaacgcagggtgaaaaaaaaaaaaggcttcaaggagcaccttcctgtgagskgctctgttcatattcttcccggtactaaccccagccactaacccaggctgagtccccatagggcactcatgataagagccaattccaacaactgtgagcaagtcacttaccctccctgatcctcagattctcttctcacctgtaaaatgagactgacaatacctaccacacaggaccagaggggataatgtatttgaaaccattttgtcaactaggaaattctatacaagtatcatattaatatagcccaatttagagaagtcagccagccactagcctaagaaggtattgttttgtcttctcaatggccttctcattcctctgcagctcaagatttagtgaacagccatagtctcccttagctttaatgaacctcaaaccctaatgtgcttttagtatcgggtttgtcagaagagacctggaagtccactgccatccccattatagagctacagaagctacatggccaggtctggacatagtgaccccaagggcaacaggaactcggctactggggcgggaccttgtcctctcactttggggcagactgtggctggtagaaagaggtagtctcccctctgcacttgaggcccatggcccaggctgcaagtaatgtatgaacacaattccactcctctggggctgcacagggactggcccgccttcattagtaatttgccctcccatsttcttggatgccccttctgggttttagctagaatatcgggccatcctcaggttcttctaccctaggtctgggcawcttgtttggcctcttggacacagaataacagtcctgttagtctcatcagctctcggcaataggctatggctcctccttcatccccaagatcttgctcagaagtcccaccttctccatcctgggagcagaggcatggtggtcctctctgctgcttgtaggacccatccatgaacagtccattaaagctgtccataacccgaggtgaagggatttccactgaacccccgttttgctcctggctagccagacaacagatcaaaatggtagatacgatattctcccaatttagtcaagaccaaggctaaggcccaaaaaatgaggtaagggcacttaaagaggataaggagatgaggtgaagaggagagtagcctgctagcactttcctggcctggaagggagcaatcatgttgaaacccagccctgggcataaacacagcaagcctgggagagcaaggaatatggttgattggactttgtggttaacttggagaattgcaaaggtatctgattgtttcgaggcatgttgtcacaaatatttgtaaaatacaagcactcattttcccgtcttatgaatagcgcaacagagcctagtgaatctggggactctgaacttcttgatctcacaggataccaggatcccccttcaaccacaggttctcaggatttggggctgcagatgctcacactgggtctgagatgcccttgggagcttcagccaaattcctattgatggcctatgcattataggatgtttagtagcatccctggcccctaccctctagatgccagtagcaagccccaccaagacatgacaatcagacattgccaactgttccctggggcacaaaattgcccctagttgagaaccactgcttgagaggaacctaagttcctggtagcttttcagagccrgggggattccagtggaggggtccaggcggtgggtctgagccctttgtgtctgacccaggcacgcatcgaggagctggaggaggagctggaggccgagcgcaccrccagggctaaggtggagaarctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaggstctgctcggcctcccctcgccctctcccctgcacagcggagcctcccccatgccttctctctctgtctgccatctcccttgtcattctcattctcttcatcaccctttggtctctcttcctgtctcccctgcccctctctggctctcctcaccctctctatctcttcatgttcctcctttctttaattcaagtctctcttcagactgcgccctcccacaccttctgtgtccccctcctgccctctggcattccccatctctgaccctctcttycttcctctggtcgactcagcccctcccacactcacccttcctgtcttgcttcctgaaggcaaacctggagaaagtgtctcggacgctggaggaccaggccaatgagtaccgcgtgaagctagaagaggcccaacgctccctcaatgatttcaccacccagcgagccaagctgcagaccgagaatggtgggtgcccctaaccaaccccctgcctagggcaggacatgacttgtgaaatggcccacaagcccctcatttcacctccaggagagttggcccggcagctagagsaaaaggaggcgctaatctcgcagctgacccgggggaagctctcttatacccagcaaatggaggacctcaaaaggcagctggaggaggagggcaaggtgaggcccagtggggagggtgggcaggcttgatggcagccctggggcaattcatctcagtgccagaaatggagcctggagctggaaagagtcctctgcaagggaaagaccctccagtctaggttctgccctgcagctaagcgtcatttaatgcctcttttcttaytcgtaaggggatggggtgagcagactgggaaactcctcaaacagtgaggtgccacatcagcccacatggtgaataaggctgggcttggttgaagtactacataagaagagaatctagagaatggggcacagggagtccctcccacctcctggtgcccccccccctccccaggcgaagaacgccctggcccatgcactgcagtcrgcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaagtgagctccagatacccccttaacctgactctcagagaggaaggggcgagaggacctggggtggggacaggcaaagtggtcatgagacggaagtggaagagacaggaggaactcggagggcaacagaagtgcttggaagaaagcctgaactctttgctctgtgaactctggctggccctgacccacttcctgtgacgggcgagcttttggcccgggttatacctgatgctcacgtataagacgagcaaaaagcttgttggtcagaggagctaccgtcgatcagcctgtgtggggggtgagggcagggggcactgacacccagatgccactgcaggtagggaggacgcctgggcagcccgtgctggcggactctgttccaggcatgagcaggctcagctcctgctaggctggacttacggtgtctcaaggagatatagggagggggtggaaggaggtccacccaaggctccagtgttgcccagtagagtcacacacacaccctccaccctcacctgggcagaaagaagctggcccagcggctgcaggatgccgaggaggccgtggaggctgttaatgccaagtgctcctcactggagaagaccaagcaccggctacagaatgagatagaggacttgatggtggacgtagagcgctccaaygcygctgctgcagccctggacaagaagcagagaaactttgacaaggtggaccatrggygggggccgcagccagcatgcagggcaagggggcatgaggggttcagtgagaggccaaaggcaacctccttggaggtggaggaggagggctaagcccaggctcgggaccagggacagatcttggacatgcggctgaggctgggggctggggcactgggaagcaggagggctggggagctaaggctggggggctgaagagtgagccttgtccccgggcagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcagggtgtgctgggggtccaagaggccagagatgagttggtgggagggagggccatgcaggggcagggggaacayaggctttgagctttctggccctctggtccccagargaaatctcggaccttactgagcagctaggagaaggaggaaagaatgtgcatgagctggagaaggtcckcaaacagctggaggtggagaagctggagctgcagtcagccctggaggaggcagaggtgagggccgagaactccctgcaycccatccctgttctgccgctgtctcccacttctccctcacctgggggtgaccctgaccccaggacaaaatctattcattccatrttctttgttcaacattatctacccactattcactacccatgactgcctccaaagccaaggtctgcacaaaggaaaatgtcagtctgattagaggccaaaggttttgtttcccaccaggttttaaaagttggaatctggccataataataaccacttagacagtgggtaggagtgtggggttccagagtcaaacaggcctgagttggaacacagcttgaggactttcactgcrgcgttgggcaaaatctktaatctctctctgcctcagttttctcatctgtaaaatggaattaactgtacatacctcatatgattttacacatgattattataaagattaaatgaggtaacacatttaagcacttaatatatattagctattgttactcttcatttctaagcacctgggaatagccctgagttttctgggcttctaacttttctcaggaaagggtgagggacctggaaaacaagataaaattttgtatttgtggttataaaaattcctccattttctataatactttagacaggtcaggaatttatgcagtgttagtgctggagggtctggcaattgtgaggtccaaacccttttcttgacaggggaagcccagagagtccagcactttctccccaatagcaccgtggtgggcatggggtgcagatcccacctccccatctcttctcagctcttcttctctgggcgatagtcctggctgacaccgtgtatcttctcatcctccctctcaaccctgccctgtgccctgtctgcccgccctcrccccaccccttcccaggcctccctggagcacgaggagggcaagatcctccgggcccagctagagttcaaccagatcaaggcagagatcgagcggaagctggcagagaaggacgaggagatggaacaggccaagcgcaaccaccwgcgggtggtggactcgctgcagacctccctggatgcagagacacgcagccgcaacgaggycctgagggtgaagaagaagatggaaggagacctcaatgagatggagatccagctcagccaygccaaccgcatggcygccgaggcccagaagcaagtcaagagcctccagagcttgctgaaggtacatgggggcgggaggtcccctcaggggactggcctccatgtgscctggagaagcagtggtgtctggatacaggcaccagattcctcctgcccctgggttactgcagggacctctgacaggtgccctcagtgaagggcacckaggctggcttctgctcacacccactctcctgatgctcaggacacccagatccagctggaygatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccaggtgagggggtcaggagccaccttgtggaaacctactgagtgcagagcccaggacatctagaaaagccagatgttctaagtgagcacatctagccagggtcacaaatcatttcctctcttaggccaactctcatctgtggtggctgcagaaccattatattaagaaagcggtctctacttagaagctaagagggtcatgattgattgctgatacctgccaaagccacaaatctgggagtagtggaatgtatcctgttatttgatattcttgatctgaaagacagcctccggcttgctctgtaaagatgagagtttgggagtttaaagaagcataactgcatctcttgcaaaccaagctggctagaacaccattttctgcaatcccacccacactgttttcagttatactctgcaatgagactttgtgctcaccttttgcagtgccctgtggagttttgttctttaatctagtatgtgtgagaatgacatcatccacttacctcatcccctcttccttaccccactacattcttggtatagctataaacatctctggaatattgtcctggtaaaaagttgtttccatcttccttggaatattgtcatgctcctacgtaaacatgttgctaaagagctccagggtaatactgcagaccttttgctatttgaagtcttttttcagagtttagtaatcttagatacaatgtctagaatgtatgcactttcataggaaaagggaaagcaggtacaaaacgatcaatagtctaaaagtgggcttgttgtttwaaaaaaaaaatgaccacctttaattctytctggagaaagggtatgaaatcaggtaacaaagtgtagtatatatttgatcrtttttctctctccatgtctagaacaccagcctcatcaaccagaagaagaagatggagtckgayctgwcccagctccagtcggaagtggaggaggcagtgcaggagtgcagaaacgcygaggagaaggccaagaaggccatcacggatgtaagtgaccgcccaccttccgcctcccctaaagacagaaacaaggccttgggtccaggccaggccactgtgctgtaacaccaagccaactctgcagttctgtggatttgagggcctgatgggagaaaggagatccttggggggcaaaaggccccggcccctggcccatgttccttgccacctctctcctgcacacaggccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccaggtgcggcggacgccagacaccrggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccaggtttctttctttctttttttttttttttaataactctaagtgctaccatgaagacttcagaacagttcaaagaatccttccaccttcgactgtggggataagagtcaggggaggggaaaagacccggaaatcttccatagaacttctggcacacaaagagaaggccacagagaaagaggaccctagaatgctctaaaacctccacttgcatagctgagagctgtgcccttggcccgttattttcagtgtacctgggaagaaaaggccaaggagacgagggtgtcagtccatttgatagatggataccagaggcacaagaaagaggttacagatacagaaccacagagtgatttgtggacagaagtagaaatggcatcctggcacatacaatgataaagagataggaatgatcgagtgacgttggagccagtgatcccgatgcctgaattctggcccagtacaatatattagaatgtagaataatctggattatgataatacccccttctttctgcattctttttctggtcaagaactactggccaagagaacctatgtaagtccaggttggagctttatccaccatactggagctggaacagacctggtgcttttatattaccacattagggaattccattaggttctgagcccctccccctacttctagctttatgacttcagccttcattgctctgtggatccctgactgacaaccttgcattgcccctttgacctacgatagagtcagagaatcttccccaccacctctttgmcctggatcattgcagggaggggcagcaaaggcaaggggagaagagtaaaatgatggaggagggaaaggtgattgcatttgctccccctccaaaccagcttctcccaccctcycacccccagacagaggaagacaaaaagaacctgctgcggctacaggacctggtggacaagctgcaactgaaggtcaaggcctacaagcgccaggccgaggaggcggtgagttcagagctttcttccctttctcatcaacacacctactatttgtgagaaccaatgaatatctcctacagaggggcctggacaaagagtttgctataaactttaactctcaaacatttgtttgacacatctggtatgctcagagctgtcaggtgttctgaattaacaaaggcaccacctacaagctgcttacaattcagataccataacccaacagaaggcagtgtagatgctagtgcaggacgtggggcagccgaagctgaaggcaggaaggtggcggtggaattgggcctagaaggggacccagctagccacagggcagtggggaagacatctgggtggatgtgagttgctgattagcatgcctgcacaggaagctggggtccgggacaggtgcagcaaaacaggattctgaaggggcccagatcgggcagcatgggatttgtctggggcagtggatggccgtgaaggactctgagtgctggacatgtttgagaagagtgcaaggcagttgcaggatacccttgggaaggctgttgcaggaatatkcatgaggyatgggtgcctcagggacagggagctggaacctcaggttgagaggctgagaatcccatagcccatctccagctcattcacccatccccactgtcccaccacaggaggagcaagccaacaccaacctgtccaagttccrcaaggtgcagcatgagctggatgaggcagaggagcgggcggacatcgctgagtcccaggtcaacaagcttcgagccaagagccgtgacattggtgccaaggtgggtccctcccctgggcttcactagtcacttccacattagcatgccccctgatatgggtgcccttcagagtgggcactgcttgccctatatgtaggcagttctgagggtcccatagcttacataacctgagaatccactctcctgctcaaaacagccccccactgactggaacttctgcagagatccccagttccatccccctaaaccacaagtgcctctaacgtgggaccacargatccctggggccctgcctctccctccaagggcatctcccttaggccycwgaaagccccagggatttgtccccayacacttctccctcttgccagctgccccctcacacctcttattctttttgcagcaaaaaatgcacgatgaggagtgacactgcctcgggaacctcactcttgccaacctgtaataaatatgagtgccaaactctgcctgagcccatctgtccttcctgccagctgtccatcctggatcagggcagtagggggcctgagaggagggaggcccccagcccctgtatcagagctgccagagccaaggcatcccatatccacaaggaaggagaccgaggtgcagaggagtgaggtgttctgcctgacgtggacagctgtgagtcccagttctgctcagtcaaccacacaagggtggagagggagaaatttcaaaagtgaagaaaacaatggcatcaaaatggtgagccagtccaagatgctacgagatagaattttggtgccgaagttgaagccactctccacctaccccacccctgaggctgcaatgattaaaggtgtcctaggacacccattctttctgaaatgaattttccaccaatgccagaaaaggctcagagctggctgagaattaaggtatgggaaaggagatgggagagattccattctagtcagcccctaggaagtaactcccagggagccccctccctgtcttccccaggggtctccccctgcctcctatgattcagcacctcaccgtgagggcatcttgagactctggggccaatcaacactgagcccaaaccaatatgccatgaggaccaagcctgggcattgctcatttcatgttggttctcacacagacacagatggcacaggtgcctgtacagggaaacactgtggtcacatttctgctctctctaagctcctactggggacagtctggcctggatcacacagctgcttgtgggacaggcccggtcctgaccccgttctgcacaaagcaaatccccactccccactgggctttgcagccaggctctgctgaccgcctccttaaccgttcacctggcaccccatctccctgactccccaagtggagcctcttctatccctcctctgagaccatgagaatggactgtgcataaagccctgagaaatgtgagcagtgaccagagaaacacaaaatcctgttggttctagcccaggagaggctgccagttctgatggtgagccaggacacaaggataggagaacaggaagcaggaggcaggaaaaagaccaagagagaggagtggctgccaccaaggaagcagagcgctctgaccagagttcaagatccagggttcgggcaggacttgggagctggggcctgcagctggaaggagcgctccagaagaaggattgtatctcagggcgggaacacacacacatcagcgacaggagatagcacgtcagctgggatggagctgctgagccaggccatgctgggctcctcgggctgggcaggaacgtctggctgcacatctgtctgtctcggcccagcagggctgactcccgggctgtggcagtgtctgctccaaactcccctgagccttcccatagcattcactgtggggagctcttgaccagcttgtctctttcccagcctgtgagtgctaaagggcaggccccccgtcacctctgaggccctggcacccagcacagtgtgcatgggagatgctcaggaaatgtgtgctgaggagctggcaagctgggagggtggacccgcagtggagggaagagttggccattcttttctgagctacaaggaggctcagtacagtatccagaacactcgcttaggtgtcagaagagctgcgttctggccctagctctgtcacaaatgagttcacctcccctggctgggcctgttttctcttatgtgaaatgagggcattggaccagctgataatcaacggctctcccagcattcgcattttgggaaatctctccctcctctgatacctcaggctgccctctccctgcgtcctgtgggccaagtcttccccacaccacaagggggagctctgcacacgccccaggcgagcgcctggcctccagcccactaacctgcgggaacaggtgtggtggtgcatgcatgctcccatgaggaaggctgtgccttctcagacacagaactccagatgcccagccaccaggcacaccacaaagtggccgtgcacacagaggtgtagcgtagaagttttgtgttggaggatgtcttcagcttcttctggctagcccccacatcctcactgctcagacccagtcccagagacagaccacgacctgctctggcaacattcccatgaatactccttgacattcctgacctgcctaatttctggggaagaaagagactcaccagtagaatttgaatattttaatttgggaatgacttagaggtccagattcctcccctccaccccccctcccccaataagttcccctcctctggccagagcttcatgagaagccacatcctggagcaccaggctccacagataagtccccagtgacgtctcaggccagactgctgtgtagggctggggtggggtttggcgggctgggggctagtgaatcccaaggagacgtgtctgggctccactgtcctctctggctggctgggcctaggagccaggtagccccagagtcactgctggtcccctgtgaggatagagccaggtagggacccacatcaggatgggtagctagggtggggagggcatctcctctccacagagcacaggcactcaccctggctggccccgggtgccatctcagtccggtagatcttgaaggcatcataggcaaagatggaaaccaggatgatgccaaaaacctgtgggagtgggagtggggatggcaaaacagaggctatagggccattgggttaaggtatagggtgaggtgcaagccagaaccccaagtcctggctgtggcttctgatacagaaagtgtgcaagcaccagcctgagctcttgaggggctaaggagtcctgcagggctgaactcacaaaagcagcaatggcagctccrtcccgggaggtcacagctgcaaaggagaccaccaggaagatgatgatggcactgacacagcgcaggaagtcctgggggccaggggtgcagggttaacaggacctcagaaggcagggggcgttaccctgaagttttccaggctagccagcagcccgaccctgagggattctgaacccctccataggatacccctcacacaatatgaagcacattcaagagacagagcgctcacactgctacccagggagtggaagcagatgaaccagagcaaccaggaccagaagccaggcgctggggctggaacccaggggacagcggctggagtatgccagcccgggggggtcaagccaggccagggctggggctggacctttgctgagtgggagagtagatctagcggatgtggtcctcctgattgcccgtggccctgcagctgtgaaatcagtgtgagtcaaagcacacctttgagtgcagggcatagcatgggacaaagcccagctgtggtgtggaaatggaaagaagctcggggaggaaaggaaaatgcatcatttagaggagagggaagggccccaaactgggctaggggtcagggttcctcaccagacagggccagttaattcggtcgaagcgctggtagtactgggtggcatagaggaagaggaaggcaagtgtgatgaagaactccagtagcgccgcggccatgtaggcagagatggaggccgtgaagcaratgaagatgatgagggtcagggcctgcaggaccgagcatgtggaacatgccaagaaggggacacaggcaggggccagggctttgccttcccctccttggaagctcccctaggctggcacctactacctgtccttggaggggaggaaggactctggcacatctccctatcccctggtgtcaggagccaccgttgcagggcatttgccggtcaagggcagtctccggcctcccactctgctcacccagcaaccccagcagtctggccaagccatatggctcccaggagcactatcccacagtaattcataggtacagtgtgaatgccagcccctggagttgtgcccacagagacccgactccacagggaccaagaggagccccctgcctcataatgctttccccacccccagatgcctgaaagccccctgacaaggaccagagcctttgattccatgccaagagagaaggcagatgctgcccagtggtttctgggagcccctttagctctgatgacctagggtggcatacgtgcagaggccttaactctacactgtggtcttgctaagtaaccaggggaagatcctttcctgagaagagatgtttctgggcagcagaccacagataaagtgcagttgcaggaagtctgccctttttgatagttagacttcttggacgtgctgagaagtggccatgttagaggctgtcattgcccctgtcccatccctatgtctcaagcttcctcaatgtcccaaaaagtcaccctgtctaactgcagtccttcctgctgcaactgaaacctgctgtaaatgtctccgggtggagaggcagcaagaaggcagagtaggagacgaagaaggggcagctgcgggcaggagaggtgtccagagggcttggggaaggaggctactgaagggtgagctgggggctggcataaggctggccaggagccgggggtcagggagatggaggcaccaggttgggaggcagctgttaccagctcggtttccagcaggatgcccttgtgggaggtgaggaaggccttgtccaccgcgaagccctggagctctgcaactaccccctcctcagggtgccggtcccggcgatctcgagcactgagcatcttcgtagggcccaccaacacagccccctactgccaaaagcccagcaagagaaacagaaatctggcaggatggggaaacagacaggagcaagaaggcacttcgagaaacctgaaagtgaagcaggaggcttgcccacagggccccgggagagaaggcaggcgctgggggccttgcccagatgggccctcacccagctgcccagagtgcctctgctgctgcctgcaccagccccctagagacccatggggaggggcagagaggaaggaggctctaatccctccccttgcttagagcccaacccagcctggaatagagaaggaaggggagaggaggaggtccgaaaagaaactgggaggagctgggatgtgagtagaggaacaggggcaggactgggagcccccagggacctaagcctgaagacatttgtgtcccccttctctaaccttaaccctcttgtttggccggtcctttctcccatttccttttagggagggtgtgagctggagcccagcccaggcagcacccccaggaccaagctgcagcagccaggactggaggacaaaggcggattgttgggggacaagggggcgctctgtgcctgctgcaatgcctcaatgggcctctgtctctccagcatgccgggagcgcggcctagcccccaccctggtgtttgggatgggccagggagacagagatgggagaggacgggagggtgcagcggaaactctggagggcggagagagctggcagggtggacagaggtgagggccaatggtggaaaggagaagggacaggctgggagaccgcgagatgttcaggcaccacggatgccaaatacagattaggccatttttaaataaagatatttatttggataaatctctatacattcaataacagcttcctcctcagaatcatccatgtcaaaagactagtaactacactagaatgcacccaaagtagatgctcactgagtgatgagtaaacaaacaaataaaaccaggggctctttcttctccagcaagggggaaatatctagaaagtgcctgtgctgggccagggtagcaggggatgggaaaagaggaagagacaggagtggtggcctccagaaatgggcagaactttgaaaacctttcctgagagaaaatgacaggacaccagcttccggcggccctaagcagcagctgctcttttcaaaatgtgcagaagtgcaggctttccccaaagccccccatcctgtcccgggatcctgctgctccagacagcacttcacaggggccaagcatctgggcatcctggcccttcatggcaagtggttgtacacctggctccaggtttcccaaaaagggaccagcctccag

SEQ ID NO: 12172 - DNA, 214902 bp, Homo sapiens
tgtattcaaggacattaacttgatagcttaaaactggccatggctggcagagtatttatgccacaacagttggcatatactgtaaatcaaggcacccaccaacaccaccagggagccaattttaaaatatttgccagcacatcattggctatattgtcggacaatcatcttgggtaattctggtagaattatatagttagatgaggtgaaatcctgaggcctctaggttcccagcaaaacaaagactagcaagcctgcacagttactatgcaatttatcaggtgcagaaggaaatgacgtttctggtcatctgttgaataaagccactttgagttcaggggacatggttttctccagcttcactagtgttgcatctggtacaaggggttaagtgctaaacccctgtaggattgtcacagtgaagccagataacagagtaaccgcaaagagatttaattctgtagtcccacaaaggagggtgtgtaaagagtgtacaacagtgtcagagtttggaaaccaagggttgacaaagttggttctctggaatctgggggtaccagttaaaaggttaaaaggagtcattgttttctgaaactatccaagagttacagccatgtttttttgtttttgtttttgtttttaagatttcgggggaatcttattttctcacatgtttctggaatttttcttttttttttaatttaagttccagggtacatgtgcaggatgtgcaggtttgttacataggtaaatgtgtgctatggtggtgtgctgcacctatcaacccatgaccaaggtattaagctcagcaagcattagctatttttcctaatgctctccctcccccaaccccctacccactcacaggtcccagtgtgtgtttccctccctgtgtcctgtgttctcgttgttcagctcccacttataagtgagaacatgcggtgtttggttttctgttcctgtgttagtttgatgaggataacgccttccagctccatccatgtccctgcaaaggacatgatctcgttcctttctatgtcgagttacaaccatttttaaaagtggaactgcacaggattacctcagcctgctaagtccttccagctaggccgtccctgtgggtttaaacgcaatgtaaagaaagtggatgttaagtgttcttaccacaaaaatgataactatattagttaatgcatttgttagttagctagatttaaccatcccacagtgtattttatgtatttgtatttatatttcaaaacatcatattgtacataataaacacatcgatgttatctgacaatttttattaaaaaaaaccactccagccacttataggtaccttcacaaatactattctctggtttgtatggatcagagagttctagatgttccagtagtctacagccccaacctgtcatcctttaagggttggttccttcattctcacaatgaacatttaatgagcatctattctgtgctggtaccatgctgggaagctctgggaatacaaaaatgaggaagggccagatgtggtagctcatgcctgtaatcccagaactttgggacaccaaggcaggaagatcacttgagcccaggagtttgagaccactctgggcaacatagcaagacattgtctctaaaaaaataataagtgagaaaaacacattcatgtcttcaaggaactcacaattcctcgacaaggaaatatttgctgtacagtgtgataatccaatttatataagtgcagtgtggataccaagaaaagagtgaacaactttgctggagaatggggacagtcagttttagggaaagaggtcttgacgtatgttcaagatctaattcaaggtaggagttctctctgcagagcaaataaaaggagccagcattgcagagtgtggtttggaagactacagcactttctcaaggatcttgacagtctttgttcttggtggattatgacaactgatttaccagtgtcagcagcaaagtcgtgggagcctaactgccacagagccattagcactgattctggttattttcaaaggagaaattgggaaaatgggattgctcaagcttttctctaagaaagtttttttttgtttgtttgtttgttttttgagacagagtctcactcttgtcgcccaggctagagtgcaatggtgcgatctcagctcattgcaacctccacctcccaggttccagcaattctcctgcctcagcctcccaagtagctgggattacaggtgcccgccaccacacccagctaatttttgtatttttagtagagttggggtttcaccatgttggccaggctggtctcaaactcctgacctcaagtgattcacccgcctcagtgtcccaaagtgttggcattgcaggcatgaggcaccgcacccggccaaaagtttattttcaaaatgtctcccactgggtatagtgtcaagtaactctcagactattagccacagacagggaggaaacccaattaggtctttaaccccaccccattcccacttccagatctcatcctcaaccagatgcccagagttgacttgagtaagttaaggtaatttgatatagggaaccatgtgggcctcaagtaactaggggttaaagaagcatacacctttatatgcctgagagatgagtgtcctgaaagacaccagctgaggtggttcagctggtcacactgaccttcgtaagcagcactcagttctgaaattaacctgtcaactaaattgaaggggagaaaaagcagaagggctagcacacaaacatccatccccacccccagtccaatcactgacgtcaggcctggcgtgggtggtattaatcacacaagcttggtgtgcagttgaggacagctctccttccagcccttcaacccgtttctgaaagcattccaccagccatgcacctgccgctggccacaaaccctcaactcccagacaggcacggatgcagcgacggatgtccctgacgacactcaaagccacagtgcaccctttagaaccccaggctttgtggggagtgggagtagctatgagcgggggccaaagtggtacccatgctctcccagtgtgcatttctctaatctctgcagtgctccctcctcataagatagtcatttcctgagaatttaataagaatataagattaatgacccaaagcactcttggagccggcgattaattcccccaggaaataccagtggtctttaaacaaaattgcctaaattatgggctagtgatgcatgtccgctcagggcttgggggtggggggattgtcaccccaactggttccgatagatggygcctatcttcatgtaaatcattcaaatgatttgttttccatttttttcccagcaaaaaccggggaccatttaaacagacacacacagcagggagtggagaggacttagtaaaagcccagacaggaactttccgtccaagggttgtttccaggcctggcacgcctctcaggctcaaaagactgagccactccagggtgcagccagggacttgagcagcagtcttgcttcctatgcacagcccgagatgggcactagcagcaagagggacgcagggtgggagtccagctgaagagcacagtaaaaaagcccctttcggccgggctcacgcctgtaatcccagcactttgggaagccgaggcaggcggattacgaggtcaggagatcgagaccatcctggctaacatggtgaaaccccgtctctactaaaaaaaaatacaaaacattagctgggcgtggtgacgggcgcctgtagtaccagctactagggaggctgaggcaggagaatggcgtgaacctgggaggcggagctggcagtgagcggagatcacgccactgcactctagcctgggcaacagagcgagactccgtctaaaaaaaaaaaaaaaagctcctttctttaacctttggggaaagatgggggtgttcagagaacccttcccaaagtcgatacctggtgactgttgtattcatatttcaaggtccctcctgccattggccaaacaagaaacatcaaacttttccatttccacatgaaattgtaaataacaccatcttttcctaagcaaacaaaataagactttaaggaatttctggcagaatatgacctaacccccactaactcttgctaaacagtcttccagtctgtgtattgaatcatgtaactatcaaaggatacgtaagactactcttctgggggaagatagggcatacgtatgcctgacttgcatcacaaacctcagctgcagccaaaccatgcagatttctccgactctgcaatctctgggacttggcaccatgactcagatgtgaatgaagtcaggatagttttattttggttggaagtcaccgcctcctgattgatttggcagacgttaagtgttgtttgtcttacagggatttaaggtacttaaagccagaagttaaaatggccatcattctggtggtggcccttcatacgtgacttaaggatccctaaattgtaaggttaagggagctgtggtcccagcctaccagttctggctttacttcccatccagcagcacactggatattgaagaaagtcagtgaaatgttagatccaggggactgaccgctaaaactcccagggtatctagaagagctaagtacgtggtaggggattcgcttttccaaattgaggagggtgaacttcccccaacccaatcaagatcttttggaccaaatgatgtccaactgcttgaaacaactcagctgcacagagacagaaataaacaaaacagctttagtctgaggttgtgtggggcactgcaagatgctgcttctccaattcatctgtccacacagcacggttccccattgaataaacaggttactatccacttatcagagaagttagggaggacctgccttttaatgctgcttagagagacactttgtgatgagaaaagagctcgtacaaaagatttttttctcccccctcccgctgaagtgctggggttgtgtgcttccacgtacatctgggataccattatatttacaaacagaggtctcatagcctgtgtcaatgagcgggaacgttggggaatttggaccccaatttcttgttcttctgcacttgaccttgccttccaattcgttatgaaatacattgactagttttgcttcttccattctacaaatcatgcgaattttctatactaaactgtgttttcccagaggcagtgtaggagggagtcagctggacttggtttccaggcaatgagaggctcccaggtcgatcccattaaggcaatgccctcattttgaatagcagatgaccgggacccctcctcccccacacacctgaattggaaaattggctcggctttgtacaagcccttgcccttaggctgtccataaaataggaacaatactgaagacaatcctgtaagctacaaaagcaaaggctccggcgcgtagtaggtccgtctcctcctcccgccgagggacgccagagttaaggagcttcttgctgggaaggggtccctcctttcagccggaacctgacccgcagaatgtatcggaaatgtgagcagccctagtatcccttccccgtcgacgctcggtgaaaaatcgatcgacgaccgagggcgcgcagtcccttcccctcacacccgccagcgccaggggcgcggtcgcctccctggcctccgcgcccgcggcttggggcctcaggagaaagcgagactccggggcgcgccggcggcggtggctttctgtatcctcgcgggtccctagccccgcgtccgcgtgcgcggcggcctcgggggcgcggcgggagcgggcgtggcgagcgagccggccttcctgctgcagctgctcccccggcggccgggcggagagtgcggattgcgcgcgctcggggcgggggagcgggcgcgcgcgaggctgccgggctcgcgccgcgccgcgccgcctagtccccgccgggccgcccgccccgcccctggcctcccgcgagctgcgcaccgccggccgctgccccagctgcccgagcccgcgccctcgtccgcrcgacccggcggggggctccaggccggcagcatgagcggcggcggcgacgtggtgtgcaccggctggctgaggaaatcgcctcccgagaagaagttgaggcgctatgtgagtgcgggcgcggccgcccaggggcgggcggggggcgctccggggcctgcggaggggcgggggactcccggaggggcggcaggctggggagctcgggcccggagccgcggggggccgggggcgaggagcggccgggggcgtgtggggcacctgcacacctgtcacaggtgggccgccgaggggcggggcgggcggcaggttgaggctgcggctcctgctccgccaggcgggtgcggctgcggcgcctcccaagccggtctgctcgtgaactaaatacagtgtcgaagtttgtattgatggcttctggagaccgagagagttgactctcggggctggggctccgcggcagcccsgagcagcttcagcccgcagggtcggggagagggcgggaaaggggggcgtaggctgtggggccgcgcggacggccccacaaagggcgagcgcctcacgccctctccttccctttctccgcctgcccctcccggccgccggcctccctccgtccgcggctgcatcaccggcagcgtcagcggcatgtgcagcccttgtattaagtgactcatttgtttgtcccccttctttccctttattccgttcgtctctcacaggcgcctcccccgaccccggtgtgacactgcastttggtccccgtggctggcccgggtttgggaccgggcagctcccgggtgtctggggtcgggagagatcgaggctctccgcggccaggtgttgccaaccgacagtgtttactgagatcgctggaacagcctttyccctctaggtggggaactggcagcctgggggaggtggaacagcgtggcgctgagccgtggagttctggctttttttttttttttttttaacccctctccccagaggatgccttgcctggtgaggtcaaagtacaagatggtgccagttactgagatttggccgaaatggtcttggggtagtcgcgggagtttggaagtgggggtaaggttgctggaaggtttcaaggtctctcatctgctccctctccgtttcccatgaaatgcccttgtttaacgggctgtggtgccgaactccgggatcactcccacagcctggaagggagccgttgcctccagctgcagtgcatcaagggagctcggaatagaccctgccctctgtcagctgcaccagtggctgtccatggggggagaggcagaagcctaccagaatttcctgtcttggctccccagatcagaatcaagggacttctggcctctggactgaggaagtgacattctgtttttcaaaggaagtgttgttgttgcggagtacaagtgtgtgtcaatgaaatcaggctcttaggtagatgtttgctgggggaaaaaaatctaaggatttagcacatgagttttgaaagtggacgtggatttataggaggaatgaagcagtgaattgttcatctcagttcggaagctcatttttaggagtgtctatgtagccaaagtataattattaagaaataaacttttttcctcttcagggttgtatcagttcgttaggaaggttgaatattttaattaggattaaggagcagtgatttactattaacaattttataaataatttaaaaactttgtcccgaagagcttccaaaaattatctatacaaatagatttccatacaagctagtggaatacagtgtccacagtaaaaaaaaaaaaaaaaaaagtgacccttaattttcaagtttgaacactatacactaaagaaccttgaaagttgtttttgaaacaatttgcaaacagtatgacactgtatctacatttgacttatcgctccttgaactctcacccagactctatgacccatttcttgggtgtttttgttcccaaacaactttagttcaaaataaccaggtttggaggcatttgggtcaagcacctttttcactgatttgaacgaatctagtcgtatgatggccttagcctctctttcccatcttccatgtaccttcagcccatcaggtgtcagaccttaacagctttaagtaacagcttttcttaggttaggatgtgatgtgttcacttacatgactggaagcctctgccccttcggaagttcagtttccccctaactgaaactggtgatatgtgtaaccttaagsctctggggaacagtatgcctttacatctacttttcttttggggtattcagaatttttgcatcctgttgtaagttaaaactctgctagtttgcttatttcagtagaggcccgagttcattagaaccaagcttggaaagtatttcccagccccatggctgtatatttaccccaaagtagctgctgcttctggtatacatcataggcgtgttatattgtagattgagaaatcctcattataagaatacatcgagcatatgtgataaggggaaaaagtagttgaactaggttataactatttaaaacgattttttaaaaaactgacttaatttgaagtctgggcgcagtggcttatgcctgtaatcccagcactttgggaggctgaggcgggtggatcactggaggtcagaagttcgagaccagcctggccaatgtggtgaaaccccgtctctaccataaatataaaaattagctgggcgtcatggagggcatctgtagtcccagctactcaggaggctgagacatgagaatcgcgtgagcccgggaggctgaggttgcagtgagccgagatcgtaccactgcactccagcctgggtgacaaaacgagactccatttcaaagaaaaacaaaaaaacttacttaattcggaaagacgggaaggtgtagaggggaaaaacatcttagaagaagcaaaggcaaatgtttgagcaattagttttcagggatttttttcatcagccttttctagttaattaagtataagtataagagacctatctgctatttactgagtgccctggagaaattgcaaaaagtgtctctggaaaatgctgactattgcctctggggcatcctgatatggctgcagtgggaggccggcagaagtaacaaccctcccatcgtgcctcagtgtatttgtgtgtgtatgcgcgtgcatgcaaatgcatacacacgtacatgtatataattattaaacagaattttcttgaggaaaaacattttattaatatgacctacactgcattgtagttttctatcaatttcactggattaaaagattgagggaataagattggcagactaccccctagtggctaacttgaagaaagttgtgcacaaattgtaaagaactactgcattaaggtaacagtaattgtttatttccattatatttattaaatatacttattaaatctatgtcccaggcactggatcaggtgcttggaataaaaatccagtaaacagaaaaaaaaattaatccagtctttcagtcttagcaatggctttgccttctccttcaaaggaaaattgaaatgatgagggagtagttgtctgtacgtacgatgaatggccacattttcaaatttacttgtatctgcatagttcctttctttcttccttttttttttttttttttttgagacagagtttcacttttgttgcctaggctggagtgcaatgcacgatctgggctcactgcaacctttgcctcctgggttcaagcgattctcctgcctcagcctcccaagtagctgggattacaggcatgcatcaccacacctggctaattttgtatttttagtagagatgaggcttgaccacgttggtgaggctggtcttgaactcctgacctcaggtgatccacccgcctcggcctcccacagtgctgggattacagacagacatgagccaccgcgcccagcctgcatggttcctttcttgtttccttttcttagagtagatgaagtgccacttytatctgagctaatcctgctacttatactttgaatcatatcttctcctccctactcaaataattcttatcctgtaacacatcttcaacttctttccctctctgtactacctactttttttcagggataaacttggtggtggtttatgcagtcttcctttctcccaccttcttctcagtcggctccagtggaaacctactttgttattcaccaaagctattctgacaaaggcaccagcgatacccaggtcactaaactcagaggatgattttttactcctcattttaattaatctcttcactgcttggtcatagttgaccactcttttttaaaacaccttcctcttatcttggctgacactataaatgcctgttatttctccttttctggctactctatatttcctttgctagactgacccttttatccagtccttaaaggttgaagctcctttatagtcatagtggctgtgtggtttctcccctttggcaaccttgtccattctactggcttcagttatcatttgcatggtggtcatcaagttaaatttccatctcagagttgtgttctgaacttcagacttacatatccaactgttaactgggcatctctatttgaatgtttcccagtcaacacaaactcaccacttccaaaactaaactcttctttgttcatctcttcactccacatctgctcagtaaacagtgccactaagcacctacttgctcagatgagaaacttgggcatcatctttgactccccgtcacccactatcccacatctaatctgtcaccaaaacccattagtggtatcatctaaatatcttgttataygcttcttcatccccactgccatgacttttaggattattttagtagccatctgttgagcacttactttgtaccaggcactatgcttagaccattgatcttttaatgtagtaatttagccctataataagggaagcaacttacccaaagtcatctagctttgtcctaaagcctgggctttttaaaaaaattaaacatttcattttgaggtaattctacatgcacatctagttgtaagaaatagtaaacaaagatttatgtagccattatccagttttccttaatggtaacatcttgcaaaattatagtacagtatcacaacagtatattgacaatgatacagtcaagatacagagcatttccatcatgataggattttttatgttgcccttttataatcgtattcactaccatcccacccctaccacatccttaatctgtgacaactactaatctgttctctgatatttcatgtgtgttatttaaatggattcatgcagtacttaagattttgaacttttttttattcagcataattctctggagattcatcctcatttcatgcatcaatagttattgttttttattgctaagtagtatttcatggtatggatgtaccacacagtctgtttatttaaccattcacccgttagttctcatttacatttcccttatggctaatgatgttgaacatcttttcatatgattatttgccatctgtatatcctctttggtcaaatgtcttcaagaatttgagtattttatatataggttttttttttttgagatggagttttgctcttgttacccaggctggagtgcaatggcatgatctcggctccccaggttcaagtgattctctttgttgttgttgttgttgttgttgttgtttttagacagattctcactctgtcacccaggctggagtgcggtggcacagtcttggctcactgcaacctctgcctcccaggttcaagcgattctcctgcctcagcctcctgagtagctgggactacaggtgtgcgccaccatgcccagctcatttttgtatttttagtagagacagggtttcaccatgttggccaggatggtctcaatctcttgacctcgtgatccgcccaccttggcctcccaaagtgctgggattacaggcgtgagccactgcgccggctttcctggttttttttttyctacacattttacaggtttatgtttttcctttaagtccgtgatccactgtgagttaattttcatgtaagatgtgagacttagattgaggttcttttgttgttgtcattgttgttgacaaagccatcctacttccattgaattgcttttccgtctttgtcaaaaatcagttggacgtatttgtgtgggtctgtttctgttgtctctgttttggtccatttttccatgtgtctgtccctctgcaaataccatagaatcttgccaactctagctatattgtaagtcttgaaatctggtagcctgattcctctactttattcttatttttcaaagtgttttagctattctattatctttacctttcaatacaaattttagaataatcttgtttatgcaaaaaaaagaaagtcttgctgagattttaataggaagtgcattaatcctgtgtaccaatttgggaagaaattacagctttactatattaaatcttccagtccatgaatttattttacatttatttatatatgtctttcttccttcgtttattttcttctccttccaccatcccccccmccaaccacccccaccagaatcttgctgtgtcacacaggctggcgacagtggcacaatcatggctcactgcagcctcaaattcctgggctcaggtgatcctactgtctcagcctcccaagtaattgggacgacagctgcgtactgctgtgcctggctaatttttttttttattatttgtagagacagggtctccctgcgttgcccaggctggtctcacactccggagcttaagcagtcctcccaccttggcttcccagagtgctgcgattataggtgtgaaccaccatgtctagccttctggaagagatggtgtagaactggtataattctttaaacctttggtagaattctccagattaaaccatctggatctggaaatgtctttgttaggaattttttacatttttaatccaatttctttaatagatacggggttcttcaaattatctacttcatattggctgaattatagaagtttacatttttcaacaaattggtccattttgtctaagttgttacatacatgtgagtggagttacagtatcctgtattatgctttcagtgtctgcagggtctgtagtgggtccactgctttatttttttaacccttattcttgcatactgacattgcttcattattattttttgtttgttttttgagacagcatgtcactctgtcacctggggtggagtgcaatggcacgatctcagctcactacaacctccacctcccaggttccagcagttctcctgcctcagcctcccgagcagctgggattgcaggcatgtgccacaatgcccagctgatttttgtatttttagtagagacagggtttcaccatattggccaggctggtctcaaactcctgaccttaagtgatctgcctgctttggcctcccaaagtgctgcaattacaggcatgagccgctgcacctggcctctgatttttttatatagtagtttattcatttgagacttttcctcttatttaatgtattcatttactgctatgaatttccctctcagcactgctttagctgtgtcccactaattttgataaattgcattttcaatttttatttgctcagtatatatatattttttttactttccttgagactttcctctttgaccatggattatttacaagtacattgtttagtttccaaatgtttggagattttcccattatttttctgtttctgtcttttagttggaattcattgtgggagtagagtaagttctatttgatttcaattatttttaacttgtcaaggtttattttattgctgaaaatgtggtctatcttgctttaggttccatgggtactttgaaaagaatgtttattctgctattattgggtaaagtattccataaatgtcaattatatctttttgattgatagtgatatatataattcttttatatccttgctgatttttctatctagttcttctgtcgattgttgagagacaggggttgaagtttccaactataattgtgaatatttctgtttctcatttcacttatatctgtttttgtttcacatattttattttttttattatttttttggagatggagttccgctgttgttgcccaggctggaggtgcaatagcatgatctcagctctccgcaacctccacctcctgggtgcaagcaattctcctgcctcagcctcccaagtagttgggattacaggcatgcgccaccacacccggctaattttgtatttttaatagagacagggtttctccatgttggccagactggtctcgaactcctgacctcaggtcatccgcctgcctcggcctcccaaagtgctgggattacagacatgagccaccgcacccagccctgttgttcaatatatacacatttagaattgcaacatcttcttggtggcatgacccttttatctttatataatacctgctgagtctctggtaatttcttttgctctgaggtctacttgttatctgatatattatacaagtatctgagggctacttgatatattatagcctatatctgatgatatagttattcttgctttccttttattgatattcacatgatacatcttttccatcaatttactttcaacctacccatatcattgtatttgaagtgatatcttataggtggcatattgttggggtgtattaatccgttctcgcactgctgtaaagaactacctgagactgggtaatttatcaagaaaagaggtttaattggcccacagttccacaagctgtacaggaagcatggctggggaggcctcaggaaacttacagtcatggcggaaggtgagggagaagcaggcacatcttacatggctggagcaggaggaagagagtgaggggagaggtactacacacttytaaataaccagatctcacaataactcactcactatcatgagaacagcaccaaaggggaactccacctccataatccaatcatttcccatcaggccccacctccaatatttggggatgacaatttgacctcagatttgggcagggacacatacccaaaccatatcatggggcatgtttttaatccactgtgctgatttatgtcttaattggtatatttaaatttacacttaatataatttctaatatgctagagcttagttctgccactttattttttgtttgtgttctgtttttgttttcttcttgccttcctgtgagtttcttgaatattttttagaattccattttgatttatctatatagtgtttttgagtgtatctctctatacagcttttttagtggttgctctaggtattatactgtacatacaacagtcagttggtgtcgtcttataatctaaatgaagtctgtatcatcattttacaagtttaagtaaagtatagtaaccttacctccctttatgtccttttgccatcctccatatataattgtcttaaatattttttttatatcagacagtgctataatttttgcttcagtcattaaacctaatttagaaaactcagaaggaaagactatttaattacatttttgtttactatgtgctttcttctttgctgatgttttcaggttcctctttttttcatttcctttctgtttagagaacttcctttagccattctttagggtagattggccagtgataaattgtctttattttccttcacctgagaaggtctcattttccccttcattctgatattttcactggatattgaattatttagttgacacttcttttctttgagcacctgtaaaatactgcatcctttccttctggcctgcatggtttctaatgaaaaatccatggtctttccaattgctttccctcaggaggtaaaatgccctctttttctttcttttcttttctttctttctttctctctctttctttctttctttctttttctttctttctttctttctttctttttgggacggaaaatgccatctctttctttctttctttctttctttctttctttctttctttctyactttctttctttctttctttctttgagaaggagtttcactcttgtcacccaggctggaatgcaatggcactatctgggctcactgcaatgtctgcgtcccaggttcaatagattctcctgcctcagcctccctagtagctgagattacaggcgctcaccaccacgcccagctaatttttttgtatttttggtagagacagggtttcactatgttggccaggctggtcttgaactcctgacctcaggtgatccacccaactcagcctcccaaagtgctgggattacaggagtgagccaccacgaccagctcccatctttttctctggatgcgttcaatgattttttttctctttattttcagaattttgctatgtgtcttggtgtggaattttcttgagtttatcctgtttggaactcactaaacctactgaatctttcttactacatttgagaagttttcacccattatttcaagtactttctcagtcctaccctctttcttctcttcttccaagaatccaatgacaaaactgttagatcttttgttgtagttccatagcttctgtagactctggtcattttttttcagtctgttttctctgtgttgttcatattaggttatttctactgtcctgttttcccattcactgattctatttctctgtcctcactattctgccattgaactcactgatgaacttttttattttggtggttatatttttcagttctaaaattccatttggtttttctttacatcttctatttttttactgagactttgtttctttttggaggctttccaattttccatttgttccaagcatgtttgtacctgcatttttatgatgactctttaaaatctttgaaagataattctaacagctctgttatctcagtgttggcatctgtcgattgtctttttcattccatttgagagcttcctcattctttgtataatgagtcgttttctattaaaacctggacatttttggctcacacatgtaatcctagcactttgggaggccaaggcaggtgagtcacctgaggtcaggagctcaagaccagcctggccaacatggcgaaaccctgtctctactgaaaatacaaaaattacccaggcatggtggcaggtgactgtaatcccagctacttcggaggctgaggtgagagaattgcttcaacccagggggcagaggttgctctgagccaagatcatgccattgcactccaacctgggcaacagagcaagattctgtctcaaaaaaaaaaaaaattaaacgtggacatttttgtattgtgttgtgatactctggatctaatttaaaccttgtgttttatctggatttctctgaccctgctgcaatcatcggaaggggacactgccttagtactttcaagtagaagttgaagtccaggtttttcattccacctccattgacactcccgataggaaggtagtcctcattactcctgtgaatggtttaaggttccaacttcccatgtggtctccagtgactctacagggatgggtgccttattaccagtttttgggtatgcatatcatagctttctacttggctttctttgacaccaccctagcaggtgtcacctggcctcatgacaacctctgaagggtagaagtctaggttgtcagtcagtttttgctgctgtgggtgagggttggaccacagtttgctctgcggtgtttggctggagtagagcagttattgtttagcagtttcgtctcttgctaggctgctcctttcccagtcctttggctagagagagcagactttctttgggaattttttggtctacacaggttggtgtttctgccatgctgactgcttcagctccaagtctgagatatatgaggcataaagaaaactcatggaatttatcactgtgtcattccttgggttccagggtccctagcaaatctgccgcctactcttcaccttttagattcttcttaagcttgttttatatgtaatatctaaggattttagttgtacttagtggtgggaatagggaaaagtatgtctattccatttacccactgtgtatggtcttgaatgttgcttatacaaaagcacttgttaccagtaaacatatagtatagtagtggcaattactagatattttattcccatgttaccagaggagaaactgagcacagagcttaagtgccacacatatagtaagtagcagacccaggactacaaaccaagtcttctcattaaaatccatgtgcttggccaggcgtggtggctcacgcctataatcccagcactttgggaggccgaggcaggtagatcacagaggtcaggagatcgagaccatcctggctaacacagcgaaaccccatctctactaaaaatacaaaaaattagccgggtgtggtggcaggcacctgtagttccagctcctcaggagtctgaggcaggagaatggcgtgaaccggggaggtggagcttgcagtgagccgagattgcgccactgcattccagcctgggcracagagctagactccatctcaaaaaaaaaaaaaaaaaaaaaaaaatccatgttttttccccacattctgtggattaggattctgcctttatttttttaatttttactttttacggatacataatagttgtaaatatttatggagatgtgaaattttgatacaagcatataatgtgtgcttaggatactcatcacctcaaacgtttatcatttctttttgttaggaacattccaattccagtcttgttattttgaagtatacaataaattattgttaactatacttgctctatcttgctaccaaatattagatcttagttcttctaactgtatttttatacccactaaccatcccttctttatacttctcttcccactgtcctttccagtatctgataatcgttattgtttctctatctccatgagttcagtttttttagcttccacatatgagtaagaacatgcagtgtttaaatttctgttcctggcttattttgcttaacataatgtcctccagtaccaaccgtgttgccacgaatggcaggatttcattatttgtatggccgaatagtattccattgttattgttgttttcaagacggagtcttgctctgttaccaagaggtgtagtggtacaatcttggctcactgcagcctcaacctcctaggctcaagcgatcctgccacctcatcctcctgagtagctgggactacagacatgcgccacccggcctggctaattttttgttttattttttgcagaggtgagggctcactatgttgcccaggctcatctcgaactcctgagctcaagtgactttcctgccttggcctcctaaagtgctgggattaaaggcatgagccactgtgcccagccctgaataatattccattgtgtatatgtaccacattttttaaatgcattcatcgattgatggacacttaggttgattctgcatgttggctactataataagcatgggagtgcagatatctcttcaatacattgatttcctttcttttggatatatagccagcagtgggattgctagatcatatggtagttctatttttagttttttgaagaactatcatactgttctctatgggggctgtactaatttacattcctaccaacaatgtgtgagggcttccctttctccacatccttcccagcgtctgttatcacttgtctttttttctgtagatacttagcatattttacaaaaaaaaagaactgaatgccagcatatatgactttgagctccttatatattctagttattaatcccttgtcagatgagtagtttacacatattttctcgcattctgtgagttgtttcttcatgttgttaattgtttcctttgctgtgtcaaagcttttaagcttgatgtgatcccttctgtccgtttttgctttggttgcttgtgcttttgaggtcttgctcaagaaatctttgcccagaccaatgtcctggagcatttcctcaatattttctactaatagttttatagtttcaggtctcatatttaagtccttaatccattttgatttcatttttaaatattgagaaagataggggtctagtttcattcttctgcatatggatatcaagttttcctagaacatttattgaagaaactgcactttttccagtgtatgttcttggcacctttgtcaaaggtgacttctgtcctactttagcatagctagataatttctgtttactatagtccatttgcaaaaaggtagccatttacaaatgtttaaatgacgagattattttaaacttacatagtattgccataattatcctgcagtttaactctttaaaactcaagcaattattaattttctttttaagctatagggtaaccctagcagtttttaaaaatttaaacttcgtaaatatgtttaagtgatttgctatccttgattagtatcttagtccattcaggctgctataacaaagtagccttagctgggtggtttataagcaacagacatttacttctaaaagctctggaggctggcaagtccaagatcaaggcactgacacattcagcgtctggtgattgcccacttcctcatagacaatgtcttccattgtgtcctcacatggttgaagagggaaagaagctcctcagggtttcttttataatgtctctaattataatgtctctaatttatgagtactctgccctcatgacctgataacctcccaaaggacccacctcctaatacggtcactttagggattaggattccaacatgtgaattggggtggtggggcgggctggggcattgtgaggcagaagcatgcagttcattgtaataagatgattctttaaattttctaaaaggtgacttttaaaagtctgctcatggccgggcgcagtggctcatgtctgtaatcccagcactttgggtggccgaggcgggcaggtcacctgaggagtttgagaccagcctggccaacatggtgaaatcccatctctaccaaaaatacaaaaattagctgggcgtggtggtacgtgcctgtaatcccagctactggggcgattgggggtgggggtgggggggtgcggctgaggccggagaattgcttgaacctgggaggcggaggttgcattgggctgagattgtgccactgtactccagcctgggcgacaagagtgaaactctgtctcaaaaaaaaaaaaattttttttaaacaaaaatgaaaatgtatttagtataatttagttcagtaatttatcaaacaattagtatgtgccaagtgcccaagttctgggactgcaaagaaaaaaaagcaaaggcttcctagagaagaaaaagcaaaggcttccttacttctaggacctgactagatagaagtaatccaagagaagaaggtttttcaggtagagggaccactaagagagtagacaaggtggcaaggacatacacagtgtgtgcaaggacactaaaaacagttgggtgttgctggattatcagcaggatgattggaatagaaggctttgaagctggagaggtaagtaagagagaatacctgggctggtaagaacaggggaggggaagatcttcaaaaactggagtccattcaagacttgtttgtagaccatcctaggcagccagggcattattccaacagattatttgagtatttaaataaataattctatatggttcatataaccagatggaaattcattttagtaggtttctattgtggtcctaatcactggattatttcttcgattatattcacagcattaaggagactgttctaaccagttcaaggccagtctcctgagctttttatcattcacattggatcagaacttctcatttggaagcaactcaagtgtccaccaacagataattgaataaacaaaatgtgatatgtgtgtgttcatatatacacacatatacatatcacatatatgctatctggtatacatatatatacacacacgcacacacactggaatactgttcagccttaaaagggaagaaaactttaatacatggacatgctacaacagagatgaaccttgatgacattatgctaaataaaaggagccagacacacacacacacacacacacacacacacacacacacacacgaatactgttcagccttaaaagggaagaaaactttaatacatggacatgatacaacatagatgaaccttgatgacattatgctaaataaaatgagccagtcacaaaaggacaaatactgtatgattctacttatgtgaggtactagagtagtcaaattcagagagacagaaagtctagtgctagttgccaggggctaggggtaggggacaatgagcagctattgtttaatgggtacagagtttcagttttgcaagataaagggttctggacattggtggtaatggtggcaacagcaatgtgaatgtacttaatgccactgagctgtacacttaaaaatgataagatgataaattttgtattctgtacattttatgacagttttttttttttaaacctcacttggtaaaggttagtaattggtcttgctcatatttctaacccaagagaaaagacaggatggaatctccacagccatgaatgattatggaatattctctcagtgacatgtaaggacctgaggcaatgaagttgcacagagctggaagacatgcctgctgcttcgcttaatgaaacaacctttttttttttttttttttttttttttgagacagtctcactctgtcactcaggctggagtgcagtggcacagtcttggcttgctgcagtctccgcctcctaggcgtaagcaattcttgtgccttagcctccagagaagctgggattacaggctgcaccactatgcctggctaatttttttgtattttcaatagagatggggttttgctctgttgaccaggctggtctcgaactcctggcctcaagtgatctacctgcctcagcctcccaaagtgctgggattacagacatgagccactgcgcctggccttaatgaaacacctttgatgttgctttttatctctaggtagaaagggacaatgagatatagtaactttaagcttataagaaatgctgagaaatacaggttcctgagcaggctgttgtctacatccaaattaattttgacaggtgtttatagagcatatactgtatcctttcccttcccaaggtaataaatcagtactcatccctgccttcaaggcatttgcagactagaaagactagaagtctacatgtgaaacagaatgatgcccttatatggagttatccaggcaccaagttgcgtgaaggcaaatgctcttggtgtggaagaagttggaggggcttcctggaataggaggtggacatgtgagttggactcaagagataagggcctaggaaggaatatggtgttcaaaatgagaaagaggtggtgcacatggggtgtggggccagtaaaattccatccagagtggaggaatctgtagcagaaagcaggaagttttgaaagttcagagctggggggaatattttataattcccagtaaatgccttagatggtaggatgacatttactgataaagagcatcactaactcagtgagtctttccctcacagatggccacttcttcagtgtgaaatgtcagtgtatattgacaatgtttatgttcagaaaacctctcagtatttcaaaggccttagggtcattaagcaaatgacttaattcttttaattcactgaggccacttctttgtctgtaaaattagactaatgcttcttatttcactgggtttgcacatttatcagaataacatgtgaaaaaaatcttagcacagtgtctagtccagagtattaagtactgggggaggtggcatagggatgatgttgacttacatttattaacctattcataggaactctgaacatgagcatgggtgccttcacatccctttcaaatttgagccatacctggaatgtacaatgtcagaacataactgaaattctcaagctgggtagcacatcaaattttagggagttaatttttcctgaaaggaacagctcaaggatctgccagtctcatggaagggaaattaaaccacacagggatttgtctgaagctatgactttggccagtcgctgggaaataggtgtgtgctgggggatgtaaagatcaatatgtgagatcctggggccaatgtttgagaatggtttaaaatgcaaaaacttctcagtaagtggtaacccttcaaaggttagctcagattgcctaccctgcaggatcctccaaagggagccgccttctgggcttgcttccatgacacttttttcatctctaattcgccattctcacattgggctatcagtctccctttgctagattatgagccctttgcttgagactgtaagcagcttggtgcaggcttgatgccacttgtaaggcagcagctatcatcaaggtaatttcagaagtcgctgatattctttacaactaattacccctctaacccatttttatgctggcttcttatttatttacttgctgtcagagtagtgagtgagttccttaggatccttcaaagtgatcaattagggtattttttagtatcattataagctcacatgtttaaacatattccatgcatttgaatctgttagagttgttatccttattgaaagtcagattgtcctatctttaaccagcaggagcctattcgagttgatttctggatccttttgacttgaccctactagtctttgataatttctttgttctctggtatgacaagatgttccaagtttatcttgtacattttctgacccagacctggaattagctagccatttcctcagagtcctggtttcttctagtaaaagtggtatgccaaaatccatgatgggcactaagggtgctaattgctattgctgttattttggccacacgctcattttttacatggttataaccaacatcagttatcactttattttttttattataacattgtgaattttttcacttatatctacatagtattttttccaatttttaattatgaaaaatttcagtcatacacaaaagtaaagaatactgatgcacacaatttcaaatcttatcaagatttcatcacatttcatctatctgtttttctgtttctttgctggaatatttaaagcaaatactagacatgtacataagtcttataaatatcacgtaagtgaatgtaccacacctgtgtgcacattcccccagttaaacatttgttacttccagttattcactgttgtatacagtgcaggcctgtcatgtcatataggtggcatgtctgagagtttcacccatgttcatgagccataacatttaggtgtcattaactattaccacagttcactgcgaagattttctcgggtagacagcgtgtctttccttagtgtgcattggaagaacatgccaattggagttctgctgacttgcaagagcaggggaaagtgctaagttttacgtatagtatcatgaggattgttgaaatgagtttgttgatcttttcatataatttcctagaggaaaacattgagtataggccagggatgtgtgtgtgtgtgtgtgtgtagctattcacaggcaggaccatagcacactacagcctcaaactcctgagctcaagtgctcctctcacttagcctcctgaatagctgggactataggtgcaccactgtgcctggatttacttttttggataccaacagagactataacttattgaggctaaaacctgttagaggtccacttgaagatactgtcattaacagatagtaagtatctacagtgtacataagtatctacagtgtacatagtattcccctcaaagtttatagtcttggtggggaagcagcttgaatgtagaatgtactgccaggcagtacatactacacaaatgacaaagaccagtgccataggagtccggaagagattggtctagtgtggtcagtgaggttagtgtcataagacctatgtttagattttacttgtgggtaatctgccatttcacctctgtgccctcatttcctcatatgttcttaggactaatttcacttgccaccttgtggcagtctttcctgcaccatccacctcatcagaatgaattatgaagctccttcctctagttcacctgtgtcaccgtcaggccttagtaccactcagtaactgttggtttacgctgtgcttcccctaaaatggtagcttttccaatgcaccatgccctttgttcatgttcttgtagccttggtacctaaagcacagtaagttattggttcattagtgctttatatgcttttaagttttgaacaaatattactcaggattggttatattgccttggcgaaaaaaagagtttgaactggaattgaattgaaaatgtgatttggttttgggttttttttgtttgtttgttttgcaacaggttttgggaactttcatagtatacgctattaaacatggaatttttttgttaatacttgttttattcacaataaagtaattataaacacacatcacaaaaataatattaataaatagcacttgtaatactcctgtcaagcctaaacattaatattttagagtatttcctagtctctttttcctgtatttatatgtgctatgtatattttacaaaatgaaggtgaggctgtttcaccctttgtgtgctttaagttaatatattgaaaatatttccctggccgggtgcagtggctcacgcctgtgatctcagcactttgggaggctgaggtgggtggatcacctgaggtcaggagttggagagcagcctgaccaacacagagaaatcccatctctactaaaaatacaagattagtcgggcacagtggcacatgcctgtaatctcagctgctcgggtggctgaggcaggagaatcgcttgaacccgggaggcggaggttgcggtgacctgagagcactccagcctggacaacaagagtgaaactctgcctcaaaaaaaagaaaaaagaaaaaatatttccgcatcacaaaatagtcatctacaacataggtttttaatggccacagagtttctcaagcatgtgtaataaggacactttaaacatatatttgtactggttcttgctgttgaattaaattattttaattatttctttaccaaaatttgtataaacaaaaactgtgaggtgtaaacatgttcttatagctctcccacaattatatatgaaaacaaatttacaaattcaatttaaaacttcagaatccatataattcacgttaacaacagtagatattttgctgaaactaaattggtgattcagatgtgaatatagcacttctttgatgcctgtctgtcctgtgtcccatacttttttcctaccacatttctttgtttgaactacggtgaaactttgctttgtgtagcaaggcattggcttttaattggtatgaccacattatttataagctgtcacctctgtcctttctgattagtcattagtatatgaaaattaaggaacttactacttgatatctgtaagattttaaatgcaaatgctggcaatcaaggatcagcattcacctgcaagatgattcaggtagtcgatactatgcttatattttttaagaagataatgcttgagttgaaaactcaagattgaaaaaagaaatgtgtactggctttgcagatccctaaggatatgttggatgctattttgaaaaatcctcatgtaatcataaaaagcatgagctctgaggttagtcctggattggaatccaaactaaacctcccatatgctttgtgggtgtgggcaagtttcttaatctttctgagctttaatctcctagtctgtaaaatagagataatggcaaccttagcctgttaattgaatagttttcgcttagaggggtgcaaacatgaacaattgtgtttttctccagtcagaactcccaactgctctgtccaaatctcccttctcctctcaaggacagatgataccttaggcagagttcacaacctcctggtcacactgggttactgaaagttgaccatttgaaaagttcagtatatctaattgaaaggtttacttactcctgttactctaaccaggcttgtggctattgggatatgaagtgggaaaaggtagacttggttggtttgtttttgagatggagacttgctgttgcccgggctggaatgcagtggcatgatctgagctcactgcaacctctgccccctgggttcaagtgattcccctgcctcagccttctttgtagctgtgattacaggcatgtgccaccacacacagctaatttttgtacttttagtagagacacggtttcaccgtgttggccaggatggtctcgaacttctgacctgatgtgatccgcctgccttggcctcccaaagtgctgggattacaggcgtgagccgccgcgcctggcctggttgattttttttactcctcttccccattcttcaccttggagagtgtaggggtgggaggagatacagtctctctctgatatttcttccctggcccttctggtctccagtcattccagtgcccagttgcccagtgtgtaaaatgagcaagagggcgagggacaaggatacgagtctcttcactggctgctcttgagtcctcctagatggcatttacaggttgcctgtctagcactgtctgtgggtccactccccattgttgtgagttctttggagggtgggcttcctcaccgcatgatctccagacctggagaagaaactggtatttagttcttttcrtctctttcaggacatcctcactcttctctggtaccacctggccctggtccacttgcttattgggcagccgttttgggtggggaactggcaagagggcttaagaccagcaatttctatggactgtatgacccagggaagacatatctgtgccaaacagtggggtaacagcagtgctgctccttcttgctcagtttctccttcctctgtccagattggtgcaggccaaatctgtaagtcgactgcctgatcagatattcacaagacattacactttttaaaagttattaccccaaaccttttcttttcttttttcttttttggtacccctagtctctgtaactgatgatcttggagcccaccgtggggtagggagaggaccaccccaaaatacagcacattatagtaggtcagggaatccaagatttcccctcttatctctgctcttcttttgtggactgtggagggagagggacagtgcaggagcacatggttggggtagaagatctcatagtatagcttcttttttgttttttggtgttttttttgagatggagtcttgctctgtcacccaggctggaatgcagtggcacgatctcggctaactgcaacctccgcctcctgggttcacgccattctcctgcctcagcctcccaagtagctgggactagagatgcgtgccaccacgcccagcaaattttttatatttttagtagacatggggtttcaccatgttggccaagatggtcttgatctcttgacctcatgatctgcctgccacggcctcccaaagtgctgggattacgggcgtgagccaccacgcctggcccatagtatggcttcttaataaattctttaattagcctggcaccagttattgactgctgtctttaccttgtggggaactcacctcctctctgtctttagttgtgagttctatttaccaattgtggggcaactgaaaaagtcacattcaacattctcttacataactaccttatggatttctgtggtattaaatatgataatgccaggcacattgtaaacactctataaataagtggtaactgttacaattattgcagtgccaaatttatttgattcttctgttcttggatattttagtccttaactattttccgctattttataatagataatgctgtgatgatctttagagcaaagacttttatccttaggatgaatttctgcaaaagagggtctgattcaaagggtataattatttgtaaggctttttgatgcatcataccaaattggctctcagaaaggatagttttggcttccctgattcttctttgatattagacattttaattttttaatacttgataatttgataggtgaaaaaatagttgttttgatttggatttctttgattgctactgagtttgaatatattttcatgtattattggctcatattttaaatgacttgttcaaatgcaaggtgctttttgatacastttattcgtgtaattgggaaaactgtgtgacttcaggcattgtaataagggaacttggaataactagagcgggggaatctccagcagtagggagggaaaagattgacctgacctgatgttcctgttaactcagcagctcccttttgagacctttgcagttgtgattccatagatttcccccaggcagccttttgatctttactcagtttcaaggcctgcctcaaatgtcacatggtttgtgatacttcctgatatcctcctgaaggagatttatcttccctcaacatcctgcctctctgcagctcctatgatgttgcagcgtgactgtgtttttagtctcttctcttaattatggggacttctcaaggatagtcatctttcttttctaacctggtgtttggcacataggtacagaagcaagagataagacggtggaaagtgttgcaagaaagtagaatagggtgattaactccacttggagtggggcagtgtcagaggctgcagagaaaattataattgagctgggatgtgaagagtgaacaggagttcatctacagatggaaaagtaacatttcaaataatgagaacagtttaaaggcctaaagatgtgagctcatgaatgtcgaggtaaggtgtgtggatggagagggatgaagaacaaggttcaagtgagtctctctgttctccccagtacccccatcttcattacctttgcccaccgtggtctctgctctgtccagagtatcttctctctcccctgcctcctcagactctatcgatcattccacaaagttactgaatacctattatgtacttgcatcaagagaaagaggcaaaaatgggttcatggacaacttggaatggcatcataggaatgttagccccatcctgaaaagccaagcagagtagtgccttacccatattccttttcgactgcactgattgttcctaacaactgaaatgttttctattgtagcatctgtagataaaatagataacaatcaaaagagttacagtttatttagtcccttgtgatgggacagtggtttctttctaactaggcttaggcaaagaaaatacagttttcttcttcttcttcttttttttttttgttcgagaaggagtcttgctctgtcacccaggctatggtgcagtggcagaatctcagctcactgcaacctctgcctcctgggttcaagcaattctcctacctcagcctcctgagtagctgggattacaggtgcgcaccaccacgctcagctaattttttgtatttttagtagagacagggtttcaccatgttagccaggctggtctcactcctgacttcgtgatccgcccacctcggcctcctaaagtgctggaattacaggcatgagctactgcacccaggcagttttcatattttctatagctgtctgcttctctgtcagtttccatctttgttccagtttctttggcttcacgatacatctttggtcatgattaaagcatgcccaaaagttaatgccataaggtaaccattttattttactcacagattgtgtgggtcaggaattcagagagggcatggcaggaacttgattctgctccccaatatctggggccccaactgggaaggcttgaatggctcagagtgacttgactgctaggaactggaatcctccgaaagcatcacttacatacctgtcaccagggctgggatgactcaaaggctctgctcagctgcagttgttgatgagagcacctaccagtggcctttacatggagcccaggcttcctctcatggcagtctctaagcaatcagactgcttacatggtgcttaagggctccaagagtgaatgtcttagtggccaagatgaagatgtcatggccttttttagtgacctagccttagaagtcacatagtgttactttggccatacttcattgattgaaggagtcacaagtccactcagattcatggaaagggaacatagacttccaacctcttggtagatggagtatcaaagaatttgtggtcattttaattttwattttatttatttattttttaatttagagacagggtctctgtcacccaggctgttgtgcagtggtatgatctcgtctcattgcagcctcaacctccmgggctcaagcgattctcccaactcagcctcctggacagctgggaccacaggtgcatggcaccacatccagctaatttttctgtattttgtagagatggtgttgcactattttgcccaggctggccattttttaaaactgccacaataacatttatttttcaggataaagtctcctttgaatcttttcaaaggtcagcttcctaatcagggctctttgagtaaatacttccgctttcatagtaccgcccacttccctatttctgctggaaatcttacttggycaaggcagggatttcatctgcgttattgatctccagatcctcatcaatctagaacagtgtctggcaaaccgttgatgtttaatacatatcacggattatgtaatgcttactatgtatctgtgtgagagagaagaggatatctacattggtatctgtggaattttctacttcagtgtctaatttctgatgtattcctgagtcacctgttgagacttattctgtctttcggagtgatgtgcatgaacccattattggaggagatcgcggtattggacatctgtctcraagtctctatacactgagaactgcttgtcccaaccataggcctctataggtccaccagtctcttagcaatttctttatatatatctatatatgctggagtgcaatggcaccatcttgacttgctgcaacctccgcctccctggttcaagtgattcttgtgcatcagcctcccgagtagctaggattacaggcacctgccaccatactcagctaatttttattttcttttttgtagatacgggatctcactatgtttctcaggctggtctcaaactcctgggctcaagtgatcctcctgccttggcttcccaaaggaacaagtctttttatgagactgtttaaggcctctgtataagttgggttgacctagtgagaaatcctttgtttatagcttgctggtgtgggctataaagcaatagcctcgccaagcctggtttcatttatttcaaaccctttgtaaaccaagggaacagatgcaaattatctccttattttcatgaacttccatatcaaggttttttgttaactgaatttgtgattggtsagctttgagccagtgagtactattttcttttgttactgcacgtggcgtgtgtagtgttaacataaactgtactctaaagctgcctggtcctgaactactgaatttatgtggtggtagatacaaaaggatctatattatgctgaaaagaacaaagtattatcttatccatgtacaaaattattatgcaacaaatgcctaaaattcctgctgtgtgcaagaacttcagctaggcattgcgagagagaaaggtataacaaaagaatgatagtaaactgatgatattggtaacttgtggggatttgactggcaggggtggtaaaaggggcttcaactttatggtgtctcaattctgttttgaaaataacagctttgttgggatgtaattcacataccataaaagtcaccatttaaaagtgtacatattcagtgttttcagtatatttatgcagttgtacagccatcaccactattttcagaacattcttacctgaaaagaaaaccacggccgggcgcggtggctcacgcctgtaatccagcactttgggaagccgaggtgggtggatcacctgaggttgggagttcgagaccagtctgaccaacatggagaaaccctgtctctattaaaaatacaaaaaattagctgggtgtggtggcacatgcctgtaatcccagctacttgggaggctgaggcaaaagaatcacatcaacccgggaggcggaggttgcagtgagccgagattgtgccattgcactccttcctgggcaacgagcaaaactctgtctcaaaaaaaaaaaaaaggaaaaccacatgcttttctgtcattctctaaaagaaaaggtagaaaaggacatggagttgttcttcatgtcaatctcagatgtttctcccaaagtaaaatgtcatttttcctgttgtgatctcagaacatgttgattgagactctatcttggcacttaatacattctgccaagaaactaggagcatgaatacctctcctctgccagcttaggaggaccctgggagcaaagactaggtcttgtgctaattttaccacctgttgagtaaatgcttaatatgtactcattaaatatcagtttgaattctattgacatccttagacttttcaggtagatttctaggagaaagatcttttctgaccaatacatccctagttcatttctccgttgggtggagtttctcattcttctgtttctacccaaagaagtatgatttaaagtaaggtaagggttaactttctttctcgctctagttctcagtctctttctctctctttttaacaaaacaaaaataagcaggactgatggtgggaatagaatcattgcatttgcttattttgaagttatgttctctaaggatatccatagctctgagggcaaaaggttggtagagaacatttggataaagacaagagaaattatgttctgggactatattgtgagccccatctataaacaatatgatgccaggcacagtggctcacacctgtaatcccagctttttgggaggctgaggcaggaggatcacttgagcccacgagttcgagatcagcctagacaacatagcaagacactgtctctacaaaaaattcttaaaaatagctggatgtggtggcacatccctgtagtcccagctactcaggaggctgaggtaggaggattgcccaagcccaggaagttgaggctgcagtgacgtgtgatcatgccactgcactccaccctagacaacagagcgagaccctgtcgcaaaaaaacaatgtggaggccaggcacagtggctcatgtttgtgatcttagcacgttgggaggctgaggcagctggatctcttgaagtctggacttcaggaccagtctggccaacaaggcaaaaaaaccccgtctctactgaaaaatagaaaaattagcgggtgtggtggtgcatgcctatagtcccagctacttggaaggctgaggcacaagaatcgcttgaagccaggaaacagattgcagtgggccaagatcgtgccatgcactccagcctggactctgtctaaaaaaaaaaaaaatacggagtcataatttattatgcatattatatacatattgagcacttactatatagagtactgtcctgtgcatttcttmtgtattagttaaccttcacttttattttctccattttgtggataagaaactaaaggacagggtatttaggaaaattgsaaaagatgtctccattagaaaataaaagaaccacattttgaccccaagcaatcttcctctagtgcctggttggtgtctccatataaaataaactgaatttgaatcctggctctactatttagtaggaatatagctttggataagtcatctaatctctttgagcctcactttctacatgaggtagttggcagattgtgagtaaagctccttagtccattgtgattcccttctgtcatttatttgtggatttttcttgctaactctgtacagtctgacagcaggatatgtgagtgatggcagatttcaactatttgttatgtaatgattaagcagttctacacatccttttctatcgtgttaacaaatttgtttctcaacccactgagagaccactgttactgtggacttaattctgacccattggtagagattttggtaatataaacttgatgagaacttgataacgtgatggtcagtttagcttgttagcagtgaagagcaagaacatcgtaccctagactttagaaatgcgtatttcagaaagtgtctgaaaaccttgaccaatgctagtacatctagagaagatgacagcccaagggatcatgtgggaagcatgccagataaggagtagttggagcctcagaggtcatacagtgtgaggaaaagaagagttttaaaaagaaagaaaagaaaaagaagatattccattgtggggggctcacacggaatctaaagtagaaggactgcttcagcctagcagctctaggctacagtgagctatgacctagccactgtactccagcctgggtgacaaagtgagtccccacctcattcattgattgattgattcattcattcattattttggtaacaacgttttgtttaatgtctaaatctaacaaaacatgtcattttgatttaaaagtacaattttatgaaataataaatatatagaaggcttggccaacatttataaaccagatgtaaatccgtgccttccaacttccttgacatcacattgtctcttcgtaagagatagtcactttggccagtagggaagacaggaaaaccaataacatgagtaaacaatttacatcttgcctggccctgactgcggtcattactctaagccacatgccttactttgctctgacacttcaggatgttccctcctggtattagctgtgcaccaaggctaagaggtcacagggccctccttgccattctcaataaatcagttttggaaaacctccaggccttcttgcagagtattcaggcatatagggttgtagctgatcagccataaggacaggcctccctttaggccctgcagcagtgtagcaccagtttgaaagcctccatccagtgcacataatgaaagtcagaaaaagaccttcattacttatgtgtactttctacaaagaaacagatacctggatgagggccaagactgcctccttcatcattccattttgtgttgtctgtgttgacagagtcagcaagagaagagatatcaagtgcttgcagggtccctaggtctgtccttgtagccagaccttcccttgctacttgtaattccttgacagaagacattgtggtagtgggtactcaggaaagaagcaactagaatggggcacttctcccagggcaaacactgaatcctctttctgttataaagttccctgagtcctgggtttgattgttcacatagatagaatgatagctattgaaactgtccctaacttagtaattctctctgaactcccttgagagggcccaggtactcttaccttccatctctcctgacaaagaataaagaatgagtctaagagtcttgaccatcatatatctcaggcactgactggggatggggaagctttgaataaccagatacatacgtatagatagacaggtaaagatatctcatagctacactttcatttttttattaataaaatactaattatgtatcagtcttgtgctaggcatgaaagatgcaatgctgaataagacaggttagataacttttgtgaagcataatatgtacccctcccaaatgttctgttgatgacagattcctatcattgggtgcctcataattttgtattctttcatcacatctaaaatcaatctctacatggtaactttcctcagtttggagacattggacatgcttcccatcttctgtggagtttctggtgtctaagaaggctcaactgcctactaaagtttctcctgcatatgctacaagtataaggctgctcacctgtgtgagttctctggtatttaataaggttggatttgtgaatgaatattttcccacattcatgacatttaaagggcttctctcctgtgtgaattctttggtgtgtttgtagatttgtgtcataactaatgcttttcccataccatgagcatctatatgggtttattccttgatgtgtcatgaagtgcttattaagacctgaactccatctaaacctcctgtcacattgttgacatttatagagtttctcttcagtgtgaattctctggtgcttaataagatctgagctaactctgaagattttcccacagtcctgacatttaaaaggtttctctcctgtgtggcctttcccgtgaagatccataagttttggaagctcttgtttacaagttgtaagtttcttttcttccttggaaaagcttgatgccatttctataccctgtgtgtatcaccatgattttccctgtcctttgttttctgggcaattttcattctggtcttttttgatactttgtatcctgctgtttgtatttcaggtgcagaaaccgatattataggatagtcatttccattgtcattttttagctttaaccctagagagatggcagtctcatagatatcctgcattacatcattgtagagagtcttctcaagaggacctaataattgccattcttcctcagagaagtacacagccatgtcttcaaatgtcaataaactctgggactcaggccagatgagcttaggtgccatcttccagtctttggtgcttttgtgctcagaaagggctaaaatctgttgaacatgcacagctctttcatatacaggctgggtttctttctgagtattccagcccagctgttcttgtagtaccctgtatgtgttccagtattctttctagaacagacccattggttcgagctctgctggcttccacttgaagcctggggccactgttgttcctctcaagagcactgcctcctctcccagctcatgggctgtgacctcattctttgttccaccaggttctctctgcaagcgttccaccaggaccagggcctgtttggcaagctgtggatgatgcttctgcacccagttctgggtcccctttggcaggatggtcaggaagtgctctagtaccagcatttccaaaatgtgcttttttgagtggatctctggcctcagccactgatggcacaatttctgaagttggttgatagcctcaagcggttcagttgcttcatgataatggaagctccggaagtgcctgcaagcactcccaggactgagacactcgatttgtgtgctgtatttcttactctgactggagttctctttcacagacctgttggtctcccacatagctcccatatgagagttcaagcatgcatctgccttcagctctctcattatcatttgctctaggaagagttttactcctgtgtgtgacattcacacccatctggtgccacctttgaggtgcatcaggtttggtacattttggtacaaaatgagagtgcaggtttggtacaaaatcaatgaatagatcttcccaagaacacttcagtcagctctggcttccctggaggcccctttcctctttctttgctcaactatgcctctgtcgccacgctgctgctctgggcagtgaagctctctgctcctgcaccactgaaaagcaatgtcaggaaagccagcaatgtcacgaaagcccgcaatgcctggcgagtaaagttccaagattttgggagccttggaaagggccttggaagatcatttctcccattcaatccctccacctcccagagaccttaccctgactcactactcctgggacgaggtctgtggccattcatttaattaattgagacacggtctggctctgttgcccagactggagtgcaggggcatgatctcagcttactgcaacctctgcctcctgggctgaagccatcctcccacctcagcctctcgagtagctggcattacaggcgcacaccaccacacctggctaatttttgtawttttttttttttttttttggagagacagrgttttgccatgttgcccaggctggtctcaaactcctgggctcaaatgattttgtccacctcgcctcccaaagtattaggattacatacgtgagccaccacacacggctgagaccccacgtcttaaaaaaaaagaaaaagacattgtcgtagctatgccattccttgtgtttcagtgtttgaattaatgaattttttatcttatgcctacttttcatggaaatggtagtattctctacttgccagtcatgacttgcagccttttctggaagattatttcatttctgttttttcttttttgagacggagttttgctcttgttgcccagtctggagtgcaatggcatggtctcagctcactgcaacctctgcctcccaggttcaagcgattcttctgcctcagcctcccaagtagctgggactacaggcatgtgccaccatgcccagctaattttgtgttactggtagagacaaggttttgccatgttggtcaggctcgtcttgaattcctgacctcaggtgatccacctgccttggcctcccaaagtgccaggattacaggcgtgagccaccacacccggctggaagactgtttctaaagtcagacaaaggatagactaaatgtgttttctgagaaacgttagtctagggaatctgagaggccagaacctctatcatgagtaaaagaatcatggctcataatctctagttttcatctcatactgttgacttctaatcgagttccttgttttagtaacaaataaaataaatgttttctgctctcaaatctacagggactttattaaaattggaggaacaacatttgacagtcttttgaacgtttagaaaaataggatttattgtggctaagtctaaaaggtctcatgattacaattgactgaaaaggaaggaatgcattgctttccatgcgtggtgacttaattttatgtgcagtactatgcaatacacagagacttacctaactgctgttcttggagggtctattaggcattaaagtgtaagtatccctattgttatttacactaggaaaaaaagcatacctcaggtctttgagaatccaggaaagctttgttttagaatattgctccagcacttgcagtgagccgagatcccgccactgcactccagcctgggcgacagagcgagactctgtctcaaaaaaaaaaaaataataataaaaaaaagaatattgctccagcagaagggggggccaaggaattgtaggcttttattgagtgcctacaggatgcctctcactggggatgtaaatgatacagtccttggccttcaggagccaggtgtagaaggaaatcaatcaacggttaactgagagccactgagatgctgcaattccgacataaacaaagtgccatgagagcacagaggagggtacagctaattgattgggaatattcagagaaggcttcagggcttggttccatcagccaggtctggagggatcagtaaaacttggactagaagaagagaacaaaggtcttttagccaaagggaacaacttgtaaaacttgttactgacacgctggaatgatgagaatggagctgatatatgagaagtggtgggattagcatggccaagttatgaagattctcatatgctaaggagttagagctcttattctttaagcagcaaggaactgcgaagttaagtgtgtaggttttaatggcctgacctcacatatgtgatacagccacctctggttctctgattaaataatttgagaaacaatccatactatatttctttttcatggtgactctatatgtacataactacattggaggctctgaaatgataaactcatttaatgtgcttaacacagggtcaaatgtgctcaaacatggaacctttttttttttatctatttaccttttagtttttagtaacatgtttaggagatctgatatagggaaaggaggaagagggagaaacaggcttctagggaaataaaagaagaaccttttttaccagtctagcagtatttggctgtagcaggtgggaggaggaagagccatttcttaaatctaaagacagctctgtactgggagtgaggaggtctaagttcttactctgccttagctgttaaataagctgtgtgcccttggctagttcactacttttttgagactcatctctcaagacacagataaatactgcttgaccacaggttagttggagtctgtgttaagtgctttatatgtattagctcattaaatcctcaaatcaaacctaaagttagattcccatttcaaagataagaaaagtgaggaattgagagattaaagaagctattcaagaccaccttctagtaaatgagatggatgggagatgggacattttcagtggaagaaacaacttaaaggcacagaagtgaaaaggagcaggtgatcttcaaggaataatgtgtataatttggtattgtcaaccttaaatagtgagattcagaaaatacgattaagtagagtctatttgagtacaaagcttaagtatggccacctgggagacactgactccaaatgaatggggtcagagtttcaaagtagagaagataaggtttcacttacataggcagagacacagaaattttaacaggattacaacatttcccatacaagaccagtgcatacgttacagtgatttgactggttacagattcctacattccaaggaagattactccatgaggagggacaacgttctgagatggtcttatctctggcgccatttggtcttaattacggggtggggggtttgggggtggggaatgggggcagaagttgcagctgcatgacatgtgactcaggctgcatagccacattcctcccaaggctccgaataatttaaagttccaatagctttcagtttgaattatttaatttcacagtgtgtagtggacttggaagtgtgataggagacaagagtggaaaatgtagatttaggcaatgttatagaggcctttgaatgctgtgttttatttgcattttattctacagctattagggagtctttgtcatcccaattttcaaatgaggccttagaaatgttctcattcctgtaatcccagcactttgggaggccgaggcaggcrgatcacgcggtcaagagattgagaccatcctggccaacgtggtgaaacccctgtctctactaaaaatacaaaaattagctgggcatggtggcacgcacctgtagtcccagctacttgggaggctgaggcagaatcacttgaacccgggaggcggaggttgcagtgagctgagatcacaccactgcatttcagcctggcgacagagcgagacttcgtctcaaaaaaaaaaaaaagttctcattcaatgtcattcacaattattttatattccactaagcaggggaataaataccttattgaaagagtgcttgtagacttatgcggacatggatttatagtccgkcactctcttgcatacacaaaaaagaaaagtataaatgaaacattggtaaagaaatttctaaaactacttcataatcaattctagctttcaatcactttttaattcattgtccatatttgcctacataataactgccctgcatgccatcaagagtattgatggtgcaacatttcttaaaaatgattcaacattgtcttcaaatttttctttcaggttactgacacgtattttgcaagtttcaactttggcactttcttggtcttactagaagatcttagcaaaaagtctcacaactactgaaattcatgtttctccttaaaatggcccttgatttatttgttcagggttgtatttgttcagtcacaatgacagacatgacaaccaagtacactcttgtgcaggcaatgacagctgtgtcctgactgcagcttaactgtaagacactctcaacagtaggaaacattctgattttgatgttaaaatagaactgaatttgaattaatgaaatatagtagcttgttgaaaatcataggatggtgaaggtatcaggacccatttgctcactgttatcagtccagccagtaggaaatctgtcttgtcggtcaactgtgtgagaaaaccctttcctaaaaagaagctttaccttatctatttccctgttattttgaatttacacttactaaggaggaaaccaaggcaagaaagacagccaaggacattttaattgactcaagagatacttacttttaaccaagtcttttatgttctggaaagtgccttgagatcttttaataatcttgccaaatcagcatttcaatttggtactcaggatgagtgattagaagtcatgacaaatcagctagcttctctgtggagaatagctgaagcctctggagaaccacagtcttaaattagtctgaagaagcgtgaggtcacaacaggaagtaatgtgaacaggaggagttactgatcagatggttcagagagctggatgatcttaataacttgattccaattttccttgtatgtaacgaacacttattgattgcttctcttaaattcatctcctttctccttccttgcaacaccttaatttgtgttcagacatctgtgtgattctggggaagctggctccatctatcctaagcttcaggtttggctagttagcacattgcattccctcagccaccatgattattttggattgggcatgtgatctaagcaggtatagtctgagtgtattctagttggtatggtaagtggatataaggcctctattctgccatatgatttggttaaatataagaagtgtctatggggcacagtggctcgtggttataatcccaactacttgggagatggaggcaggaggattgcttgaggccaggagttcaagacaagcctgagcattaagactcctgtttcaaagaaacaaaacaaaagaacaaaaagaaaaaagtgactatgaatcctgtactctgatcctaggcttacaaagaagttcacaccatcacagatatgcagtcagggtgaagggagaaagagagaaccaatgccttcacatcagggttgctatgagaattgaatgggatcttgactgtaaagcaccttgcagaaaagtctgacataaaatataaattcatgttttaaggacttttggaattgctaatgacaaaaaccaactcaggtaaatttaagcaagaaatagaaatgtaatggtatgataataaggaagctcagaaaatggaagaaaattttctagataccaggcgaccttgggcacacaatcatattttaatggcccaagggcgctcattgtatctcatactgcttgtctgtgtttggctttcttttttcctgtaggcaagctgtctataggtgataagaaaggagatcactggcaaccctcagtcctctcatctctgtaacctaaaaggcaaggtccttacttttagaactccaaatttaaaatcctagggaaggatactgacagttggggccataattctacccctggactgagccattatggccagggaattggaaactacggtagtcagactagagctacctgtgcctcacctgacactcacgtggtaggtgtggagagggatgagtgacagcttcgctcagaatcatgtttgcatctcgtggaaagcaatttcctccatgagaaagggaagcagtgctggatagtaaaacaagtatccagttattcagtacttgctttttgtctgaagcagattcatcctccttatctctggcagggtggagggaaaataagaaagtaggagagagagtgaagtgtaaattttattgtgtacttaactacgtagtaagtaaactttgcaggtatgagccgattgcatctcatttaatctttgctacaatactgtgcgatagataatattctcatgtcagccagaaacaagctcaagttaagaaactagcccaggaccatataaagctgagtccacttgtctccaaagcataataggcttttctgctgctaccacgttcttcaaaataaagtgagttaaacttgcctggtcaacatgccggtcccctgtactccctgctaccgactcaatgtttgtgtccccccaaaaccatgtattgaaattctgatccccagtgtgatagaatttggagatggggcctttgggaaaattgagtcatgagagtagagccctcatgatgggattagtgtctttataagaagtgaacacacacaagagaacttccatccagtcgcctttttctgccatgtgaggacacagcaagaaggcagccctctgtaaagctggaaaagggccgtcaccagacactggacctactagttccttcatcctggacttcccagcctccagaactgtgagaaatgtctgtgtattaggctgttcttgcagtgctagaaataaatacctgagactggataatttaaaatgaaaatagatttaattggtttacagttctgcaggctttaccagaagcatgttgctggcatctgctcagcttctggtgaagcctcagggagctttcagtcatggcaggagatgaaaggggaagaggcacatcacacagcgaaagcaggggcaagcttgagagagtcggggtggcaggaggtgccatacacttttaaatgaacagctcttacaagactcacagcaccaagccatgagggatccactcccatgatctaaacaccttccaccaagccccacctcccgtactaaggattacaattcagcatgagatttgggcggggacaaatatcccaactgtcagtctgttgtttaagtcacctagtctatggtaatttgttatagcagcccaggctgattaagacacttccctagtcacagtctcggtgcccccctccaactctccctcatcatgagcctagattagaacttgaaacctaggttgtccagacttttatggttattcttgccttatcctacagtaaacaaaggatgtattccccaacttttaatcagaacagaatgtgtgaaaacacatttccaagtttcacatatactgaacacaaccttttacttaaaagatgaaaaagctgtagcaagagctggctggtctgtatttgaatcccattacttactaactaggcaagtattctgtgtctcaattttttcatccttaaagtgaggctaatgatggaacctatctcatagggcttgttgtgaagattgagtgagttaatacataaagtgcttagaatagtatctggtacacagcaagtactgtctcagtgttagctctttattagaagtattgttattcatcattaatgggctcttcttattaatgccaaaacaggcagactttgcttagggaatcttcattttgctccttgagttcacatctgggatgtaggtacttagctctcaaagagagctgactacaatctaaggcaaaaataaactatttgtagtccaggaagttctaaggaagaaacagtctccctgcctatctggtcctgttcgtatacatatgattaacatttcccccatatttcccctctaattatacttacgttctgatcttttgcacatgcaagtttaaataaacttccctctgttagactatgggaaacagttaaatctggaatgcacagagctgctgtatccaaagtactgcaggtgatttggcagaagggtggtataaggagtaggatggtctgagcacatctggcaggcaccagaagccaatggagagtctgtgtatgaagcttctgaatgaaatggaatatagtttcctctgtgaggagctaggacaacgtggtccccaaggaaaatctgaagagcactctgtaacttattagtcagtgagtcaaagagggaaaatggaaggctatatcactgactatgtaagctttataaattttgaggtgttcgggccttttctctgcctctctagttcagctcagattactacctgattctagaatgggatctaaaactcagttgtaatgggtaaatctcaagatgtatccatttacttctatatcagtgggcatattgggaactatacctctagattgctgatcagttgatgtatctgtctctaattttaccatatatttgctgtaccaataaatgcctttttaatgttaaacattttccaacaaatatttccaccatgtctttgccactgaaaagacattttatatcaggaagagccttagatttttcaaactgtgtatggatcaaaaagtactttaattaagctgtgcccagactaaaaaaaatacaaacaaaaaaaccccatttcaaaatgaaagtgaatagttgtggcctttgattttaaaaaatctcacaagatagactgagactattttgtagtagtagtagtttaattcaaatacccaaatattagcagggcatagtggcatgcatctgtagtcccagctacttgggaggctgaggcgggaggattgcttgagcccaggagttctaggctgcagtgagctatgattgtgcaattgcactctagtgtgggtgacagagcaagaccctgcctctaaagaaaatacaaaataaataaacgaaatatacaaagattgcaaagtgtgcagtttgtggtcttccctttaccaatgtacctgtgtgtgaaatagaattttcrttacatgctacaattaaaataatatttcaatagacttgatgctgttcttgatttgaagatccaatttagcaactgcattctggcatttattcccctccttacccatccaccttgttttatgcatagaataaacccataaaatrttctttcttagttcttagtttcctggtgtgtctatccacccattagaataatgggtctgtcttttacatttctgtaaaactgtgtgccattatattacttactaaattgtattttaatttaatgtatataatttctgtccaactccaataaaatatcaaacccttaaagatagggatagtattcatctttgtatttttagcattcagcrtaatgaccagcatataatagacattctgcaaatatttgaatcattattttatacattaagaaatggatgatgagtaaggtgtaacaacttcactaacttatctagtcagtagcagaattggcactaggactagaccccgggacttcaggttcccccccgggtaacccccaagtctttcctttgttgtaggggtttgttgacatggacaataaggtcctacatagacatagttttataatgagttcagaaatggctcgacaaaagtgaaacctgtgacaaataccggattatttgtattgtagaccttggtcttrataattttgtttttcttcgagggttgatggcaggtcatgagatttgagagacacacacagtagtcaactgtatggaaaatactgaggaagtgtgttttcggattacaaaactaaactgggatcaacttggactttttcagtcaagctgttagaatgtgtgtctaaagttggcctgcttatcatgtgttataatataatattggtttggtcagaccctctgatttgtcaaatccttgccaaaaatgggtcccatagaaggcaacctgggattagaatgcttttcaatgtaaagtctcaggtttccagggtaaaccatcttcacttagcagaactaattcctttaacaagcatttgttgattccaactgtgtgtcrggtactgtgctagcctggagcagcaaagaaggataaaaagaaccttgttttagaggagctattaagtcagattctgtccccaaactgaacagctacacaaagaggtgatttctgtttgaggggtttgtgtgatcatctaacaacaaaggagctgggaaccaagaaagttgggtcaataataacaatgactacattaatccagtatcatgccaggttctattctaagcaatttacatgtattacttaagtatttgtttacatttgcggaagttttccttgtcccgggcccattcaatgtgttatttttatctctacgtttagaaactttgaccttttttgttttgtggcttgtcccttatttgatttaaaaagtcattatatggccaggcgtggtggctcacgcctgtaatcccagcactttgggaggccaaggtgggcagatcacctgaggtcagtagtccaagaccagcctgaccagcaaggagaaactcccatctctactaaaatacaaaattagccgggtgtggtgatgcatgcctgtaatcccagctactccagaggctgaggcaggagaatcgctttaaccctgaggcggaggttgcagtgagctgagattccgccattgcactccagcctgggcaacaaaagtgaaactccatctcaaaaaaaaaaaaaaaaaagtcattataatcacctagtagctttagatatgactctatatataatgtatagaacagagaagagttgtttgctccataaacatgtacaattatttgtcaaaagagaaatacaagttattcatattagtattcacagtcttccctttagtttctcaccgactcagtgtatctaccaagattcccttggtaatatctgtccctcaggtagtctgcttgcccagtggtaagtctttctagggtggaaggattctttcttactgggtcttcttccaggactctacttctttctaataggctgaatggagcgaaaatgtaaaaatagggaagacacgctgaatcttcttaataaagaatttttaagataaaggggaaaggggagaatgcaaatttgaaactggttttgaaggttgggagtggggtaggttggtgaatgagagacccttgagcaactatattatatgagagaattgattaagagataaaaagtgtgttacgattttgatttcttctcgtatccattgaggaaagcatgtaaagactggaattactgttttttcacttttgattgttggactttctacccaggacagccacttagattgctggggtttattcaggttatacataccatgcctctctattttaactggctttttgtccctttccttgctcagcagtttttctgcaagtagctgataaatcaggaattcttaaattcttttaaagggtttttcctgaaagataagtttttttagagaagtagagtgggcctagggaataataccaaccttagatgtggaacctctaggggctggtcaaatgtatttggcacacttactctttactatgtcatcaacaagacttggatgtctttcctatttactgcctttgtcgttggagctacgattcacatctgttccagaggtcatggaaactcttcatctctcagcatttctagtgggtatccttggcaggcttaaagcagagtcaggagggtgagagctcagagagaggctaaggtgaaagcactttgtaaacttatagaggatggtattttgtacaaagcctggcacacagcagacattcagtaaaaatgcatagaattaaaagaaaaggaaaaaaagcagataccttttactcatagcagtaatctctcttctgctccccctaccttggtcaggataagagtgccttgtgacatggattaacaccatacgagtaatagtttatattatttaatctcatttcttaaactagccctacaaaatatagtatgattttgattttatgtttatgggaatgaaggttttagagggtctatgtcacttgcccaaatattacccttgtaataagagatggaactgggattggaatgtaaatgtgtctagcttcaaaaccttttatttattttttttctacctttctggccggtacagctgtcagactatgtttagaagtctcatgggtccttcaagtgactttactaatggtcttatgaaaagctgtctcccctgagaattggtgtttgacgttcttggttcattcagcaaatgtgtgcttagccccagctataagcatgaactgtactagacagcaaaggtggacaccaaagaaataatcccatcctcatggagctgccagtgtagtgagtgatcataaatataaacaatgttgggcagagtgatgttagcagtataacgtgaggttgtcctggaggaacacggaagagggattgaatgagggaaggaaaagaatcagcccctcttatgtaagaggcagcactatgtctgccagagcctaacatctcttttagccaccttagctcatttaatcttcactataaccatgtaatatcctgattatacagatcagcaacctacttggcgtttcacaacaaggagcagatggataggattttcaatctcagaactgtctggctgcaagtccctgcccttttcattagactactgagtatagactaagtataggtttttcctaatgtatgttttttaaatacatgatagttaaagttctattctgtatacaagggtatgcgttgtgtgagactcagtgtgtctatcgagatgcccttggttctgtctgcacctcaggcagtctgcttgctcagtggtgagtcttcagatgttgctgcttttgccacgttttctaacagtgctggctgtctcatcttccctctgtgagggtggggctctggtttggtctctgttaagtccattgtggagagaactacagcaactcatgtgcctaagccccatttggccagaccctggcctctcctaccactttcaagttcaaacgtggggtgtgttcttccccagtgactgtccagagtggctgggtaaacacagcctggaagtagggagtgagggcagttgacatcactgaccagagcagttggaagctggagaagggaaggagccagcagacaaattgcttcgtgtctgcctgcctttctcctccatttaccccttacacacacacacacacacacatacacacacacacgcacacacacatacaatattagtagttccatacaacccatcctgtaaccttctaaatgagcagttgtctgtgttttcatgctaagccgtagcgggtttgttgatgcatatagccttggtttcctttccctcctattctttcctaccagtctttccccactctctgctctgagattgcaacacatgataaacaggtaagctttgctccagactgttttctagaacctgggcacaatagtagtcaataaaaaacatcttgcccatcacagacccttgccctgtttgccctgttttataccttgttatttttcacttagcataaatcaggtaatatttgaatactaccatatgattaatgtgcaccaaaatcctgtgagataaaataaaccatgagtgtagttccgtatttgcatatataggtcaattgtattttcttttctttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagtattttcttttttaaaggaaagattattgcttttgttaaaatggtacatgttcgttataaatcaagaaatgctaaaacaaacaaacaaaaaaccccacgccagatgccatcatctggtgataacctttaggtgaataacgttctgggggcgctcatgaagctcagcttttctcattatctttatagtagtgtccgagtatactactgtaatttaaccaacctgaccagttgataagcagttacagtattttatttacttaaaaaatgtgctgaaatgaccatccttataaatgcctttggattttttaaacttgttggtatgtaagatatatttctccccctgaaaatttttattcagatactaccttgtgaccaacacacctgttttgcagatgaaagactctgggccaaagcaaaactaatagcaagataatctgcccttaggcgactcttctaatgagaaagaatgggaacacaaaacactgtataagggatgcaagtttcacatcccagattttggtaaccaaaagaaaccataggccacacagctgatcagaggtatatttgagctattccattacattttagattttaactttgctacagtaagtcatggctcaaatacagtagaggcactgattgatcattaagtttatatacactgtaaactaacccagttaaaaggcaacagcaccatattttgaagacagggtgaccaagtttctaatgcaatgattgccattgattaatacaatgaactggagaccagcagggatgataaattttcctggcattgagaattacttatctgactttttttttttttttttttgagacagggtctctgtcactctgtcacccaggctggagtgcagtggtacaatcattgctcactgcagccttgacctcctgggctcaagtgatcctcccacctcagcctcctgagtagctgggactacaggcacatgccaccatgcccgtaaatataaatttatttaataagtaaatttattaattttaaacaaattaaaaaattttttaatttttaaaaaatttgtttgtagcgatggggtctcgctgtgtttcccaggctggtctcaaactcctagcctcaagcaattctcccacctcagcctcccaaagtgctggggttataggcatgagccgccatgcctggacttatctgactttaaagatgcttttctggggtctgaagttgaagatttaaacctatagagtttatttttgctgtcttgtcttttttttttcagtttgttaacatgctgtgtagttctgttacaaacatatgtagtgaaagaccagcttttattagggttaattgttccttttctcatttggtatgcactagtatttagtgaaattcttccttcgtgtagtatgctttgtttctatttttattaaaacatttgtttgtattgtgactatttgtgtagtaatttatatatttaatttgtagcttgcttttcagccatcagtactgtatttcagtgacttctgcacaaacgtgatttaactataggaaatttttttgtccaggataatttacataaagtccctcacttgagaatttcaggtgacagaagtttactatatttctaaatagcaagcctattatagagtagatcagaattaatcatattcatgaacagtattaatctgttgaataatcaaaccatcaaggcagatgcattggttgagttgctgttcatggacttcctggttgaacaaaatggtcttgccattcttagcaaagaaatacctcagcatgtggcaactcatggatgtggccagtaagtgctgtgagaagtgaacaaagaatagaaaattaagcactgacrgccgggcgcagtggctcacgcctgtaatcccagcactttgggaggccraggcgggcggatcacgaggtcaggagatygagaccatcttggctaacacggtgaaaccccgtctctactaaaaatacaaaaaattagccgggcgcagtggcgggtgccggtagtcccagctactcsggaggctgakgcaggagaatggcgtgaatccgggaggcggagcttgcagtgagcagagatagcgccactgcctggggggaagagcaagactccgtctcaaaaaaaaaaaaaaaaaaaaagaaaaagaaaattaagcactgacatattctgagatgttttctgaaggagctcaggctaaatgctctcacctccttaatactggctgagaggctggatcttctgcctgcagcccagtagcacttggtttataacactatatgaagtgactgcatctctaagccaaaaatcatgatacatgttctaagacagattatagactggtatctttagcctgaattccatctataaagtgttttgcttggcctgcagtgttttaaacacttttaattagtcgtagattgttaaaagctgagatctcttacataaaatccgtaaaatgtccagcttccagatctgggaacactgggcccaaatttctgcctagcagcaattagctggaactgggtggtagctttccatttaagccaaagcatatgctttctagtctgctgtatcacatgcacgcacrcacacatacatgcacacaccagtcactcatatatgtacctacctgaccctttacacttccagaccatatgcccttcgaaggcaggatttttgtctgttttgttcattgcttttttctcatgaccagaatgttgtctggcacaaagtaggttaaaggatattgctagatggaggaagaatgtatttgtgactcttggtccaagttgatgggggaaaagaaaacagaagttttcaatttggagctcctccagatatttgagctatgttcccctttacccctgagatactgtatggctcaggaatataccttagtatcataattttgtatatgacttatctcccttgctagatggtaaattcattgggttcagggacctgtcttgtatttttttgcatccttaagaataccttgcacataatggaagcttaaatactccttggatggttagtgggtttttaaaatttctcatgtaactttgtgaataaagatggggagattctaatgaatatgttgttctggaggatcatttgagaagcaaccatttgagttgcttctccactatattttctccaagccctatccccaattacattctattcgccatcatagtctggatggggaatagaatgtaattggggatagggcttggagaaaatatagtgaatatagaaggtttttgataatccttaacccctgctctttggtagcagggtaaattaaccccccatcctcactttgtgcatattctattttagtactcatctttttttttttttttttttttttttgagatggagtcttgctctgtcgcccagcctggaatacagtggtgtgatctcagtttactgcaacctccacctcctgggttcaagcaattctcctgcctcagcctcccaagtagctgggactacagacatgcaccactgtacctggctaatttttgtatttttagtagagacggaaatctaatttcgccatgttggccaggctggccttgaactcctgacctcaggtgatccacctgcctcggcctcccaaagtgctgggattacaggcgtgagccactgtgcccagcctattttagtactcatcatattatgttaaagagcttgtctcctacactggactgtgatttccctatcattaagaactcggtatggtttttgtgcatctaacagctaatacttgataatgtttgtgtgccaactctgtataaacactattctaggaactcagtaaatgtttgcattgaattgagtttgtgttaggagttgtattagaactctacaccaccttatagtttataaaacatatgtatattcattgtcttatttaattttgaaatcaactgagtgctgcaaatgagaaaaatcaaagcccagagaaaactgtaactggtccataattacacagcagttaatggctgaacatccaggctgaactttgccagttagtggctgaatattcacgaaattctgatgcctccatagagcgggatagaattatggaggacttgtcattctggactgcggaatttggacctgtgtattgaaacaagaagagaaagggaagtgtttcttaagttatttttggatgaaggctttttgcgatccaaggcttcatcccctcaagctcaacaatagcattccttgggggagtgagaagatgatgaatggtcatcagtttgcttgcctcacccagattccattcctacctcccagaattttccctggtcccacccagctccacagtaacaatcaatcccaatcagtgactgtacttcattttttggatcaaggaatacccctcccttttctgtcttcctccttagggctttggataggagccctttaattgatgttgactaaactggaggccagcccctgcataccaggaatgccagtggctttgttagttgaggagggcgctgcattagcactgccctctaaatcccagagcaggtggaggaaatctaattagcatttagtaagccaaggtgccctggggagtttctgataaagaaaaggtcactgcagaaggagaagggacactgatagggagacttcattttcctagtgggaactttctgaaatggactggcaatcaggtgagctggattctaatgcctgccttactggtggctttttaatcacacttaagtccctctgcttatctgagatttcattttcttgtctgtgtctagtccgttaccagactccttttcctacacaaatatttgtttcataacagtggaagggacctcagatcattaagttgctatcaccttggggtgacaggtacactaaaatctcagaagtcaccactaaagatcttattcatgtaaccaaataacacctgttccccaaaaccctgttgaaataaaaaaaatgactgcagccattcccacccttgtatttcaagcatagcattgccacctacttgcaaaatactatatagacgtatatatatatatttttaaaaaggtgctattacctgggaagcttttcccaacattacatatgtccaaatctcactctgtatctactgaatcttctgatatcagtagatatgtagtaaatatgtatagtttggggaaaatttctcaggaaagtttgataaaatccctggtttatgcttttttgaagaacttaaacacatatagcaaactcaaggcctatcacagcatttgctatcrtagttgttagtaatatgtttggagaggaatttggggggatggctattaagtgagaagctagaggtagaataaccactgcaagcaataagcattttacaaaatggggattgagctctattcgtaggtgatgaaatcaatggtaatgagttgctaccagtattttcaaagtaaaatagtatacaaaaagtagcatgtattgtgtccagttaaggatatttattgaaacttttaagttcattgtatttatagatactgtgctacaatttaaaagacatttcttactgaatttttgtcaaaatccattgacctagataggaatctgtattggagtaaagatggttctaaggggaaggagtgtagagaagcaatgtgggagccacatgcggtggttcatgcctatattctcagtactttgggaggcggaggtgggaggatagcttgaggccaggaattccagaagcaatgtggaaaggacactagggaatgtaggttctagtctttatccaagctctttgacttcaagcaaatcacatttttctcctggaccttacattcttttttctcattgcccttagtaccttctgtctgacttcaaccccacatctgcttgacaagaattaactcaaatatctcttcttaacacctacctgattctggcatacagtaagtgcttataaatatatgttaaatgggtgagaacctttcccttaggtctgtgggtactttcactgggcttgtatatctaccactccatttaaaactctacttacagctttttaagaaaatgtatttctaagccaggcacagtggctcatgcctacatttccagcagtttgggaggctgaggtgggtggattttgtgcttggaaattcgagaccagtctaggcaacgtggcaaaaccccatctctacaaaaaatacaaaaattagcagggtcatagtagtgcgtgcctatagtcccaactacttgggaggctgaagtgagaggattgcctaagcctgggaggtgaagactgcagtgagctgtgggtgtcccactgcacttcagccttggcaacaaagtgagaccctgtctcaaaaaaaaaaaaaaaagaaaatatatttctatttatcttttactaggttgtggtcccctggaaagcagacatttttattcatctgtgtattctcagtacttaacacagtacctggtatgtaataggtgcttcatagatgttggagagaatacatatttttaagaggagtattttagtagatgactcataaaacatttattgagcacctactatataccaggcagtgtggtaggtatgggaagkgatacaaatgtgtgtaagagaccaacatcttcccttgaggaatttagagattaattgaagcataagcacacagaattgctgacaaagccattagtgttagtctctagctatgtggttgcttatgcagctcatgtgtaacttctcatttctgtgtttgaatactggtcaccagaaccagacaggaagaatgtctttccgttctgattaattttcttaggaattaagtaagaaattgtgtatctgatatggtgatctagttccaaggaaggttaacttgagttggcaaaaggagcctcatcttttttatattagttactgggaggttgtttaaaaatctcccattatgtaatggacttgtcactttctacttatagtaatggcaattcttgctttatatatttcgaggccatattactaggtacacatactttttagaagtacatgacttctgggcctttgaacctcttatctttgtgaagtgcctgaccctctttgcctttttaccttaatatctttttttgcttggtagtcatatacctgcagcagcattcttttgagtaatgtatatgctttatgtaattttttccatcctttgatttcaacctacctgtgctcttgtattttaggtgtatctttaaaaaacagtatgtagctagattatgtttttgtttagtctggaaagtctttcttttaacttgagaatttagttaattcacatttattgtggttaatacagtgagacaggctttatcttttaaatggtgaattaaattgatttacatttattgtgattatggaaatgttttgatttgttgcaaccgtgtagtgttgtaccttaccttacactgaaattttctgttgttttttttaatcttaccttttggattgaacattttgtttccttyttctaatttyctttttatccctctgcttatttggaagttacactctaactacttcattagaagttactctaggtattttattatgcatacttattaaaatgtttaaatttaatagataatacatgcacatggcttaaacacaaaatatttgaaaagtatactgtgagaagtctcttctctatccttctgccaccatctgctcatttctaatamcctggtgtatttatctttataatgtatgttggcctgttaacatattagatatgttagaatatatctaatagagattataaatacgcatacaaatacgtattaactcctccatttatacaaataaaggacaactttctctatacttgctttttttttttttacttcataatatatcttgatgctctttccatattgatacatgaacagttttcttccccatgcctttttaaaaagcagctgagtggtagtacatcaattggtgaaggcataactaagtctttactgatgagcatttacattgttttcaatattactcttttaaatagatcccaaaatgcacatatgtcattgtgcacatgttagtttatctctaggataagtttctggcattgcctggttaaaggatatatacwcttacacttttggtagattatatgtaattttgccacattgcyctccagagggtttgtaactatttacactcctgcctctttttccacagtcttgccaagatgattaccaaagttctgtatgtttgccagtctaatgagagaaaagtaatatttaagtgtatttttaatttgtattccttttgtaagtcaacattgatcttttcacatgtttaaaaawcatttatagttayttgtctgtgaacatttgcttatttttctgcagggttaatgttcttactgatttgtaggagctctttatgtaggagattagccctttgtaataggaattgtgaattttagcgaaatatttatgacttctaacccaagttaccatttttttccttgctttgtccataggcrtttgtgtgggtgtgggggggtgtgtccgtgttgccatgcaggatttgaaaatagttttcatttttagatttataggtytctgtgtagtcactrtaacaatcattgttatggtttctggattttaggtaatagactttccctcttataggctataaaagaaatgtactatgttttataatttcattttatattacatttaaatctgatccagttggaatttttcctgatctatgcttagaggtacaggttcaactttgtttcagctttatttttaacagtgtcattaaatctttcccatggatttgaggtgctacttctatcataatctaagcattttatgcattagtaaccatttgtgaactcactaagtattaaattccattagtctgtatacttataaaatatatatagcaatacgctttgttttgattaatgaggtgtgttttaccatatggttgtaatagtgtcctctgctattcttgtttttctttatgaactttacaattgtattctcttatttagaacaaatatggtgggttttttgttgttgttgttgttgttgtttttctttgagacgaagttttgctctgttgcccaggytggactgcagtgacaagatcttggctcactgcaactgccgcctcctaagttcaagcgattctccagcctcagcctcctgagtagctgggattaacagggacatgctaccacccccagctaatttttgtatttttagtacagacaggttttcgccatgttggccaggctggtctcaaactcctgacctcaggcgatccacctgcctcagcctcccaaagtgctgtgattacaggcatgagccaccacacctggccaaaaaaatggtgtttttactgagtttatgttaaattaataaattcatttagggagatttgagctctttatcagcacatacattttaattttttaatttggcctaaagtatagcagtatatttactctctgtattagtttcttttttctttcctcctcctcttcttctttttttttttttttaaatacagaaacagggcttcgtcatattgtccaggctggtctcaagtactgtgccagctttggcctcccaaaatgctaggatcacaggcttgagctatcatgccaggcccttagtagtttcttgtagttgctgtaacaaatgactacaaatttgttggcttaagacaatagagatttatcgtcttacagttcaggagagaataaatccaggtgttacagcgctgtgttccttctgaaagcactggggaaaatcttttgcctcttttggcttccggtggctccagatgttccttggttcatggttgcatcactccaatctctgcccatggtcacactgtctcttcctcctctctcttctgtccctctgtctgttcttcctctatctctgtcttatatggatacatatgattacatttagagtttccctgaattctccaagagaagtgctgcctatgaatattatcttatatggcctaagggtctgagacctttaacttaatcacattttatgtcatataaggtaatattcacaggttccagggattaggacatgggcatatcttttgggaagggaccattcaacgcactacacccttcttccaaatcatgtaagaatcttagcatacctaaacttgaatcactcctcctaacttatgttattgttggccggtattttctatcttatttatttatacccacttaaaataatattcttgttttacactggaagtgttcagatttcccatgtatttatcaatatctgtgctcgtctttgttttcttttatgtcagaccttccatctgggattatttttcttcctaaagtatatcctttagaattgcctttagtgagagtctgtctgtggcaatttctgtttttttgtctgaaaatatctttattttgcattcattgagtttgaatggctattgacttctgcattgaaagttattttttcttagcacattgaaaaattattctgtgatcttctagatttcactgttgctgttcaggagttagctgatagtctaattgccattcttctgcaggtgatctcttgtttctcttttaatgtcttcttttttgtctttggtattcaatttcattaccatatgtggtttctatttatcctgcttgacatttgtttagcttactggatatgcggtttggtattctttcaatggttctgaaaacataccagccaaaggcaggcatagaataatactccatcctctcttatttaattattgaacttcagttacaagattagatatatgttagaccctcttactctatcatccacgtctcttaaactctgattttttcatatctttagttcttggtcacattctatggaatttctttggattgctcttccagttgactaactctttagctctatttaatctgtttaacttgaccatggactttttcatttcaattgtaattttcatttttggacattcagtttggtttgttttcaaaagtatttagttcttttttatactctcgtttgctaattttttcaagcttctcttctaaatcttaaaaattttatattctgtctctaattccaacatgtgaagtctttgaagatacgattctgtcatcagtttttcctggctgtcattcattatggtattatggcttatttccatatatgtttttgttttacttttaacagcaagtgttccttaggactttacctgtggaagctatttgaggcctaggttaaacatttattctaccagaatggattagaggctgctgcctccagtagcctcaggacattattaatcctggactacttttagatcttcacttgaagtatcatgaatttgatcacaaacttgcattagagccagattttgattacagacttttaggaaagacattacttcttttttttttttttggtcactttattattattattattattattattattattattatattttaagttctagggtacatgtgcacaacatgcaggtttgttacatatgtgtacatgtgtcatgttggtgtgctgcacccattaacttgtcgtttacattaggtatatctcctaatgctatccctctcccctccccccaccccacaacaggccccggtgtgtgatgttccccttcctgtgtccaagtgttctcattgttcaattcccacctatgagtgagaacatgcggtgtttggttttttgtccctgcaatagttgactgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacatgtacatgtgtctttatagcagcaagatttataatcctttgggtatatacccagtaatgggatggctggatcaaatggtatttctagttctagatccttgaggaattgccacagtgtcttccacaatggttgaaccagtttacagccccaccaacagtgtaaaagtgttcctatttctccacatcctctccagcacctgttgtttcctgactttttaatgatcaccattctaactggtgtgagatggtatctcattgtggttttgatttgcatttgtctggccagtgatgatgagcattttttcatgtgtctgttggctgcataaatgtcttttgagaagtgtctgttggctgcataaatatcttcttttgagaagtgtctgttcatatccttcgcccagtttttgatggggttgtttgtttttttcttgtaaatttgtttgagttctttgtagattctggatattagccctttgtcagatgagtagattgcaaaaattttctcccattctgtaggttgcctgttcattctgatggtagtgtcttttgctgtacagaagctctttagtttagttagatcccatttgtcaattttggcttttgttgccattgcttttggaaccaaaagacattacttcttttctagtggtcaagacaggtcagtttttttatggttcctttcagtgctgtagatgtattgcccacacttgaaacagtcatcacaattgtcactagtgtttgttacataaataacctcagggcaaaaaatggttttagtgctctctttctttccagaatttctgctttcacttattttttttattgyggtgaatgaaacatatataacatcaaaattatttttaagtgaacaattcagtggcattaaatacattcacattgttgcatgaccatcaccaccatccatctccagaacttctcatcttacaaaactggaactgtgtacccattaaacagaaactccctattaccccctactcaccarcccctaatccctggcaaccattgttctactttttgtccttatgaatttgattctaggtatgttatataaatgggatcatacagtatttgtccttttgtgaccagcttatttcacttagcgtaagtcttcaaaattcatccatattgtaacatttcagaatgccattccttttaaggctgaaatcatattccattgtatctataaaccacattttttaatccactctttgtcagtgaatattcaggttgcttccacctgctttcatttaacttttgttctctacagattccttacttcttgacagcatgactcattttcaaaattactatttaagaatattttatttagcttttaagttgttttctttgggagtgtcattcatggtatctaggctaacttaattgctcaaaaccaaagtcttatacctactataggtggaccagaagacaaccagaaagaacataatttgactttcttttgggatgctaaaaagggaagattctgagatatgaaacaattaatatgtagttttgcatgttttgattcttgaggtctgctataggtaatatttttttccttgcatgtgagaaaaccttaagaatactataagaaaacataaacatttctgtcttgcaggatttggcattgttaccatgttgttagtactaacctctcaccctcaagtgccccaatatccagtagtagcatttgaaacttgtacagagataacaaaatcataaactgcttgagctgaaggggtctaatttctaaacatcaccccttccaccactgtgtcttttttttttttttctttttttttgagatggagtcttgctctttcacccaggctagagtgcagtgacatgatcttggcttactgcaaccaccacttcccaggttccagtgattctcctgcttcagcctcctgagtagctgggattacaggcacacaccaccacacccagctaatttttgtatttttattagagacgggctttcaccatgttggccagtctggtcttgaactcctgacctcaagtgatccacctgcctcggccttccaaagggctgggattacaggcatgagccacgagccaccacacccagccactgtgtcttaaagatgagttggctaaggttaagtgactgacccagccagggtcctataaggagtttgtgacatcaagaacctcagttgcctcattttaatctcagtatacttggtacttctgtgtactttctctctctgagaagacctgtgatcatttaatgagttctgagcttggkctttttttttttttttttttttttttaagtgagacagggtctctctctgtttcccaggctgaagagcggtggcgcaatcatagctcactatagcctcggactcctgggctcaagtgatgttactgtctcagcctcttaaagcactgggattacaggcatgcgccatcatgccccgcctgagcttggtctcttgaaatgttgctgtggatgttgataaagatgacctgacactgatacatgggtcagagtagaggcaagaattctcatctggttaactggtgaagatcaaatagagttggccttccaaatactatttcactcctgtctctcctgttcatggaatcttttttgataacagaaggttacagttgggtgggagagctcttgtgatcattcgtgccaatctcaaattgcccacagggacgttttgggatcccctgcccagaaactttgctgttgtttatagatgaggaaactgaaacctaaaagatgtaaatatggtttccctcaagtcacataaagtgcttttagcaaagccagaactggacccacatctcctaatccctattcccgtggaggatctctattacactaatgcattaacttcactcctgatctttaagtaagctccacgtctgtggtctctgttttaagattgtgaaatgtcataaaggtggtttgcctttgaaaataagccagaacctagagagttaatagaaattgaacagtgaaagtggagtccttttcttctctcctcaactggggagccgccaggctgtttcacttgcaccgcmtgtgttccattatggtataatgatgtaattaccagtaatgctgctgctgcttgagtagtggtgaagaggcagcattaaggaaaagactagccccagttctctcctaagagccatttcagcccacttcagtctattagattgaagatgctggaaggcgaatggcttcagcacaggaaaaggtcagatttaaaagcttttctgggtttggtatttattgttgcttttttgaccttcagaaaagtcccctgtgtgtttgtccttgattcttgcctttcccattaatgcttgaaagctgtattgctgtccagaccaggtctttggcatagatgatttcctttgtggtgttagagaaagcctagcccccactccagatgaccagtcctgttgtcgttcatgccaccattgcagtgtcaaaagcctttttaactcttgaacattttagttttcagcaattctgtatgtatatatatataatatatatgtcatatatgatacaatacatatgatatgatacagtacagtacatatggtctgtactagtatcacatattctttcacaaacttgcctagatctaaacaatttatgaattaatactttaaaatacagagaagtaagcaataagacttgagtgccttgagcaaacctttctgtgaatctctttcaaaacgtacagcctgccacctgatgattatgaggaggtaatcatggtctctggaacacagtagacacttccaaaagtgttcctttattagagggtagccatcattctttcaataataagcacctgctgggcccaaggtacaggttataggaagacagcaagttttccttatttcagtagttctcaaagtgccatccctggaccaacagcaccaacatcacgtaagatcccctgagaaatgcaaattctcaggcccccaagccagagctactgaatcacaaattctaggctgggagccttcagtctgtgttttaccaagctttccggtgattctgatgcatactgaagtttgagaaccacttctttattttgtagttcagtaccaggagytatctgataatataaaataccttatgtttatctagagctgcactgtccaatacagtagtcattagccataggcagttatttaaattttaataaaaccaagttatctagagctgcactgtccaatacagtagtcattagccataggcagttatttaaattttaataaattaaaaccaagtaaaattaaaaattcagtttctgagttgtactagccacaagtgctcagtagacatatgttgctagtggaaaccatactggacagcacagatgtaaacatttctattatcacaggaagttctattgaataatgctgggctcaaagcagtggtcctcagattttatcatgaatcgtatcattagtctgtaaaatatacattgttgggccccatccccagtttctcccagtgtttctttttatttgagacaaagtctcactcttttacccaggctggagtgcaatggcacaatcttggctcactgcaacctccgctttctgggttcaagtgattctcctgcctcagcctcccgagtagctgggattacaggtacacaccaccatgcccagctaatttttgtgtttttagtacagacgaggtttcaccatgttggccaggctggtctgcaactcctgatctcaagtgatccgcccacctcagcctcccaaagtgctgggattacaggtgcatgccaccactcctggctcccattcccagagattgtgattcagtagatctggggtagggctggagaagatacacgtgtaacaagctcctagatgatgctcatgctgctggtatggggaccactttttgaggactactggtcttgcataaggattcttgatctgaagtctgtgaaccttaaaaaattataggcaaaatactctatgtacccatataatagaggttgcaggatataggactcacagttttaatctgattatcaagtgggtcagcaggtcaggagaacttttagctgcagttaacagagaatctgactaatagtgacttaaatcacaaggactttgatattcatttagcaaagtaagaggctggaagtttcagcattctttcagtggctcaagcatgtcaccaggaaaatcaggcactttccctcagaaaaccccttatgttttttttggctagcaataggtcacatgcccacctctagatcattcccatcaatgaggaatgggatttgtataattgcttttgattcagcccctggggcaaagggaggggatttaccttccctgataacatcagatctccaccagtcctctgaacaaaatatgaattctgtaacaagggtgaagggagaaatggctatttggtctctcagtgagtgacccaraaagtgttaggagtgtctggtctgcatcctttcagcttatcacatgctttcaacttgctaggcaagcagggcacagacacgccgagctgtgaagccctgctgagctctgtcctctagtgccttatgacgggttctgtgaagtcatcctgcatgtaacggggatgacgtggtatgagatttaagagcctgatccaggcttctgggagtcggcatcaagtcagccttaaagctagtccccgtctgactttggcccccagttgttttgtgtggttgtgtgtttttgtttgtttgtttgagacggagtctcagtcctgttgcccaggctggagtgcaatggcgccatctcggcttactgcagcctccgcctcccggattcaagtgattctcctgcctcagcctcccaagtatctgggattaaaggtgcccaccaccacacttggctaattttttgtatttttagtagaggcggggtttcaccgtgctgcccagctggtcttgaactcctgacctcaagtgatccttccacttcggcctcccaaagtgctggtattacaggtgtgagccactgcgctcgacctggccccccaattctttttagaattggctcttgcttggttccttttggtcaagtccctgtcaaagtacaagtttttgtactttgattctttaaagactcccattattcttttctctcaccagtctccttggaattagagtcctggtcctggatttggggaccaaacacttggaattctgctgccagacttccagttccctatctacttacctagctccctgcttgtcttctcccagcagtatgctttagatgcttggctttcagtagggagatagtgtctaaaaatgtacaatgtgagactatttcacgtagaaatggtaaatgaagcactgggagttaatgagattattgaaggagaagatgtgagaacgaaagctcataccacccctctactgaatcaaatgaagggcatggtcatttgtgtgttcatctgtactctccacaagtaccatgaatcccaggctgagaatcaacaaagaccttataaacaaagacccagggccacctgggaatccagagaggtgcctgatgaaagggatgacagtagctcagctggcagagctctctgcctgcatcccctgccccctagagcagttctgcttttacttctatgttatgcttctatacgaaatcttgtatgtagaaataaataattccacttattaaaaaaaaaaaaggccactgggtaaatgatgccgaaggccccttctaatactgagaatgggctcaagggctagaatacaggtactaggctatgacatgtgaaacagaagtgtagtcctgtcgtattttaggagaaggaactctggctcccttgttctctgcatggttttgagctgacagttgcctcggtcaacagctggatacagtacccaattgtttgcagcaaaagtcctgcgagtctgtttcctctaaaaagcttcttccacgacttccttcccccatcctcccaggacagaagtggacacaagggggaatgtttcagttcccctgtcgggttgtgtgtcttcctctcaaaccactgttcaaaatgtctagggaatttttattttccaaagttgcttaccggaaacaacttggcagagcatagtttggggaggaggctttagttcaatgagcacaaaagcacatgttcctgtggtgaattcttaacgtgtgtgaaggggaagcaaaggagctttagtaaaattgcagttcaggctaagtcaggaatggaaatgaggaacaaccagaaaacatcacagtttgttttagagcatttagttcctaactctcaatgacacacactcaggcttatggctgaatttcagattatccttgtatatactttttagaagtttttatttggtatcataatttatagtgtaacaatgaaaagtcgcctggctttataacagatttcagaaagtgaaacttggtttctgaggaataaacaggcagcagagcaatcctcaaagaggaagtgcatgagaaactgagggtttagggagattatatttggttagaaacgctgggcctttgttaaaagttgaaaaacctgatcactccagtctttggaggttctgagggagagcatgtcttgccagagtctcacggatgattagagttaatcccggcacccaggcctctttacttttcctctgcagtgtgggttcccctcctgagctacccgctagagcctagtttcccagggtttctctctctggtctgtttttgcagctcaagccatgttctccttgatctgttggccaggcttcaggggagatggactacagctggtctgaaataggaagacggtaaatttacttaaactttcagcatgacccatttgcctaacttttttttcaatgtgatgaatgaaaatatagacaacagaatgtttcacaagacagccaactcaaagagaataagaatgaggasgtgtgcaatttgcttttacctttaaaaagaagcatattacagaacctcttgattgtctttcttttttttttctttttttcttttttttacctctgtcatctgtgatccattcgcctgttcagccaagatattttggcatttttactctgggaaaccagtgggtgggtgaacatggaggagccaaaagttaacaaaataccagcaaatgctggagccaagtgagaggattctcctctgctccagaagcagaggtgtaccccacctcccactctcccaagctgctttgaaaaaggctgctaaaactcaycgacttaaaaaaaattttttaaaagaaaaaaaactccctgacttgagaggatttctcagtcctgatgaaggaaatctctagcagctcttcttgtccctaggctatcagggcttttcctttctgaggatgccctaagcactgtagggaataatagcattcgaaggtaagtttatctggtctgatgccagcatacattgttgaatccaaatctaccatttaccatcggggtgactttcaatgagttctttaaactttctgagcctgttgtctcatctgtaatagagayaatagtgcctacctcatcaaaagtgttagaattaagtaagatgatttgtaacttagtaccagacacctcattaataatcaaatgttttttgcaataccactcattttctcaccaacttctatacagcttcctgttttcccagtgatcgtgagatatgggaggtagtagcttgctaacttgtttccagtggcagcaggagtggcaaaggaaattacttttttccttatcaacttcaaaggataatttacacacagtgaactatatctgtgtacatttaatgagtctcataggtgtctgtccgtactcatgaaacaagtactacattgaagatgtagaacattggcatcatccccaaaagattcctcttgcccctttgcagtctttcccttcctttgcccttagccccaggcaagcactcctctgttctttgtcactctaaattagtttgcattttataggagtacagtatgtacactttttgtgcagcttatttcactcagcatagtgatttctggatgtgtccatgttgttgcatgtatccatgttattgctgagtagtattccattgtgtggatataccacctattgatggacattgggttctttcttgtttctggctcttttaaataaagctgatatgaacattcacttggaaatctttctgtggagcatacattttcatttctcccaggtatacccagcagttgaatggctcagtcatatggtagatacgtgttaaactttttgagaaacttccaaactgtattgttttactttcctatcaacagtgtatgtgatttccagttgctttacaatctcagaagcacttagtgtgatcagcctttttaattttagtcattctaatgggtttataggtcatggtattcattgtggttttcatttgtttccctgatgtctagtgatgttgagcaccatgtgccaactggcattttgtatactatcttcttttgtctagtatctgttcaaatcttttgcccatttaaaaaattgtgtcatttatcttcttactgagttgtacaagttccttttatgatctggataccagttctttgtaagatagaaatatattaaacatttccttcaatctgtgaaaacatgtgaatacaactgatccttgaacaaaatgggcttgaactgcatgggtccatttatacttggattcttttcagtaaaagwgacactgagtgtgcttgcctctcctgcctmcccttcctccccttctacctcttctgcttctgtcactgctgagacagcaagtctaacctcttcttttcctctttctcctcagcctactcaatgtcaagatgaagataaagacctttatgatgatccacttccacttaatcaatactaaatacattttaatcttccttatgatttttttctctatctttactgtaaaaatgcaatatataatatataacatactaagtatgtgttattccactgtttatagtagttaagtttcaggggagtcaaaagttgtacatggatttttgactgcatgggagggagccatcccctaacccccatgttgttcaaggttcaactgtatgttctcccagtttgtgtcatgccctttccttctcttaattgtatcatttgaggaacaaaagctttgaattttgatgaagcttagttttcagtttttcttttatgatttatgctttttgtttacttaaaggtcacaaagatttttctcctatgttttcttgtaggagatgttttagcttttacatttaggtctataatccagttcaagttaatgtttgtatatggtgtgaagcaagggttaacatggggattatcttttaggtaagtgtctattatgtatcaggaactttatttctcaagaaataaatgttctaagataattatccttattttaatgatgaagaaaagaagtctcagaagtattaacttgttcaaatcgtacaaccaaggctcaagtccatgattgcccaactccaaagcccatgttctttctaccttattatgttggcattgttttcaatgtcagtttggacccatataaaaacgcccagctgtaccctatgaggaggatataaaaatgtgagatggtagttgacactcggaggacattcatatctccaaacccaaccttatgaagttggccacagcaagcatgttggaaactagaaccaggggtttcatatcaagccatttgcttaggtctgtatctcaaaagctttaaatacaactttttttggtgccctcttgataaggagtcttatactgagctcttcttctcttttatagctggtccatcagaaagattaaattaaacgtttggccacatggacagttaatccttagatcacccagttggatggttcattcctgctatgtttggtttgattttttatttttggaaaacaaatagtgagtcagtctgctttccctccctttctctgcctcaccactccttctggattctcttagatgctctggtcatactaggtaaacagtatttttcttaaaattttccttgagccatgacagaatcatgagagagctcccctggctctgatacttaatgcccccctctaaaaagaaaggtctatttgaggctattcacttttgtcatcttgaaagagtctctgagtcttacctagcaggaatattttgtttcttttcctaaaaaaaaaaaaaattatatatatatatatatatatatatatatatatatggaggggatgtaaacagaacagcccatacctctctgttcttgcttctcattaatgtagatttggtaaattctcctttctcttctcttctcttctcttctcaggcagcatgatgtaggtgggaagaatatggagctttaaagtgagaagtacctacatttgaatcccagctccagtatttacatagctagcaaatcacccagtctctatgaagttcgatttcctattctgtaaaatgggaataacaagtactttatgggtttgttactcagtttctggcacatgtgtgtgcttatattatttcctcctgttcttttattagatctctttctgaagagtaaggatgtgagatgatactcataaaaagtctgaataagggggtgttggaagcttataaagggtatgttttgaatatggagccctatttaaggtgccttaacagatttattcctttcactttggctaatccgggcagtttgatttcaaagtccagacatgaagggtgaagaattgtagtcattctgcctgttatttttaaagttatttttaattttttacagctgtcgagttgattgtcctgggtctctgtaagcaaactctgttctctgtgatgcaattatttgctagtgagaaatttatctcatgggcaacagtgagacttaggaaaagagtggaggagaaaagacagtttatctgtctaatacggagaggatcaaatataaattggtaggagagactgggaaactctgataacaaatttgggagagttatacctctgtcttgggaaacagagccctgagaaacaccaatctttgtgtcagctggtaggatgaggacagtcggtgtctcccactatcttctggttaccgtgccttccagctggcatcattttcctctgttccatgagaattttctttgcatttcagtctgggctgctggcctctgcctcctttttgcctactaaaaattctgtggactctcaaattaacattttcaaactggtacattctttgagatgcagctcaaggcgtagttcttctaagaagcctctcccttgactattctgcacagtttaatggtgctgagaccaccctaaattattcaggtagccttgagaatctgaacctttgaatatttaatgaattacaaaatgtgtgtgttgaggaacaggagttagctacagagagacagatcagagttagtaccaactagaagcacttacacctgacttccttttaccacttttgtcttctcaactaaattcctaaaccttcgcaggattgcctttctaaagccaggtgattatataactctaacagataaatatagctctagtttcatctatttgcccagtcttcatattgtctctacaattttgggtacagttttttgtttttgagacaggatttcattcccattgctcaggctggagtcaatggtgcgatactctactcactgcaacctctgcctcctgagctcaaggaatcctcctacctcagcttcgaagtagctgggactataggtgcgtgccaccacacctagctaatttttgtatttttagtagagacggggttttgccatgttgcgcgggctggtcttgaactcctaagctcaagtgattcacccgcctccctccctccctcctgtgccaggattacaggcgtgtgccacagcacccagcctgggtacagtttatttcacttaatgttataagcttaacaatgcttattataaaatttgaggataatttaatggctgcagtgtgactcactcattaaaccacttttgtgccaccaagacattagaccctttgtcttcctagattttcaaaaaaaacaggatattgttgaatcattaaagcctttaggcaaacttgtcttatgcctaaaattctgtttttccctctataactgtatacaggatattttgactgtccaacaagtaagatgaaggaattaatttttttttctcttagaagtgttcactgtgtagatgaataacatttacagttagatctatgaaatatcttaggttttgtttgtgattgattctaagaattaaacaatgaatattctttgcaacactatagtcatgtaaatattcacagcatagctgagtttcataatttgacccataggacaaaaataaagtttgatgatattaagcctgcaatatttaaaagagaatattccaaacatcaagatcaaatagattctctttccgtcacttgccacattgtctttcctttgcatttataccttgtctttgctttttgtttaccttggaatttttaattgccttttttatcttaattggagatttttttcctgattgaagaaaaacagcatctgccattaccttatgactaagatcacttagcttcttaatcatactgtttgttataggaaaatgactttcatcttgacacatttttctctaagtcctcagagttcctgttctaatttcaaggccttcattgaaatcctgagttaaatctttctcacatgccatgtcatcctacttcttaaaaccctttttaattttgctgtaaatcatccctggtaatttgttcagaaagagtacacaggagttaaactttgtaactccttgcatatctaaaatgttttgcctagctgttctatagacagtccttcaactcatcaccttgatttctcctcctcttcctgccgttactctccttgttgtctaattctgtgctattcagtatggtaccttctggctacctggtctgttgagtacttgaaatctggcttatttgaattgagatgtgctgcaagtatcaaatacacactagattttaaagacttagtacaaaagtaaagataaatatgtatactatttttatattgattatatattgaaataatattttagaaatattaggctaaaatatattaaaattaatttcacctgtttctttttacattttaaatgtggccactataaattttaaaatcacatatgtgcctcacgctacatttgtatttgacagtgctgctgtaattcccaagaagcagcagtggctgccgcatacagcctttccccatggtcctgaacctggcttctttgggtggattatgatacatcagcattgyagtatgtctacaataatgtacatttaccaatataatcccatctatttccatcttttgaaaatagttaaaaatttctagtctgtctttttgcccttattcctctctccctctccttctccctctccctccttctgtctccctctcctccctccccctccctccctccctctctccctctctccttccctcccctaattacattattccttcttgtactacattgccacttctttggggtttgggaggaaaatgaattttcagtctatcaacggggaagcagaagattttactcatctcatcactatttttaacaacagtgcagtggttatcttcatgtgtaagtcagtctacatctctagatattttctcatggtggttttctagaaatagataaactgttcagattatgaatttcttgactcttgatatagatattgacaagttgattcctcaaaaaagtaactaatttatattcttagtgggttattcaataaaaggtgggagcagttactcaagggtacctacattcacatctgaaccccttatgtgggtcttgtatctcagcttctgtggaaaatttggcctcttttctgaatcactaaacttttctgggcctcttttatttgtaaaactgggataatcataccctgaagtaatgtatggaaaagctcattgaaagtagtattttattatttcagcaagtgcttaagagcctcctacttgtactaaatacatgttctgtactaggaactatggaggatgtctaaatgatgtgaacctgggcctcaaaaccaatttacaaaaaaaagaagctaccacacaagtctttttgtgatatctaacaagaagtgcaggccaggcgcggtggttcacacctgtaatcccagcactttgggaggccgaggccggcggatcacgaggtcaggagatggagaccatcctggctaacatggtgaaaccccgtctctactagaaatacaaaaaattcgccaggcgtgctggcgggcacctgtagtcccagctactcgggagactgaggcagaagaatggcgtgaaaccgggaggcggagcttgtagtgagccgagatgtgccactgcactccagcctgggcgacaaagcgagactccgtctcaaaaaaaaaaaaaaaaaaaaaaagtgcaaagtgttgaaggggtttagaggagggagggtttatattgtattttaaagatcaaggacaacagcctagaggaggtggcatttaaggtaagccttgaagaaggagtttaatttcaacagagagtaaggctgggaataatgcgatgtgagaatgatcttgagaagaggcacagagggtaggttcagggcagatccgttgatagcattcactagagtgtaagcaaaaggtgaggaaaactgaaattgtaggttgaaatttttgtttctgcgagtatacttatttgcatttgcacagaaggtggtgatccytatatttatttctgctgtgcatcaataggggaggtggagataaataatttcattgttttggctctggccagaattcattaggcacagtttgttgtccatagggaggggaacacaacacacactggcctttgtctcccttccacacaggctggtggagattctgaggcatttttaaacattgcacttagccattcagatgataacttggatcagaaattttgagaagtggtgggatgaagaagatccctgaagagagsagtaactgagacaaaggmgaggctagcaatagagagacaagtgagggaattagacctttggtatcatcatgaaaaggtgagttttgggaaacaaagagtatggcgggcaagtacctagcaggttctgaatatttgttctttaggagtcaccatttaaacaagaccccaagagtgacattaggtgtaaccaaagtgaaattgttgactacttgatgagattcgtgaggayaggcattaaatgatatcttttaagaaaccattggcagtcctggagctgatgaccctagtgcaggatcattatggttgcttctttcatcatctcaatttgatgacatatttgaattgaacttaaactatacctaagccttaatcccagggtctactagtgattcagctcagcacatctaaaggcaatgattattcaagaggattacattggtatctcctgtcacaccagcatttagtattctatacttattccctaaatatatctcgttgtcattctccgatatttaccatttaccaatattaccaatatgcctagagcatagcaattgctcaataaaagtgtattgaagaaatgacacataataggcattcaataaatgttgaatgaataaatgaatatatccaataaaagcatrtgcttcctttattggatgagagatgtgaaaccatagactcaagaataaagtcatggggtacagggtaaagtaagatagtagatataatcaggagcttctagctgaactggagtcacctttaatgccaggcacawgaacttgacttcattttataggcatcaagaaagagcatctttgaatgttgctgaagatgaaaaatatcttgggcatggtagtagggaggtgggagggaggtttactgttccttaaatgaggcttatcccttyctgcttccatgcggctgatcaccattgtgatgaggaaagagatgattttgagccagatctgggtttgagacctagatttaccttgggcaaatttcttaaactggttaaaggctttgagagatacaccctttcctagggtcatctgttgtgaggttgtgaggtacagatgagaatttatgtgtaagtacttatcatggtggtatctgtcacgtggtaaatactttgttttcttcctttcctggggagtttccttttctctcttcccccagtcttactaaactcctgcccatcttttttttttttttttcctcttcacataagcagtgtagcttttccagggttcccagatgagacagatataagctttccctttgttcatcttcatttgtggaattttagacttttgaagaaagatttcaaagtgataggaggaatgacacaggaaagggtagaaatctgaacaaaatactatatttgggagcagaaaaataagggtccatgagagggtgtatgcacagtgtgaataaaggcatcttgtcacttagggcaacatcattgattctcagcccatctttgttcatccaggaggccaaagagaaagactgtcttgccagttcctagaattatccacgaaaaaggggctactcactcctctttattcagtgagagctagctaccaatctcccagatagccctgagcttttagaatatgatggtatgttttgattaggattagggcagtcattctacagactttttctaggaaaaccgagcttggtaagcagaatagaaaacatccagaatgacatcagtctggtaagctttgaaggaaacaaccaaagatggtcaacacaactgcttgttcttttatttaccatttcacacctggtgcagtcaggaagctacatttaaaaaacaattttctctttaaaaagaaaaacaacccgtagtcaaaaaagcactcatttgccataaagctggaaggattcattcattggagctgattgttcacatttgtagaatttagaattttgtggttggaaggggccttagagttgaataaggtcttcaaaaggaaacaaaaggctcttgctttctgtatgaacagagtttattcacaagtcagttttccgtgatctatgaggagtgatttcagacaattagctaattggttgaggcaggtgacctatcagctctgtagaggggatgtttgctcttagggatctacataaagaacatatcttacactttccatgacagtcaaaagcagccccattaatcctcctatgtaatggccagtcataaccacagatgaggagtgcatttcatgagaaccttaacagctgtcaacagttgatcactgccaccatcagctcagtgttgtgtggggctttgaaatattactgaatgatcttccaatttgttgtattgtagggcataagcggctctccagatatagtctgctatttattttttaagtgttatcagatgcttagtctgttgaaatgacacttgtctattgtatgaaaaacaagggcaggactgacttgtgaccatcttgaaaccccaaatgggtgcaaaaaaagaaaagagaacagggcaagtttggctaggcaaatgttatatttttctggatttcaagtgtgaaagaaattcaaaatgaaagaagagtgtcatagatttgtcatgaaaggaatcagggcctgtcacagtggctcatgcctgtaatctcagcactttgggaggccgagacaggtagatcagttgaggccaggagttcaagaccagcctggccaacatggcaaatccctatctctactaaaaataaaaaaaaaattagctgggtgtggtgacacatgcctataatcccagttactcgggaggttgacgcacaaaaattgcttgaacctgggaggcggaggttgtagtgagctgagatgacgccactgcactccagcctgggcaacggagtgagattctgtctcaaaaaaaaaaatgtgggggtgtacagggaatcaggagaagatgaccagtatgtatgaatcagtaaattcagtctcgttgcccttagtctaaaacccagtgaaatttggagtcattgtttttggagcatattattaaggtgttcccagaatgtaaagttttatgaggagaatggctgtgacaatcatgggatgactggtccttcaaaccagaacaaccacagtactggtcattaagakatctggtttttttgacactgtgtgtatccttgttagtgtattggttaaggtcagggctttgggtctgtcagaaatgggattgaattctgtttttgtcacctacctactttataaccttggccacgcacatggtaagcatttatctcaggaatattttcagtttatgtaagagaaagcgcatagtgtgttaaatagttgatttttctcacattacaagaagtctagaataagcagttcctgcctttggtgtagacagtcagtgttgcaatcaagcatgcttcttctgtcttcccagccagccatctagtgtgtgggctttcagcctcatggtagcaagagaagcaaaagctttcccaggaacctccaaaagatttctacttatgtcttattattcagaactgtgacatgtggatacctccagttaccaggaaagtaaacattctgtttgcctagactctctaattaaggacaaacaaggaaaagggattatgaataggcattatgttatccagccaacagtgcagtgtctggcattgaattgaacattgaacattcaatgctcttatgatggtgatggtaacagataattcacttcatcctgctctcctgaagagtcaggtaacatacttaacattttatactttatggagtacttttgtaagacatttgatggtgtattgtttttatatgtttagaagttccttgctgactgagccaaagaaagaagatgaactaggaaggataatgtagtccaggccttcatactgacctggcctggcctcgggtcttttgcttacaaagctttctcaaaccactctgagctacagcagttgttcatgcctctaaactcctaatattacttctgacttaatgctgtatttgtgctgctttatattttaaaaatgtacatggcttcttagctaagtttggaactccttaattacaggatctacacagaatgtgtcttacggaatatagagaggaactcatttgtgattcatttattgacaaaacattttctacttctcaccattagctgcacttgagatagggtagggatggggagttactagaatgatgctttcttcttctatgagggaagacttttattttctttgcctaatactctaccattctttctccaacttccaccttctttctcttttccctgcctctaagagaacggtgtgggttgtcaggggagaaaacatatcattccattcttktattactttctagcccctccttaactaagtcttgtctgtgacatcactgtggggaattctgccttacttcctaatagggcaaaaacttctgacccctccctgccatttctgagactacagcaaaaaggaaacccccgcatagtagcttctggtgccttttgcatattgccttttgccctgtccttatttctttttggacatttgatttaagaggcaaatagtactagatgaggaaatcaaacccactaactgaaatctacgctgagaagcaaatgattatctgatcttttgctgagaccaaatgctaagaatgtgttgagatcttggaacccaaaggtattagatgaacattgagcaagaagcatttaatcgcaaggctggttgcccagtccaaggttctttgaatgttgttccctgctagtgctagtactatagtcttcagaagtccatagtcaaaggtaggtagatgctggagtactcacagtcagatttctgagcagttgaatacaatggcttttcttccctttactatgatattttagaaatagaaatgactagatgctaacatattttagttcaatatatatcacttcttgtcattaattcaattctttggtttattttgtttctaattgcacagataacaagaatttcctaacatttttctcataccctttggccacttaatgttcccatgctatttattcctgttcatttttcactgtttgatgatggttattgttgaaatttagcaaataaaatgtcagctgtggcacctgtatttccagggtctaaaataatgtgtagacatccatagacaaaacacaaaattctaactattatctattttataaaacaaagcactttaccaaggttttagagatttaaggtgcccgttaattatccctcctcccaggaagtcaaattatccttgtttgctcatgatatgatctcatatttggaaaaacctaaagacttcaccaaaaaaaaaaaaaaacaacaactattacaactgataaattcagtaaagttgcaggatacaaaatcagcatacaaaaatcagtagcatttctatatgtcaacagtgaacaatctgggaaataattcttgttgtgttttttttttttttttttttttttttttttttttttgagagacagtctcgctctgtcgcccgggctggagtgagtgcagtgagtgcagtggtgcgatcttggctcactgcaacctccacctcccaggttcaaacaattctcctgcctcagcctcctcagtagctgggactacaggcgtgcaccactatgcccagctaatttttgtatttttagtagagataggatttcaccatgtcagccaggctggtattgaattcctggcttccagtgatccgcctccctccgcctcccaaagtactgggattgcaggtgtgagccaccatgcccgacctggaaaataattttttaaaaagtaatcccatttatagtagccacaaataaaattaaatgcctaggaattaatttaactaaaaaagtgaaagatctctgtaatgaaaactataagacactgatgaaaaaaactaaagaaggcaccagaaaatggaaagatattccatgctcatggattggaagaattaatattgttaaaatgtccatactacccaaatctatagattcaatgcattccctgtcaaaataccaatgacattcttcacagaaatagaacaattctaaaatttatatggaatcacaaaagacccagaataaccaaagctatcccaagcaaaaagaacaaaacttgaggaatcacattacccacttcaaattatactacagagctatactaaccaaaacagcatggtactggcaaaaaaacagacacatagaccaatggaatagaatagagaacccagaaacaaattcacatacctacagtgaactcattttcaacaaagctgccaagaacacacactggaggaaagacagtttcttcagtaagtgttgctgggaaaactggatatccgtatgcagaagaatgaaactagatccctatctttcaccatatacaaaaatcaaatcaaaatgaattaaagacttaaatctaaaacctctaactatgaagctcctacaagaactgattggggaaaatctccaggacattggtctagaaaaaaatggcaagtggtaactccacaagcacagacaaccaaagcgaaaatggacaaatgggatcacatcaagttaacaagcttctgaacagcaaaggagacaatccctaaaatgaagagacaacccacaaaatgggagaaaacatttgcagactgcccatctgacaagggattaataaccagaaaatataaggagttcaaacaactctatagggaaaagtctaatctgatttttaaatgggccaaagatttgaatagacattttttgaaggaagacatacaaatggcagacagacatatgaaaaggtactcaacatcattgatcatcagagatacataatcaaaactacaatgggatatgtcacctcaattaaaatggcttttatccaaaagacaggcaatagcaaatgctggcgaggatgtagagaaaaggaaaccatcttacactattggtgggaacatgaattagtacaaccactagggagaacagtttggaggctcctcaaaaaatagagctaccatgtgatccagcaatcccacrgctgagtatttaccccaaagaagggaatcagtattttacacagagatacctgcactcccatgtttgttgcagcactgttcacaatagcccaggcttggaaacaacctaagtgtctatcagcagttgaatgggtaaagaaaatgtggtacttatacacaattactattcagccataaaaagaatgagatcctctcatttgcaacaacatggatggaactagagatcattatgttaagtgaaataagccaggcacagacagatagacattgcatgttctcacttatttgtgggatctaaaaatcaaaacaattgcactcatggagatagacagtagaaggatggttaccagaggctgggaaggggagtgaggggtggtaagagaggtggggatgattaatgggcaccaaaagtaaaatagaaagaatgaataatacctactattttattgcacaacagggtaactatagtcaataataatttatttgtacattttgaaataactgaaagaatataattggattatttgtaacacaaaggataaatgctcaaggggatgggtaccttattctccatgatgtgattattacacattgcatgcttgtgtcaaaacatctcatgtatacctactatgtacccacaaaaattaaattaaaaaagttacaaaattataaccatcaaaaaaattattattagtcctcccttctgttgtagaaaataggaaggaaccaaaaggagatgaacttatcacctttactcatgacagctcaagagggtctcagatatagtctggagatgccagtctaggagtacttggtacaatgagagaaatatgaatcagcaagcaatatatagagtaagacaagagaaaactgagggtgaaatcccagggatcatagaccttaaaaggatccttatgatgactgaaaatgaggatagaaatgcaggaaattgtggtgtcaggtaatctaaaggatttaggagaggagccttcaggtgtctcaaatgctgccaagaaatcagtgaagataagagcagcagtaagtatctatgggattttacaacaaaaagttttagatcacccatggtgaaaaacttactgttctccctgcccagtctccctagactaatcacacaggaccacctacattttgtttttcagtctgtcttcacatctggctcccactgtgtataaaaatatgccactgggcagggggtggtggctaacacctgtaatcccagcgctttgggaggccaagatggaaagatctcttgaggccgggagtttgagactagcctgggtaacatagtgagaccccccacctctataaaaattgtttaaaaattagctgggcatggtggtgcattcctgtagtcctagctctcgggatgctaaggcaggaagattgcttcagctcaggattcgaggctggagtgagccatgatcgcaccactgccctccagcctgagtgacagagcgagactttttctctaaaaataaaaaataaaaaaagtcaccaaaagatctttggactcaaattattcattataatcctagaagaaggacttatcagtatgtgtattattggaagatggttagtgataagattttcctttgtaattggagcccagtatttccgggtgaagactgtaaagcactggatcaagagtatactgatggtaccacatgtcccaggcaggctctgaaacaaagcccagcattatcctcctccttctgtcatttgaaggaccatctttcccattaaattataagagattcttgatctgctataggggatacaccagtgttggggctcaataaatatttggcaaaattaggctctgcaggtataagacaaggcaaaggggaaggttcttaaaaaaacaaaaactatatcttcaaatttctgctcagactctagggcatgagggaactccatgtgcctgcttcttcctctaagcacctagaaaggttctttctcaaagtcaataaacaacacttcttaatagttactttttggtctcctaaatgttactttttagtttccctactgttcaagccagagctatgatttgtcattactcacatatgccttcaagtgcagataaatttcctgcatgccattgctacctcttgctgcatcccattagactcttacttaagttgtgaggtttattttttgataaccaaaattcacttaaacataggatgtcatttgtactactgatccgtttctctcatcatttgagtcaggatatgtgtgtaggacactggggcttttaccttctttttgtgctatcatagcttatatgaatagaaagctcagacacagtgaggacttgatcaatattgaaaggaaatttaaatcataccaggtaccctataagctkctcccccaggcaaataaagccagtgttaagttgatctccctaggttggtgggcagggaaagtcccaagcctggtggcttcctcagtcacttctttaaaaaccaggggcctcaccactggtttccaatagcctgtgtatttttagtcctgcttttcatgtaagtttcccattaactgcttgcaggaaatcttttcttggacataatctgcccatttcctgaagtcttcctcccgccttgtgtcagtttggggatgaatcaagtcagcagttttggagggggtttgttctgttccccgccacaggctccccactttgtagagtaccagaaagctgcctttcttgtcttttcctagaggcaaagggaggaggggcaagcccttggtgtgtgtctgcctcttgggttgcccaacacaaatgcccttttgtgtgtggagggggcatgtgtgttttttttccccttcccaatggacactttcatttacgaggtccggatggtgtcctctgggctataaacaatggcataggagataaagagctgccttagtgaccaggctgtggtggcagccactggttttccatctgtgtctctgttttccaatccccttggtctattgtgagtttggtctgatctgagccagcctgggacctctgtaatccctttctaggcccagagcagcgtgggcactattcctcttatcctgaggacttcaagcttagagaaagaggttttctgtggtaaggatagcaactcctcatgtttgcacaatgtgtttaaacacattatatcttttggagaactgaaattctggatttgttatcccttaagaatggaggattcggggctgggcgcagtggctcacgcctgtaatcccagcactttgggaggccaaggcaggcagatcaggaggtcagaagatcgagaccctcctggccaacatggtaaaaccccgtctctactaaaaatacaaaaaattagctgggtgtggtggtgcataactgtagtcccagctactggggaggctgaggcaggggaatcgcttgaacctgggaggcagagattgcagtgagccgagattgtgccactgcactccagcctggcaacagagcgagactccatctcaaaaaaaaaaaaaaaagaatggagaatttggatcaaaagagttggagtgctggtcctgctatttatttattttatttttatttattttttgagacggtgtctgtctctgtcacccaggctggagtgcagtggcgcgatttcggctgactgcaacctccacctcccgggttcatgcaattgtcccgcctcagcctcccgagtagctgggattacaggtgcccaccaccatgccctggtaatttttgtattttttagaagagacagggttttaccatgttggccagtctggtctcgaactcctgacctcaaatgatctgcccacctcagcctcccaaagtgctggggttacagccatgagccattgcacctagcctggttctactattaataactgtgagatctcaggcaaattctagaactaatacctttctacttcatagggtgttccacagttccattaagaaaatacgttatgggaagaaaaatatttccattaagaaaataacatatgggaagcacccaaatgttaaccaaaaaaggagggggtgggaagaggaaatgtacaatgagacaatataaatgaatacgctatgcataagatgctaagtatatagtcactatttggttttagaggtctaagagtaagccttttctccagataaatctaccccttcacctggattctcattctgaccatcacttccttctctgtcatctatcactacgggcccttctttcacatgttgacatgactctcctatctcaaagcaaaccactatttcttgattccagcccctagctcagtgcttggcccaaagtaaggttcaacattttcttgaatggatacttgtgaaaaactccaaaacgcaaagccttgtatttcccttctttcctgtccccagagacctgctgtttgtcactcaaacttctttatttttatacccagggatcactgtgagaaatggaaaccactccagatactttaaacaggaaggaatttaatacaaggaattagatgcttaccaaatgataggaagaactagagctgcatgttctagtttaagaactccataggtgacctcctaggacaccactggtgatccatttaacccccacccacaccccatagctgtggtctcgggtatgggaggtcagacttgagaagctactaatgaacctgccccatggcactcaggaggctggataatacctcagccgcataaaacaatcaaacgtctatatccttttttgccagtagaaacgagaaatagccaaaagagaaatggaaaatggtcttagcctcatttccaccttaccagtcttatatgaatgcaagtaattggcagactrcctgcaaacaaatttggtaaaggtgacttttagttttccagattttctaactagaaggggaatggaattgatgttgagtgggccaacctatcgtacataccaaccaacttcatctagaaagtatttcaggtagcaatatggcgagatacatgctagctgagaaaatccaaacagatctctgtgtttctagttataacaccttccaagtacaaaactgcttccataaaatcatgcttttctgtgggaaatcttcacatttccctgtggcctctaaaatggtctggttgccctagcagccagctcgccttgtacttgttgagtacctagggtattctcaacaaatgcttgagtgagtgcctactatatgtgtcagttactatgaacacatcaaaaacacatcaaaaaagaaagacaaggccctgccttcaaggagttcatgatggtctagtagggggatacagagatgaaaacagttacaaagtgatattataaatgctaaaaggaacacagatgagagatacataaatcgtattgggggataaaatgaggataaatatgaaagggccatctgtactcttgtaaaaagttaagtgtaagggatttttaattaatataaagagcctacaagactggccttataaactctctactctctttctcctagccacgcaacccagacacaaaaccccaaaaatgttcttyatttttgctaacatttttaaatgaaaaatttcaaacataaagcaagattgaaagaattttacaattaacacctatttatcaaccatctagattctgtcattaatattttactatgcttgctgtatcacttatctatttgtctatccattcctttgaccacccattgtgcatcttattttttatagcatttaaagtamattgcagacattagcatatttctccctaaatactttagcatgcatatcattccctagagttccacatctgttgagtatttttctttgaggtaaaatgtacatggagtgaaatgtcaatctgaagtgttctttgagatgtgacaaaaatgtaactaaagctcctatcagactatataaaacattaccatcgttccagaaagtttccccattcccctttccaaacaattctcaccccacccccaccctccagaagaaacaatcattctgattttttttctaccatagattagttttgcctgttttagaatctcatagaaacagaatcatacagtatgtactcttttgtgtaaggcttctttcatttggtataatactttttgagatccatccatgttgttgaatgtatttatagaccattcctttttattgctaagtaatattccattgcatgaatataccactttgtttatgcattctccttcggatggatgcctgtgccgtttccagcttttggctattatgagtaaatctactataagtctgtaatgtcatttttaatagactttttgtcagttttattacagaagaactgagaagatggtacagagttcccatataccccacacccagctttccttattattaatgtcttacacataatgtcttttttaaaaagccttccgcggcttagtgtttttgatggctgcttaatggactgctgattgggaagactgcaaatgcaatgctaccagtaaatgccctgcaacaggaaattgtttttgtcatcccattgagattattgacccaggatttattttatcaaacaatgtggacccgagagtgcctagtgtttggtgtgtatatccgtttctcggaatcttgctcagggaagggtccaaggtcaggtccttgtgtctgcaggtgagggtaatagggctttgtcctcatctgcacaagcaaatgatcagcccaccacgactttcccacttttccacttctaggccttcctgtcacccacaacaaattcccaacaagtttgtaagatgttttgccaaagcacagcttattattataatgacaatatttatgctgtacttgccagtttatagaggtctttaacatccacttcttcaattcaatctagtaaggtattatatccatcttctagaggaaaaactaaaattcaaagaaatttaatgatttatccaaagtgacactgctagttattaagaatttaggatataaacccagctgtcttgcccttaaatcctgatttttttaaatgtattattattttcaaaatttggggggctcaccattgtttttcaaggcaaagttcaaaccatttagtacatcatttaagtcccactgtggttgggactcaacctaccttttcattctcatgttttcctggctccctgtaggctctagaaacattcaatggtatgttgtttcccaaacacttcatgaatattgctacctctgtgcactttaatgatgccttctccattatgttcagaatattatttcctttgttccatgcttcatatcttggccccaaaatctgtttctgggaatattgttcatcctttaaggctcattgcagatattgttattttcatatgaaacatctcttgattactttcctcctcccacaaccattcccagcttgaggtgcttggttccctgttctgttcattgattagactttgaatgcccagcagaccccatttcatattaaaatgcaaagataattaaaacatgattgtttatcattcttataggctattagtgaatcagacatgtacagaagtgatgataatatgacatgaggattaaaattgacccagataccgatttattgagttcccactgtatacccaccacagatgctcagtacgtatttgtagaattgtattgaataatagacatgatgcatttgcgctaaataggaatgatcttgagtatagacaaagaatggtggcttacctgctgtggttaaagagcataaatgggatctttgctcaaataaatctccatccaatttcttcttagccttcatcccatcactccaccaccactttctggctttcctacttctaggccttcttcttacctccagtaaatcctcaacaaggttttaagactttttttcccaaagcatagcttatggggaaattttaccgggtcagaactgtgtctgctttgtatatatttgagagtagcaaactgagttagttctgagatgactgaaaaattctccacaatagaatttcatgtattcaacagaagttactaaggtcctattctgtactgagaacacaaagatgaacaaactgttatccttgacctcatgaagctcatagcagaatgcagacaccacacacaaattcatggaagcaacgtgactctttttttggaaaaagataggacagaaataatttgaagtaacaatttcttattcctacaggaaggcccttcagagtgctttcatgaccaaagtttcagttatttactcttcatttagaaaaaaaaattgtccaaacttgattcagtagggtttactgttatcctattaacctgcaaccactgtatgtcatttccttttataaagaaatccaaataaatgcagaaatgaagtcctcttaaaagtttctcagtgtgaccttaagtaatgtttgcatttcagtggtgtttgtgttttatagccctcctctgacatcaagttgtgatattttaaatgagacacttatgtaaaaataagggtatgacactttttctatcacacaaggttggaagcatctttcataaaaactaatgaagttatttagatatggatatagaataagctccaagatataagtggaataaagcaaagtgcatttaatatactatgatgctttactatatgtattaaaagggggaagacattgtatatattcactctcatatccataaaatatctgtgaaatgaaacacaagataagaatgattgtctctacaaaacagaataggatggctggagttagggtagggaagacttacagtttgctattttatacctcaattcttgagccatattgttaaaaaatacaatgtttaaaaagaaatgaacaaaaatggtttgggggtagcttactgctgaaggttcataggaatagactctggtgaattttcttttttatttgtggcaatactactggcatattttctagagaaattacctgtgaagtattatctatatatcttgtgatttaactactgacaatgtagtggttgtcaggatgttgctaagtcatgtaagatctttgaaagcccacactttacgtgggtagtagttgctgtggtcaggaagaaggcacatcagaacacagatagagttcttagaaatctagcatcataaacccccagggctgaaagaaccagagttcattctagtccacctctctgtatgttcgtatgtcctctacaacattcttgcttagggatctttgtcattccggtgttgttcaatattattaatagagcctcagcaacgtggtttctgtgctgtctggaatgatcagtggactaggactcaaattacttggttcctagtctcagctctgccactaattaattctgtggcttcaggcaaatcactttgcctctctgggcctctgttttttcatgactgaagttagagcattggcctgatggttaagcacatggcatggtcactgttgcttcccctccccacctataatagacattacttcttagttttggcaggttctttgtggtggataactacaaacaaagtctcagaatccttctcaacacagccttccaggcaactaaaatcagtagatagaacttggatgggacttgacaaacaagataaaagttacttacttccatctctaaggttctcaagtagcagtgtgcaggtacatatttaatgacaagttctcagcaaaaaaataagatgccctggtttgcatcgtttgccaattcccatggtgtaaatattcacaccatgactgatttcagactaccattgcgaagtaaattgggttgcaaagttcccgaaagtttaacagtcagcttttatgagctgatagaagctgtctctggcccatcactgtaaaattaatgactttagattagctggccataaccataagtgaatatgaaaatgaccatcttcctttgggagttttatcmagaggcataattcttaccttgtryggtcttttggacttcggaaatacttggttgtcatcagaccttgatgttttacttccctgaacctcagctacactatctggaaaatgggaataaggattcctacttcagaagattatagtgaataatgagacactatgtataaagcacttagcatggcatctagcatatggattgatattccccttcccttaacagtgtggtagattatatctttatctttcccagactcatgaaaggctagccattgctttccctctagcacctttctttttccattatactcccttggcattccattttcctctgctctaatttacttaatcttctgtctgagtggaatgttaaatatttaatcttacctgttcttaatgttttatttatcatctatccaggcacatttgtgagtagagaccagccctgtgtaagtctcctgaattatacaccatcacagcatcataagtaaataagtgctaataagtccccactcttgggatcaaacttaaggatgataccgaagggagcttgtgttacatgagcacaagaggaggctgctaaagatcagccagaatatgatatacttgtagaattctgtctcctcctgtgtacttatggccagtgacctcacggcaagtagaaagaatttcacattttaagaacatgcctctttaaaaaaaaaaaattcagagggagtcaggcatggtggatcatgactgttatcccagcactttgggaggccaaggtgggcagatcacctgaggtcagtagtttgagaccagcctggcccacatggcaaaaccccgtctctactaaaaatacaaaaattagccaggcatggtggcaggcacctgtagtctcagctactcgggaggctgagggaggaaaattgcttgaacccgggaggcggaggttgcagtgagctgagatggtgccagtgccctccagcctgggcaacagagccaggctttgtctcaaaaaaaaaaaaaaaaaaaaaaaaagaaagattcagggggtacacgtgtaggtttgttccatggatatattacaagatgctgaggtgtgggcttctattgatcctgtcacccaaatagtgaacatagtgcccaacaggtagtttctcaaccttacccccctcctccctcccccgacctttttggagtcctcagtgtctactatttccgtctttatgtctgtgtatacccaatatttagctcccacatataagtgagaacattataagtgtggtgtttggtttcgtttcctttttttttgaattggggagacggagccttgctctgttgcccaggctggagtgcagtggcatgatctcggctgactacaacctctgcctcctgggttcaagtgattctcctgccccagcctctcaagtagctgggattacaggcacacgtcaccatgcccaggtaactttttgtattttagtagagatgggatttcaccatgttggccaggctggtctcgaactcctgacctcaggtgatcgtcccgtctcagtctcccaaagtgcagggattacagacctgagccacctcatcaagactggttttctgtttctacattaattcacttagaataatgacctccagctgcatacatgctgctgcaaagtatgtgattccatactttttacagctgtgtagtattccatggtgtatatgtactatacattttaaatccaatccaccattgatgggcacctaggttgattccctgtctttgctgttgtaaatagtgctgcaataaacatatgagtgcatatgtctttctggtagaataatttattttcctttgtayatatactcagtaatgggattgctgagttgaatggtagttctatttttagtctttgcaaaatctccaaactgctttctacagtggccgaagtaatttacattcccaccaacagtgtataaggatttcctttgctccacagcctctccagcatctgttgttgttttttttttttttttacttttcagtaatagccattctgagtggtgtgagatggtctctcattgtggttttgagttgcatttctctgatgattagtgatgtttgtacatttaaaaatgtttgttggcccattgtgtgtcwtcttttgagaagtgtctgttcatgtcctttgcccactttataatggtattatttgtgttttttattgaattatttaagttcttagataaagattctcagtattagtcctttgtcagatgcatagtttacaaatattttctctcattctgtaggttgtctctttactctctcgatagtttcttttgctgtgtacaagctcttcagtttaattaggtcccacttgtcaatttttgtttttgttgtaattgctttagaggacttagtcataaattccttgccaaggctgatgtctagaagggtattttctagattttattctaggatttttatagtttgagatcttacttttttttttttttttttttttttttttttgagacagagtctccctctgtcagccaggcttcagtgcagtagctcggctcactgcaacctccgcctcctgggttcaagtgattctcctgcctyggcctcctgagtagctgggattacaggcacgtaccaccacgcccggctaatttttatatttttattagagacagggtttygccatgttggccaggctggtctcaaactcttgacctcaggtgacccgcccacctcggcctcccagagtgctgggattacagatgtgggccactgtgcccagctgagatcttgcatttaagtctttaatctatcttgagttaataattatgtatcatgataggtaggagtccagtttgattcttctgcatatgtttagccagttttcccagcactatttattgaagagtcttatccccattgtttttttttttttaactttgtcaaatatcagtttgttgtaggtgtgtggccctatttctgggttctctattctgttccattggtctacatgtctgtttttgtaacaataccatgctgtgttggttacaatagccttttagtatagtttgaaagttgactaatgtggtgcctccatctctgaagaacatgtcaatttttaaatgcaagtagagtacttttcaaaagtttcccaaaactgaacttttgttaaatcttacatataatcttctccctcctctagtacaatgtttataaaatgagagatactagaggaaatgcagtgtgawctgtgctgcatctcttaattacaggaaccatttctccgcttactgaacacatactgcactccacgctgctgtgggctaggagtaaaaagacatgagcaatttttcctgcttgcaaggaacttaaaatctatagtaaagaggtaattcagccaaaaagtataacataaagtgataagttccatcggtaatagaggtaagcaggaggtagagcagaccatacatacgggtcatttccatcagccagggatggatagaagattgtgggagagcatcctggaaggagtgatgtcggaaacatctgttccccttctttcctctctcacagctcttagtactgtgctaaggttaataagtccttggtacaggggtactcatatccacccccatggcttcagttacctttcctatatgctgatgacatccaaatgtacatctccaacccatgcatgaacttttcagaccaaatccttggcctacagctcgggaaacctgcctcagtagatgtcatagttggctcaagctagaaacctgtaagtcattcttcactctgtttcaacccccacattccagcagtgactaagaaattgatcagttaaatatctcttttgcattaccttctctctctctccattgcccaccacagtttaagccataatttcttactgggactataatatctcccagttgagactgggcacagtggctcatgcctgtaaccccagcactttgggaggccatggcaggtggatcacttgagcccaggagtttgagatagatcagcctgggcaacatgacaaaactccatctctaccaaaaaaaaaaaaaaaaaaaggcaaaaattatccaggtgtggtcatgcacacctaatcatagctacttgggaggctgcagtgagctgtcatagcaccactgcacttcagcctgggcaacagagtgagaccttgtctcaaaaaagaaaaaaatctcccagttagtatacctgatgctaggcttgctcttctcaagcttttcacacagcagccagagtgatctttytagaacataaatccagccatagcactcctcttttctgttgtccttaggatgatgtccaaattccttatcttcttcccacattgaacaaggataagaccctcttccttgctattaattctcatggtgcaccatattttccttgatcataatattgatcatgctttatcataattacctgtttcttagctgggcatgatggtacatccctgtagtcccacctactgggaggctgaggcaagaagattgcttgagccaaagagctcaaatcctgcctgggaaacatagtgagacccctgtctctagaaaaaaagaaaataaaattgtttttcaaaattatctgtttcttctcacctgggcgcagtggctcatgcctgtaatccccgcactttgagaggccaagcaggggcagatcgaggccaggagttccagaccagcctggccaacatggcgaaaccccatctccacaaaaatgcaaaagttagccagtgtggtggtgtgtacctgtaatcccagctactcaggaggctgaggcaggagaattgcttgaacccaggaggcagaggttgcagtgagccgagatcacaccggtgcactccagcactccaccctgggtgacagagcaagactcggtctcaaaaaaaaaaaaaagtctgtttctttatatctctgccagatactcagctctgagatcatggaccatgtctgttttgtttactgctgtatcctcagcccgtggcacagtgcctggtttacagtagaataataaatgtgtaagttaattttttattttaagtgcactttaataattttatatctcataaaaatgaaaaggcctcaaatgtggctctctgctaagtatgattagtcatatagtaaattatttttatagcagatcttgtttaggttgtgaacatgggtgagaaattccagtttctgtcattatgtctggttctatcaagagccatagagatgaatgttaccaagcctaagggtaagttagagaggaaaacatgggagaaaactgtaaagaacagaaactctaccacttttttccccaactagtactgcaatatatatcttcatacatacatctttttctttcctttgaattattaccttaaagtcagatgccagaaatgagaattattgggcacaaagggatgaacatttttaaggcatttgaaatactgccagattattttccaaacacataatactaacaaatagttcagagcaacatgcaagggtgtctgttttatcacactacagggaattgtcatgaaaatcttttagctggtttaatggaggaaaaaatggaggaaaaaaaattcatttttagttaaggtttggtgtttttcatctgattatttatgcagctccttctgagggtgcatccaaacgctcacagccttgtttcagaggctgagaggcctgcaacctcagcggcctctggggcacagcacctctgttgtgcagcagcagggaggggcagtgatggagggaaaacataacacagaccrcaccattgttaggggatgaggttgctgggataatgctgtgagaagggatgaaaagaacgattctccattcttgattgttgtgatttccagggatgagccaacagctccagtgcgggaagggatgggtctttactgcatccagatgctcctttttccagtgctgcctccgattatttctggtgagaaggggtggtggataacatagcagctgaaacagattaacttttatgccagtttcctccctttaagtgattgccctggacctggggacattcagaattcgtcagaaaccgtttagaaataagaatgtggttcaaggtccctggtgtgcaagagccaaccttctggagtttgcgtaccattcctgcctttatctgtgggagctgcttgaggcaaagggatctttctttcctctccttccctactgccactgccgttgttcaggcccttatcctgttttgtctgggcttcctgtttcccttaatctatcctcatctatgctgttgccaaagtgatatttctactatgcacactggatcctatccctctccagttaaaactgtcagtggtccgccactgccttcaggatgaaagtcaagctccttttcacagctttttttttttttttttggcatttaacaatcagatcccaaaatgtctttcctgactggctcccaccgcttctctggactgttccaggaccctgactagtgcatgcactctgtaaggtgcttgtgctggtccctcctcctgatagcccttctgcctctgttccaccagattcactcctgatccctcatctccctcctcaaaaagaagtctccctcaattatcaactctctgatggattttccctggtaggtaatcagttctgttcctgtaaccctctagtagcaactatatacaagattgtgatttctattattattttcccctaaatcaggaattatcttccttttgtatattcatatttgtggatccccagcccttagtacaatatttgacacataataaatgctccagaatatctttttcttccttcctgccaggttgtttgtaagttcttttaccttcaatgtgttcttagttttagagttaaaaggaaatgtaatgtagtttaatcttcttcttctttttcttgttttttaatggttgacaaaaccaaagcccagaaaagaaaagaattcaccctgggatgatcagccagatataatggcagggctgtttagggctgatctccttaggtaacttaaaaagaaccttgaaacaaaagattgcatcaggaggaaaggaaggagcaaagattcgttgccaagttctttgctgaatgcttaatatatgttactttttaaaaaaattatttcttcttttgattgtgataaaatacacataacataaagtttaccatcataatcatctttttttttttttttttttttttgagacggagtctcgcactgttgccaggctggagtgcagtggcgccatctcagctcactgcaacctccgcctcccaggttcaagcgattatcccgattcagcctcccgagtggctgggactacagctgcccgccaccacacccagctaatttttgtatttttagtagagatggggtatcaccatgttggccagaatggtctcaatctcttaacttacgatctgtccaccttggctcccaaagtgctgggattacaggcgtgagccactgtgcccggcccatcgtaatcacttttaagtgtatagttcagtgacattaaatgcattcatattgctgtgcagccattaccaccatccatctccaaaactcctttcagcttcccaaactgaaactatacccattagacattgatgccctattcctccggtggcctaataaccactgttgtattttttgtctctctgaatctggctactctaggcttgccatgtaactttgtcatataagtggaatcacatggtattttctaactgcttatttcacttagcttaatgcccttaaggttcatccctgctgtagcatgtgtcagaatttccttcctttttaaggctgaatagtattccattgtatgcatgtactgtgttttatatctccattcatccaccagtgacatgtgggtagcttccaccttttggctcttctgactaatgctgcaatgaacataggtgtaaaaatattccgtttgtgttcctgctttcagttttttggggtctgtatccaaaagtagaattactggatcatatggtaattctattttcaattttttgaggaattgccttactctcttctatagcagctgcactattttatatccccaccaacattgcacaagggttccagtttctccatattctcaccaacacttatttctattttttaaagtagccatattaataggtgcaaggtagtatttcattgttttgatttgcatttccccaatgattagtgacatgagcatcttttcatgtgcttcttggtcattttgtatcccttctttggagagatgtctattcaagtcctttgtcaatttttagttaagttgtttgtttttgttgttaytgtagttctttatatattctagttattaaycccttataatcctgtactagtcagtgttctccagagggacagaactaataatatgtatatatgaaagggagtttatacatatttcataatatgtatattatgaaagtaaagaattggctcacacagttataatgcaaagtcccacaataggccatctggaagctggggaagagagaagccggtagtggctcagtttgggtctgaaagcctcaaaaccagggaaaacaacagtgcagcctttaagtcagtcccaaaggcaggacacccaccccctggccccccgtgcaagtcccagtgtcaggccaaagaacctgaagtctgatgtccaagggcaggaggagcgggaggaagcatccaatatggcagggggagggggagtggggagaaggaagccagaagcctcagcaagcaagcttattccaccttcttccgcttgctttcttctggccatgctgacaggcagtaggatggtgcccaaccatattaagggtgactcttcctttctcagtacactgactcaaatgtcaacctcctctggcagcaccttcacagataaacccagaaacagtacttcgccagccatctaggcatccttcaatccaatcaagttgacacctaatattaaccatcacaaatcctttaccagatatatgatttgcaaatattttcttccattcagtggattgtcttttcacttggttgattgtgtcctttgattcactaaagttttaattttgatgtccaatttatctattttttgttttgctacctatacctttggtgtcacatccaagaaaacattgtcaaatccattgtcatgaaacattttttctatgttttcttctgagaggtttatcattttcattcttatatttaggtctttggtccattttgagttaatttttgtatatggtataagggtccagctgtttttttacatgyggatatccagttttcccagcaccatttgctgaaaagttctgttatttcttttgtatttgtgtgatagtcctaggatgtgttataattaccttatagatgagaaaacagaaggtgaaatattcctgaggatcccctaaaagcaggcttcttgctatccttggcagttcaaagacattaaaaaggggggaaagccattttgaaataatgcgagaagaagaggggaatagactgagaggaaaagcaaaacaaaataaaataagattgggatagacagccagccgtgagcagaactttgaagtgtgtttataattcactcagagacctcctcccccctgcccttttactctccttccttctcttactctctcaattagctccttcagtttgctgtctcttctgaaactctttgaaagcttttctacagtctgtgtccagcctgttttctgagctttatctgctgtctccctcgctgccactgtgaagctgtaatggagtcatgttagttctcactgctcccatagcaagccctgcctttacagaccacgttcattttattcactttacctttaatgtgccatggtctttctccaaggcctcttgacggtggtggcacctcttcacctctgcgtcccagtagcattgtggcacagaggtggctgttctgtaaatgtgtcaaaaagatgactaaaccgacagtttttgttcctttgcataaccattccacatatgcaatatagtcttaccttccgggatttaaagtaagcatgtgacctggtctctgtccaccagtgattgtaatctagctgggagaaagcaaggtacttctatatacacttgacactttaatattctgtataacatgttatacttgtaaccttcagtgaatgacagggaagacttgttttatctccattatattaagatactaaagcacagcaaagttggagtttggctgaaatcacataactagcagaagatcaaggtgggacttaaacctaggggactgacttcaggcaagatgcttaaccacttaaagctactcagtttgttcatctayaaaatgaggataatagcgtctacttcctaagtggttgtattaaaaattacaccatgtgagtgaagaattttggcatgtcatatgggacgcagtgcaagctgctattgtctgtctgtctatatggtgttttttgtcactgttataacactttcagtgtattactttggaaaagaggcttgcaagtaccatcacaacggtttctccctggacttttggaaatattaatggccactcctgttttacatgcgagccctatgtcaagcacctcatgtgatgcctgcctgactcagggctcagtgaatggttcctttacttcccctcctggccttgtgcttttatgggtgaattgcacaggacttgacactcccacatccagaggctaactagctgaataacccagctagaactagaacttagaattctgccatgtttttcagactgtgtcttcttttccattactctttctgtagtctttcatgtgctctcttcacatttttttggtaggtggatttaagttggtaggatcactgaggcatagtagaagctaatctgtactgataccttattttcaatttgtagaggccccagggcacttgtgtgataaatggtgctatgtaaattaaaatgcaagtaagggtctcttcagtgtttcttaaattaagtttattatatgtggtaatttgcacctagaggcttttgttgttatttgttgtagtgactatggcagtaatgagcctgctcccagaaaagcttggcacatgccccatagacagtttatttgcatttggctggactccatggtgtaccctgaacaaatgaatcagcctattggaggggtggagaaactgaatcatagggaggctgtgggtcttgcacatgatccctggtgatcctgaggtggggcaataccagagttctatgtcctgttcctagctggattattccttagcctcaggatttgggagcatcaagcaccttgcagttcacccttaaaagcacaaagccaggaggggaagtaaaggaaccattcattgaaccctgagtcaggcatcatatgaggtgcttgacatgtaaaacaggagtggccattaatattctcaacagtctaggattcggattcagtctttgctttattgtggtaggtaacgctgtttatctggcagctgcattgatccaaaccatgtgaagaactgaaaaaaaaagtgctgggaaaaaaaaagctttagagtgatcccaaagaatacactaaggcttatacacatcagattctcgtgacaaccttatgaacagagcaagtgacaccttcttcatgaatcttagcccaaggaacttgcctgagatgtggtgatcacacaataaatagcagaccaaggactgatagatcaccacccagagattctctaagaattaacatgaaacagtatatcatgttttatattacacacacacacaaacacatattttttagttcccgtttctgccacccttgatgggagttgaggacactagatctgagaagtttcagtacttttctgagacacgtggggcaggtcttggtgagcaaaaagagcccagaggacagagtcataagtccttgctttgtcgatttataactttatatctacaattaagttacttaaccacttcaccctcccagtttcttcatctttaaaattggataataggccaggcgcagtggctcacgcctgtaattccagcactttgggaggctgaggcagttggatcgcctgaggtcaggagttcatgaccagtctggccaacatggtgaaaccctgtctctactaaaactacaaaaaaaattagcggggcatggtggtgggcacctgtaatcccagctactcgggaggctgaggcaggggaattgcttgaaacagcgaggtggaggttgcactgagctgagatcgtgccactgcactccagcctgggcgacagagcgagactccgtctcaaaaaataaataaaataaaatgggataataatagtaacaactcacaggatgttgtaaggatggaatgaactcttatatgtaaagtgcttaggagagtgcctggcccaaagtaactgtattttgtttttgttgtggtggtggtggtggtggtggtggtaaagaccacacagcttggagaaaccccagaatctccctcttgttttcctcttactttcttattgaagaactgtagggaaattaccttttttttttttttttaaactccacaggtcatgctggctcagagtttacagtaaacaccaggaacattcagttggttgtgccctcagttcagggcatcttatgtaatgtgctgccctgtgacacagacctagaaaaagggctgttttcaagcctagacatgggaggaaggttggtattcttcgtaatttgcagcaaggcatgaagctgatgtctatcactacagccagccctggacggcattgtttgttaggtaaaattgtcggtagaactctgctctgcctcttacctgtttctctcaccccatctcagggcctcagggctctggcctctgtatgacctggtgggattgagcttctgtaggcacctcttcttgcccacagcctcatacctaactaccgcctcgctccaagtccagttgtctcaggctttctaggtgtcttgctactctggtaaactaattgtatcttatgtatttatggaaagaattaatgaataaacaaatgcatggaggcaatttaaaagcaatataataagcagtaccaacaccactgcctggcccacagcctggcacgcagaggcttttgttgttatgttatagtggctcagtgaaaacttattgaataatttattacttttggtgtaatgcatttactatcctaaccgtatgtttgaagcccagttcaaatgctctatcctttgttgaactgttcttatatcaaataaaaattcttccttttctgtaatagaactttataggaaagtttatatatataatattctttagggaaagaaaaaaaaacaacctttatattaccttacttgattcttgtaacaacctggttaggattatcatcttcattttataattgaaactgaggcttaggtatatgaaagagctcatttttatgcagctcttaagtaatgaagctgaccccaaaacttactttcatgtatataaaatgtacctaataagtgttcagtaaatatggggggaagaaaaaacttactttcatttagtaaattatttttacctcagtacattatataggcagatgtatattttatgaagttgtgcccatattttagcttccccactagaacagaagcccttttgatctgagaactgtcccatcttgttgcctctgcttcccagagcttcacacataataaatgtttgaaagtaaattgctaattttaacagggttcttcagtggcagaatttcatacaaaatcattgtagtgaaagaaaaaacctttagtaaggagacaaatcaaacttttttcccctgtgtagagagctccctaatgggtcttcttatttttttagaatgaactgtaggacatacccacaagggtactctttctgatgggtgatacgaggctcagggtttgtggcaatgaactttgctctttcccacacctgaagctgcagctgtaacacacatcagagactgaaggacagtggcgctggaacacgaccaggcctgggctgcggttcgccttggtgaactgagattcatcactattaatatctgagtttccattaataacccttttcactgtgagctcatttaaatcttctgttctctaagctatttttaaccacacattcttgggcctgggcctggttcccgcttacagatcataactttcattttgatttttttttctttttttttttttttttgagacagagtcttgctctgtcgcccaggctggagtgcaagtggcacgatcttggctcactgcaagctccgcctcccaggttcacgccattctcctgcctcagcctcccgagtagctgggactacaggcgcccaccaccatgcccggctaatttttttttttttttttgtatttttagtagagacggggtttcaccgtgttagccaggatggtcttgatctcctgacctcgttatccaaccgccttggcctcccaaagtgctgggattacaggcgtgagccaccgcacccggctcattttggtttttgtacttgcagaaataataggaattctgcccaacccctcactccctccacccccacatttctcagaggcgtgtattgaaattgtaggtgggacaattctttgttatgcragattttatcctatgcatggtttgaggttaatatacctgtcctctgccctctaatgcctgtaaggctttccaatcattgtgacaacttaccccaccactgccaccaccacacacacaggcgcgcgcgcacacacacacacacacacacacacacacacacacatttctaaccctccccaaagtgaaccgtactgggactgattgaaagccattataaccagacacctctctctgccacccttgatctctctctgttgacttgagtccctatccaaggtagaactaggaaacaggatgttactctctatatcctgagaaaagcagcttttctgtttccccagagctctccactttgtgaaatagagaagcaaattaagatcttggggattgaactgctgagaccagttgaatatcattgttgctctgtcaagacaggttttttaaaaaaatattagccaggcatggtggcatgtgcctgtagtcccagctactcagggggctgaggtgggaggatcccctcaaccctggggaggttgaggttgcagtgagctgtgatcatgccactgtactccagcctgagcgacagactgagaccctgtctcaatttaaaaaaaaaaaaaaaaaggcagggggcagggtttaaccacaagattttattctcttaaaattacatgaaggctggggagggggacagggactggggaaaggctgttagttagtatggaatttctttttgggtgatgaaaatattctggaattaaatagtggtgatggttgtacaaccttgcaagtatactaaaagctactgaattgtacactgtaaagggtagattgtattgcatgtgaatcatatctcaatttttttaattgcttgagtctgctactcttaatatttccctacctgtcatctgatctcccaagcttgaaacttttatctggcagttacttttgactcttctctctcccgcagttttcatttctagtgggtcactaagacctaactcctaagtaattctcaaatacctttttttctgtccccactcccagtgacattactcaggctctcccttgcctgtactgtcgtgactagctgttaatttctcttcctgtctctagacttctcctaccctcagcatctttccaggatgtttccaactatgtcttcaactttttattgtgaaatggaatacacacacaaaaattatatataatatatactgtactataaaggaaacacccatgtaattaccacccaggtcaaaaaattgccagcatcccagaaatccctgaatgtctctttccagtcatattcttcttattccactccatcccttcttccaagtatcatgacttctgtggtagtcatgcccatgcttttgtttgcagttttaccataagtatgtgtattctcaagaaatattgttagttctgtttatttttgaacttttgaaatcacatttttatactcgcttccttctctcaactttgtgtttgtaaaatttactcatgttgtgtatatagcttggttgtgttttcttaaaatcttgatctgwtcctgtttcttccaatcacatagatgctaagttcaaactccttgataatggcagcattcaaggtcctccaggatcctgtcttgtaacctgcctctccatcttcatttgcagtgacctctctccccacatcctttcccataatcacatcaaagatgccctgtctttctttgagtagggatcttgctctgtcacccagcctggagtgcagtgttgcagtcacggcttactgcaccctcagcctcccgtatgccctctctttctatgcgtcctgtgcttaaaatctagactgtctttctactctttcaacctagtgtatttttgastccctcctcaaagtagaatagactcattttcataattatttatactctctctccctgttttaacacttataatatgtcttgtattgtaagtgttataggcccaagcatctggagttccgatgtccgaaggcccaaggatttggagttccaataatgtccaagggcagagaaacatgggtgtctcagcttcagaaaagaaaatgttttccctctgcctttttgttcttccaggctctcaacaaattggatggtgctyacccacactgggtgagaatggatcttccttactcagtccactgattaawatgccagtctctcccagaaacaccctcaaagacacacccagaaataatgctttaccagctatctgggtatcacttaacccagtcaagttggcacctaaaattaaccattacactgttatattctcacttcttttgtattaaaaaataactcatacactttattccattgaatatcatgaactcctatgtttgcagattcaattagttataaacttaaaatgttacaacttggacattgggagcccctttaaatcgtatcttttgactcaacatctctctctctctctctctctctctctctctctaacattttttgtagagatgggatctcaccatctttcccatgctggtctcaaactcctgggctcaagagatcctcctatcttggcctcccaaagtgctgggattacaggtgtgagccatcatgcctggccaagtccttaacatttttttttctgtgatttattttttcctttatttattttccccatcacaaatttcatacacaattctgtgatatattttaaagcaaccttgcttttattattgaacaaaaataattttcaggcttaccttaaatttttttttaacttcacaacatagaatcaacccctttccagagagttttgattcctttggtagagaataatgcaaaggacccacttctaggactctaggtgcacatgaggttgtagaggttgtagtgttcataagcactgttgctgtcatgggctactcttagtgactgagttggaaagttaattttttcaaggttatgagttcacataagggtgctgtatctaacttttcttagaatgcttggttttattgaccattaatactgtctcctacataaatattaggaagtatttttaattacttgctgtgatcagttccattgaattatgcccaaatacaggcctggtgagagatacatgttcaaaacaattagaagataaaagttgatatttatacataacacattttgtaaaacatatataccttactttatctctttctgtgactatgtgagatggatggaatgtgatctattttacgaacaaggaaactaaggcacacagcagaagttaagtgactcattagggtcatgcagctaataagtaaaggctggaattttaacctgtatcttcagaatctaaatcctgtttattttccactgtctgtacatcctttcactctctgccttcaagacgcttgcaaacacttgtgtacctgaaataacataaataacattcatgatgaagcttgtagctttataaaccaaggattgcttccaaatgaaatctatacttataatcctttcagagaaaacttatgatctgaatgactatattgatagcttaagaaagtatataggggccgggcgcagtgctcaccgcctgtaatcccagcactttgggaggccaaggtgggcagattgcctgagctcaggagttcacgaccagcctgggcaacatggtgaaatcctgtctctactaagaatataaaaaattagccgggcgtggcggcgtgtgcctgtagtcccagctacttgggaggctgaggcaggagaattgcttgaacctgggaggcggaggttgcagtgagccaagggcgcaccactgcactccagcctggctgacagagtgagactccatctcaaaaaaaatgaataaataaaaataaaaaagtatataggttctagattaggttgggatggatttatattagtaaatcaggttatattctagtttattgaaagctcatgtccatttggggtaaagttgaaggttctaacaaagataaagtattaaatttctaggtatagggcaggcttggtaaatgggtatagatgttttaatataggggtttgcattctagacgttaaactgctgggcttgattctgtatttttgactgctacagtgtaaaaaatatttttgctcagagaaggattaaggacagaaatggtttgtttcagtcttagaattttatttagaatttcactagggttgagcatgggcaatgcttgccttttcctctaggaagccatagctcctcagttggaatctgcaaacttttgctctgaggtcttgggagaaactgagaccttgggaatgcatcccggactccagagagccctattcctcagggtcaggatgtctcaagatgaaaaattatctaaaaactatgtttcaactctaatatttatttagctgcattttccactcaggcacaggcaaagaaaagtgccagaaataaaaagaccagggatttttcacttcttaagatgaaaaggtcctggtgctttatatccagaagtgctcatcacttacctccacacaaagaggcaactctgaacctgctaagtggccacaccagattataaagttacaaagaaggctggctgcaaggcacctggagcctccctgtgccacctcccctctgtggagctctctcttgccctgcctaaacattcaggattcattcctgtctaaagccctgatctccattctgtattagttttataccttaaagtaaatctaaattgtgtagaacactgctgggcaatttttgcagtttcagagacaagactcattttagaataaaaggctttgggtcctatctataaaaaaataaaaaaagactagagtttttgtcccagctctgccacagacttccatgtatgagtttagtaagatattaccattttctcaaccactgctccttgatctgtaaaatgattatgataatccctttctttccctactcataaggcaattttgaaagtatgaaaagggatttatattctgaggtctcatcagtactgagtcctcagttggcattcagctcagctcagttcccgtgctatctctagaagggaaggagaggcactgtgcctgtcctcccagagagagtaaggaaggcttttgggcattcaagtggaatcttgaaggattaataggattttcacagggaatatcacattaaagcagtttgctttkcctggaatgtcagatgttttgaggctgagaaataggcatggaggggagggaaggttgaaaatttcaggtagcagtttggaaccaaatgaaggaaggcccttgaatgctatcctgagtagtttagacttggcactgtaggacagtgcttttcaaactttttcatattacattatacaaagaaaacaatactttaatgtcaggctgcaggtagctattggcaaggggtaactggcccagggactacagtttctctgagggctaaaggaattaaaaacttttaataacttggcacttcatcactggttgaaaagcactgctaggcaataaggagcctggttaagaaacttcaggaaaaatatttcttctttgtctctccagagtctaagattgtaatgtgacttctactctagattcttgccttgggagcctggcccttggcgaaatcgagtacaccaaaaatgagtcagcctatcactacagatcctataccattaaaaggttaataggagattagtaattgccaggggatggaagaaggggaagatggagattgactaatgggtatgggattgctttttggggtgatgcaaatgttctggaattagataatggtgatgtttgcataatcttgtgaatatacaaaaaaccctaaattgtatacttgaaaggggtgaatattatggaatataaattatatctcattaaaaaataaaagcataataggagaatgttatgaacaactttacttcaataaatttgataaatgaaattctataaaagacacacatatcaaaactgacacaagaagaaagcaaaaaatctgaagagccctatacctgttaaaataatttaattataattttaaatatataatttaaatataattcatgggcctcatttgtctgcccttcccccaactttgccctgattttcactaaatctttgcttaattcagtgctttggatataactgagatcagttctttcaaggacatgagaatgaggtccctcaagagaataacttttgtttctccaacatgcagaggactggcaacagctcatctgttgctttgccaacgggagaggtaagaaacctccaggcctggatggcttcttcagtaaattcaatcaaacagtaaaggaaacataatccctaaattgatcaatagattcagtgaaaccccagtcaaaatcccagcacttctcttttttgggtaaaaattgacaaactgattctaaaatccgtatggaaatgcaaaggaccaagaataaccaaaacaactttgaaaaagaacaaagttggagaacttacactacctgatttcaagacttattataaaactgcagtaattgagacagcatgatactgacatatatgaaaaatgatattatttaaacataggaagtctagaaataggcctacatgtatttgatcaattggtttttaacaaaaatgcaaaggtaatttgataagaaaaggatatttcttttcaacaaatgctgctagaacagctggatatccatgtgtaaaaaaattgaaccatgacctttttctcatactctatacaaacatgggtcatagacaaatatcaaagctaaaattataaaacatttataagaaaagcaaaaaatctttttgaccttggggtaggcaaagatttcctagataagacacaaaaaaaagcctaaaccattttttaaaaaattttgtatttccacaggtttttgggaacaggtggtatttggttacatgagtaagttctttagtggtgatttgtgagattttggtgcactcatcacccgagcagtatacactgaacccaatttgtggtcttctgtccatcaccctcctctcaccctttcccgagtccccaaaattcattgcatcattctttcttttgcttttgcatcctcatagcttagctcccatttatgaatgagaacatacaatgtttggttttctattcctgagttaattcacttagaataatagtctccatcccatccacgttgctgtgaatgccattaattcattcctttttatggtcgactagtattccatcatatatctatctgtatagatacatatatatatctcagtttctttatccactcattgataggtatttgggatggttccacatttttgcgattgcaaattgtgctgctataagcatgtgtgtgcaagtatcttttttgtataatggcttcttttcctttgggtagatacccagtagtgggattgctggatcaaatggtagttctacttttagttcttcaaggaatcttcacactgttttccatagtggttgtactagtttacattcccaccagctgtgtggaagttttcccttttcactgcatcgatgccaacatctgttttgttttttttttaatggccattcttgcaggagtaaggtggtatcgcattgtggttttgatttgcatttgcctgatcatkagtgacgttgagcattttttcatatgtctgttagccatttgcatatcttcttttgagaattgtctgttagtgtccttagctcactttttgatgagattgtttttttcttgctaatttgcttgagttcattgtagattgtggatattagtcctttgtcagatgtatagactgtgaagattttctcccactctggcctgtttactctgctgactgttccttttgccatgcaaaagctctttagtttaattaagtcccagctatttatctttgtttttattacctgtgcttttgggttcatggtcatgaaatcttttcctaagccaatgtctagaagggtttttcttctgttatcttaatagaatttttatagtttcaggtcttagatttaagtccttgatctatcttgggttgatttttatataaggtgagagacgaggatccagtttcattctactacatgtggcttgccagttatcccagcactgtttgttgaatagggtgtccttttcccattttgtttttgttcgctttgttgaagatcagttggctttaaatatttgggtttatttttgggttctctattgtgttccattggtctatgtgcctgtttttataccagtaccatgctgtttaatgactatagccttatagtatagtttgaaatcaggtaatgtgatgcctccagatttgttctttgcttagccttgctttggttatgtggctaaatgactcaaaaaagcctgaaccattttaaaaattgatgttggactcatcaaactcagaaacgtttgttctttaaaagataccactaaagactgggtacggtggctcacgcctgtaatcccaacactttgagaggccaaggtgggcagatcacctgaagtcaggagttcaagaccagcctggccaacacagtgaaaccacgtcttaaaaaagaaaaatacaaacattagccaggcttgatggtgggtgcctgtaatcccagctgctcaggaggctgaagtgggagaatcgcttgaacttgggaggcagaggttgcagtgagcccagatcacgccattgcactccagcctgggtgacagtgcaagactctgtctcaaaaaaaaaamaaaaaaccacaagataccactaagaaaatgaatatgtataattattatttgtcaattaaaaataataatttaaattccaaaaaagaaaaggcaagccacagactgggagaaaatgtcctcccttgctcccattatgtgtgtgtatatgtgtctgtgtctgtctgacaactgcatccagaatatgtaaaggacttataactcaataatacccccaaaattaattctaaaatggtgaaagaattgaacagacctatcacaaaagaagataaatgacaactaaacacatggaaagttgcttaccatcgttaatcatcagagaaatggaaattaaaaccacagcgaggctgggtgcagtggcttacacctgtaatcccagcactttgggaggccaaggcaggtggattacttgaggtcaggagttggagactagcctgggcaacatggtgaaactccatttctactaaaaatacaaaaattagctgggcatggtggcaggtacctatagtcccagctacttgggaggctgaggctggagaattgcttgaacctgggagacagaggttgcagtgagccgaggtcatgccaccgcattccagcctgggcaacagagtgaggctctgtctcaaaaaaaaaaaaaaaaacaaaaaaaaaccaaaaaaaaaaaccacacagtgagataacattacccatcccctacagtcgccataatgaccaagtcttgtgaaggaattagaattctcatacgttgttgataggactgcaaaaacagtacaacaatttcagaaaacaatgtggtagttttttgtttttttgtttttttgtttttttataaaattaaacgtagacttactatgtgacccatccattccactcctaggtatttaaccaggagaaatgaaaacctatgctcacaaaaaagacttgtacaataatgttcatagctattttgttcataatggctccaagctggaaacaaccttatttattatccctcaataggtgaatggctaaataatggtacctccatcatacactactcagcaattttttaaactactgatacatgcagcaatatgagtcagtaattacaacttcatgttgtgcataaaaagccaggcacaaaagaatatatactgcatgattccattttttgtgatgttctagaaaagacaaatttaatctatagtaacagcagatcagtgtttgcctggcaccaggatagggagtgaggattcacytggaaagggcacaggggaactctttggggtcatggaaatgttgtgtcttgattgaagtggtggttagatggtaaatacatttgtaaaattcagccatctgaactgttaagatggatgcattttacgttatctaaattatatctatgtaatgatgatttctggcaacaaggaaacaaaagaaaaaaaaaggatcagcccagggtcattcttttaattctgtatactgaattcttacaaattaaacaaaagcctttccaatagctcctagagaggctaaggaagtctctgtatgggaatgttttccagctacatatgcaatactycaagcagctggactgatgtaaattggggctcccaggagcaagatagtccatttacttgatcacctgaattaatctttggaatttggttctgtttctcatgtcatcctttgaatgatttccctccatttttgtagaatactgtgaccagggaagagaagccaagttcctgaagggccccattatttgttcattctgtaccttggaagtagcttttcatgatactgtatttgcttatgaccagcaaattccactgtgtactggactccagatggctagtccagatgggaaaagctctccagaaagcaccagactttgtgcgcatgttcatgtgtcttcacagtttgggcacctttgggagagtcagtctagcacagtccagaagctctgcctgacattttcaatcctctgtcttttcctgtgatcttaaaatgtcagaaattgaagtgatggtgggaacaataataaagtcaacacttgtacgttatagatgaggaaatggcccagagcaggaaagtgtttattttcccccataagttcacatttcaaagacagctggaatcacaacctgaatatctaaactcctgatacatttattcctctagtgcaggtcactaagtcaaggctacatcctgtcaatcatcattaacaatttagtgcattgtttctcaaaatagggtccttgaatagtctgtagtagagtcatttgaggtttgtatccctggactgtactccagacctactgatctgaatccctgttgagactgaggcctggtattctccattgtgaacagatgtcttagtgattctgatgcacattgaagtttgaataccactgttgaagacagtagtgagctaatttaaagcaaagaagtaaaacaatcagatgtatatttacgaaaatatggaaccaggtctttggagggcctgcgggactgagagagaagcctttgtcccagaagaaaggaaacaatttatattcctgggcatcatttgtctactcttcccccagctttgccctggttttccctggtaacctttgcttaattcagtgctttaaatataactgagatcagaccattcaaggacatgaaagcaaggtccctcaggggaatgacctttctttctccaatatttaaagggttggcaacagctcatttgttgctttgtcartgggagaggtaattcccctaatggatttygagtcctctgtagaaaggttgacctggtctttggggaatgaacctcacagaattcaatcagtgtaattactgatacagggctttttggtttcccagatgtgaccctgtctctctcatacacatcaaattcatcttgtccctttgtctttcatgtggtagaggcagagaatggatagaatgcaccataatagacttgtcagagagatgtgactgtgattctcttctccatcataatgagtcataatacagcccacccacttgctcaagctggaaatcttgaagtctttattcttccttctccggtatctcccatattctgtccattatcaaggttagtcatttcagcctctgaaatatatcttggttgcatatgccctcttcaatgtatataccttttgccactgccctggtccatatcaccattatttcttgagcagtagtctatctgggcttcctactcatgctcttgccctacttcaatgcaattattataggccagaatgatcttttagaattttaaatatggaaaaatttaaaaccattcacagctctcatgttctgtttacttaaaaatatagaattatgtggattaaaatgtgaaagttccctgtatcttttctcttatatgcccattcccctcaacaaggagccattggtagcaatttgaaatgcttttctaagcatttgtaaaatgtgtgtatgtgtgtatgctatatatacactttatgtggttgtatgtatgtttgtgtacataaacatggtatatttaatataaataatatgtgaataatataaatagtataatacatggttctcaagctcatttgccaatatattgatttattaatcatgcccctattgagggattttatttaagataaaatctaaacttcaatctacccctgccttttgcttgttctactttcccctttgtttactgtgttccagccatgacctcctgtcaggttctcccataacccaagctcgcttcctcttcagggcctttacctatgctgttctccctgcctgagctactcccctgggtgcacgacagtagttcccatatgatggactgctgtgtcctgggtccttcaaaacacacacactccctcacacccagtattgcttatgaactgaataagtgttttccatgaatttgtacttttttccccaaaaaatatggatattctgattaaaggaatcatgaattcattgtagttttttcttcattaacaaatacttaaaaatatgttattttctggaggaattctcagattttttaattttataatattttaaaatatattattataatatttgacttaccttcaataattttctctccacagttttctcatcctcccgacataaacgtcaccaaacttacctttatcatttgagtacaccaaactttttcatatacagtgaatcctcatattcacacattctagattctgtactcactgaaatttacttgtaaccccaaaatcaatactcaccatgtatggactgaatgtttgtgtccctccaaaacgtgtatgttgaaatcttatccctgatgtgttggtattaggaggtggggcctttgggaggtgattaggtgggctgtgagggcagagccctcgtgaaggggatttttgcccttacaaaagcagcttgagggcttccgttgtcccctccaccatctgttagaaacagggccctcaccagrcaccaaatctgctggtgccttgatcctggactttccagcctccagcmctgtggactgtaaatttcatgtttataaataacagtctgaggtattttgttttaccagcctgaacagaccaaacagcatgctttggctgttaatctcagacattcacatggacagggcagtgaaaacatctgagtctcctgacgtgcacattcccagctgaggtggcacaaggcagtgttttgtgtacttatttcacctctcatcctgtaaacaagtgtcttctttgtcatatatcgggtaccatgttttttgcatttttgtgctttttgttggtgatttcactgtttaaaaagatccccaagcatagtgctgaagttctgtctagtgtttctaaacacaagaaggctgtaatgtgccttactgagaaaatacatgtattagataagctttgttcaggcagagttgaagtgctgttagccatgagttcagtcttactgaatcaacaaatattaaataaggtgtctttaaacagaaacacatataaaacgaggttatgtattgaccgattgataaaaatgtgaccagaggctaagaggaacctaatctggtatttttcccctagagcaggggtccccagccccctgggccgaggacccttaccagtctggcctgttaggaactgggcctcacagcaggaggtgagcagctggtgagtgagcattactgtctaagctccacctcccatcagatcagcggtgacatcagattctcatagaagagtaaactctattgtgaactgcacatgcaagggacctaggttgcatactccttattagaatctaatgcctgatgatctgaagtggaacagtttcatcccaaaaccgtccctacccctttccatggaaaaattatcttccacaaaaccagccgttggtgccaaaaaggttggggatcgctgccccagaggaatgattcaatattaactaatacagtgtttgtgctgactttacagaccataactaccagaaataacaagagtcacctatactcatcttactctcttttcctgaaagttctccctccagcagtttttcttcacccagcaaaactcttcacatccttcaatacccaatccaagtgccacctgtcctgtaaaacttctgtgactcctcgaggcaagcagagtagtcctctccgtcaagcatccactgttcatgtgggtgctgagaacacctacatgaactgtgctgagaacctctgttcataccattataagagcactgaccatgtactgagttacctatgtactgtacttgtctgccctttccataagtcatgagatcctgaaggacctggcattactggatttcataaatgttgattgaatgattggaatgaggaagggagagtttgtgtaggtgtgagtaagtgctaatggaaaagacattgaaagtgaaggaaaaagaaagtggattgaataatgaatatgatcagggctcttgtaaaggacccctgagttactccggtggtagcaaactggttcggacatatggttacagcctgtattgatcagtgacctaagttaccttaaatgaggaaagagtttattgacccggaaagtctaaggggaaaatctaaatctggcctcagcctcaggttaagactcacatttcgccattctaactggtgtgagatggtatctcatggtggttttgatttgcatttctctgatggccagtgatgatgagcattttttcatgtgtcttttggctgcataaatgtcttcttttgagaaatgtctgttcatattcttcgtcaactttttgatggggttgtttttttcttgtaaatttgtttgagttcattgtagattctggatatcagccctttgtcagatgagtagattgcaaaaattttctcccattctgtaggttgcctgttcactctgatggtagtctcttttgctgtacagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaacatttaagtctttaatccatcttgaattaatttttgtataaggtgtaaggaagggatccagtttcagctttctacatatggctagccagtttccccagcaccatttattaaatagggaatcgtttccccatttcttgtttttgtcaggtttgtcaaatggcgatcattaaaaaatcaggaaacaacaggtgctggagaggatgtggagaaatgggaacacttttacactgttggtgggactgtaaactagttcagccattgtagaagtcagcgtggcgattcctcagggatcttgaactagaaatgccatttgacccagcaatcccattactgggtatatacccaaaggattataaatcatgctactataaagacacatgcacctgtatgtttattgcagcactattcacaatagtaaagacttggaaccaacccaaatgtccaacaacgatagactggattaagaaaatgtggcacatatacaccatggaatactatgcagccataaaaaatgagttcatgtcctttgtagggacatggatgaagctggaaaccatcattctcagcaaactatcgcaaggacaaaaaaccaaacaccgcatgttctcactcatagatgggaattgaacaatgagaacacatggacacaaaaaggggaacatcacacaccagggcctgttgtggggtggagggagcggggaggggatagcattaggagagatacctaatgctaaatgaggagttactgggtgcagcacaccaacatggcacatgtatacatatgtaactaacctgcacgttgtgcacatgtaccctaaaacttaaagtataataaaaataaaaataaaaaaagactcatatttcatcaatatccatcttttaacctgcttgcatgctctcgctctccctcactctcacacgtactctttttctcttgctctctctcggttggctgttcttaggcgacaaatagtggttcctgcaacttcagggaaatattgtgacaaccctttgtccagtgacacagccagtttgagtaacacaaaacaaaggtcctggagttgaatcttaatgactctgagctggcttggaacataacgcttgtcgctaaactgatcacagtggcatgtaggatgaaatggtgcaaattggcttaatctagattaccatgatctactccttgaagcctatagttggagtcagctttatataaaggattctaggtgatcttttgtgtttatggtgtctgtgtaccatcttacctggaatagagattgtgttaaattaacagatcatctgactgagaggtttttttcccccaaaacagaagcaaataaacattattttgttcctttggtataactttcattgaacagttatatagtgctttggaagtatcaagtcctgtgctaaataaatgctggagatacaaaagcccctgacctcagaatgtcatagtcttggggtaagaaaaaattcattctgtgcccgaggagcaaataagttcctttagagtccgagggaaactgtacttatctgccctttctcagatgaatgagtccagaacaaatacagttaactatgctgctctcttctaggggatctgcatttgaggagtggaaataactttggactaggagctgaggcctagattctagttgcattattgccatctgccatcaccaattaactataaacttgaattcataaactctgtggccagtgtttctcaaagtgtagtgagcaattcatctgcagtagcttcacctcaagttctttgtgggtctggacccacagaataagaagatcttgggctgtggtctctgtaagttgtttaatctctatgaacttctttttcctcacctgttaagaggatcctatttaccttgcagcatttgttaaaggattaaatgtgataatgagtagaaagcacatggcaggtagcaagagctcagcaaatacacttttaaaaatttcctcagagagtataaagtctctatggtccagagtagtcgaaggattgctagaggaaggatagcaaaaagcctttcctcgctcaggaagtgtgccttcaaaaatgtgtaactgttacatgactcccactgtactcttgtaatgtttgctgttaactattatgggacacgagactggcatagtagcttcgtgttgaaatatattaggatagacttgtacatcatatgttcagaagtgagatcagattcccctgtgtctttgtgtttgtttgagctagaactcaaccacatcaccacctgagagttgacagttgaaaatatttctaaacctccagartcttctatcttctgccctgactttggtataccaaagataacagaactcttctttgatgactaaggacttctcaaggtctcaaatcatcttttctgataccaaatctcacgtgccttgtggctaaggttgtagaaggggcaagacattacttggaagaggcttttgcgaaactcctggaataggcgtgtccttttaacttcccgctttctgaagagggtaaaaccaaaaactgccagtaaacctagagaatcctatgaagtgaggtttatggttaatctgaatctaactgaggttactgggtgatacctataatttaaacctgttaggcgggtatatgaagaacataacagttgtatcttcaaaaagctctttgccttattttttaaaaattcaccaataacaaagactgactctctctctctcacacacacacacacacacacacacccctacacacctcttagtgaagctcccaggtggagatgtggttattcagaagaacacatccctctgttctaagaatctgagtaatctgattaaatgaggtgttaccatatcatgttttcttagttaaaaaatacataaggggctgggtacagtggctcatctgtaattccagcactttgggatgctgaggtgggagaattacttgagcctatgaatttgacattagcctagccagcatagtgagactccatctctaaaaaaaaaaattaactgggtatgatggcgcatcctgtgatcacagctaaatgggaggctgaggtaggaggatcgcttgagcctaggaggtcggggctacagtgagccatgtttgcgccactgcactcccgtctgggcaacagagggagaccctgtcgcaaaaaaaaaaaaaaaaaaaaaaaaraaagaaaaagaaaaaagtaagtctctcaagataggggagaatagaccttaggtagtctcttgtccatctattgatctactcttttttttttttgagacagagacagagtcttgctctgttgcccaggctggagtgcagtggtgcgatctccgctcaccgtaagctctgcctcccaggttcaagccattcttctgcctcagcctcccgagtagctgggactacaggtgctcgccaccacgcctggctaattttttttttttttttttttttgtcgttttagtagagacggtttcaccgtattagccaggatggtctcaatctcctgacctcgtgatctgcctgcctcggcctctcaaaatgctgggattacagacgtgagccaccacgcccagccttgatctactctttgagcccttcttctgtcacactccccaaccttcccaccctttgtttaggccaggagtcaacaaacaaatcctgccaccacttctttttctaagcagttttattggaacacagccatgcctgtttgcttatgaattgtgtatggttgctgtcatgccactatagaactgagtagttatgacagagaaaatatgacctgtaaaacccaaaatatttgctaacatccttaacaaagtttgctgatccctcaccttgcctctttcttcaaaatctccagtgttgagtattctccagtttccaagagacctgctttggaccactcatttagaaagttcttacgttctaaaaaaaataaaatttggttttccgtagactgctcctgctggtacttgttcaacttgagtatgttgagtaactaaaaataaatcaaatcgctcttccacatattggcggccctttatatcttagaacaacactatgatcatgactccaggcagaatcttgcagaatcctggtgtgataaactttcacgggccttcattgtcaccagaagggagcataacactcttgcacagctaaattgtggcccacctaggttttctgggcgccaagagcaataagaggaagttatagcctcattctacatgcttgaagaccttgagatctaacccaaaggatagagacaggttcatgtgacatgtactgtctgttcaacagctaggagtgatgcaacttccaggtcatatgtacccacactttgtggtcttgatggttgtgaaatggtttgttttctgacagaaggaaaacagtcacttctatttcatcagagatgggagtggcatacccttgatcctagacacaaattcttttttccaactttcttgacagtagaccctatccatatacttctttaagccccactgttaagtaaagtgactttcattgtcttttgtctccrttattactaccctaatttagattgccatcttctctcaccattgcagactatcgcaacagcttcttaattgttttcttgtctcttattttttatttttctggtttgtctcccgcactttgccagatgagagcacagcattggttaacatttctctgctgatctatactcttcaatggctccccgttacaaataaaggaaagatgaaacttcttagggtggcattcaaggcttttcaggacctccaaactcttcctttcctccctcttttccatattgagaagactgtgccatattctctgaacctattttatctgttcccatgcccaggccttggtcattggtcatactgtatgttgtatttaaaaaaaaaaaaaaaaaaaaaaaaaaggtcctgttcttcctttccaaaaccgcatatcaaaccctaccttcctcattgtttgtgttcattgctccttctctctcgtgcatgtttgctttctctcatgctgtttctctctcttaaccctgaaagtttgattccctgcttcagtggtctactagcgtattatgtctttttttatggtgcttacaaaaaaatcttctagttttagggatatatattaatgtcttaacttcctgaaactttgtaaatattgtaagttacttcaaaggagtatttttgggccttgcctctttatctgtcaaagcattcaacacattttgtgtttgtttttactgaattctatacaaggagcttgttgatttctcatgaaatgtaccttagatcccaaagattttcacctttttttctaaacgttttatagttttacattttacgtttaagtccatgattcattctgagttagtttttgtataagatgtgagacttagattaaggtctttactcccctatggatgcttgattgcttcggcaccatttcttgaaaaggccttttcttttcttttttatattaaaatttttagtagagacagggttttgccatgttggccaggccaatctcgaactcctggcctcaagtgatccacctaccttggccccccaaagtgctgggattacaggcacgaaccatgacaactagctgttttcttgattgaattgcttttacacgtttgtgaaaaatcagttgggcatattgtgagggtctgtttctgggttttctgttctaatccattgttcttcacttgatcttagccaaacggccaagaattgatctattccacttttctgtgtctgtctcttcgccagtgctacacagtcttgattgttgtagctatataataagtcttaaaatctggcagactgattcttcccattttatttttcagaattattttagctattgtgcttcctttgccttttcatatacattttagaacaatcttacgtacatctacagacattcttgtgggattttgatgggaattgtgttaaatctgtacgtcagtttggggagatgcaccaagtcgagttgtccaatccatgaatatggtatgtctcttcatttatttaagtctcctttgatttctttcattagctttgtatagcttttagcatacatgccctgcacagcgatttttttagatttataccttttcaatttttaagaacaattataaatggcattgtatttttattttatatgcctgcatattcatcgctagttagaagtaaattgatttctgtatgattatcttgtatcctgtgaccttgctgaactcacttattcgtcctgagagttttgttgggttttgttgtagattttttgtgttttttctttttctttcttcttcttcttcttctttttttttttttttttctttgagatggagtctcactctgttgcccaggctggagtgcagtggcaccatctcagctcactgaaacctctacctcctgggctcaagcaattttcctgcctcaccctccctagtagcttggattacaggtacccaccaccatgcctagctaatttttgtattttagtagagatgggatttcaccatgttggccaggctggtcttgaactcctgacctcaagcaatccacatgcctcggcctcctaaagtactaggattacaggcatgagccactgtgcccagccacgatttttctatatagataatcatgtcctctgcaaacagggaccatttttttttcttcctttccaatcagtataccttttatatatgttttttgctttatcaccttgacaagaacttccagcaatatgttgaataagagtgataacagtggctgggcacgctggctcacacctgtaatcccagcactttgggaggccaaggcaggtggatcacttgaggccaagagttcaagaccagcctggccaacgtggtgaaaccccatctctaataaaaatacaaaaattagccagtgtggcagtgcacacctgtaatcccagctacttgggaggytgaggcacaagaatcacttgaacccaggaagcggagcttgcagtgagccaagattgtgccactgcactccaccctgagcaacagagtaagactctgtctcaaaaaaaaaaaaaaaaatgataagagcaaatgtccttgccttattcctgatcttaggaaagaggattcagtctctcaaatctaagtataggccaggtttgctggttcacacttgtaatcacagcattttgggaggccaaggcaggaagattacttgagcccaggagtttaagaacagcctgggaaaaatagtgagacccccatctctacaaaaatttagaaattagccaggcatagtggcatgcacctgtgatctcagccactcaggaggctgaggtgggagattcacttgagccaggaggttgaggctgcagtgagccatgttcatgcctctgcattccaacctgagtgacagagtgagaccctgcctcagcaaacaaccaaaaaaaactaagtataacatttgatagtggtcttttgttgctgctctttttcaagttgaagaagctcccctctgttcctgtttttctgagagtttttatcaagaatgagtgtttaattttatcaaatattttttgcattgaaagatatgatcatgcagtttttcttcagcctattaatatggtagatgacggatttcaaatatggaatcagccttacctccttggaataaattccatttggtcatgtgtttttatagattgctgaattctatttgtattttatgtgtaagtccataatccattttgagttaatttttgtatgagattttatatagacgttagaacagtcctgaaaaagctttctctttaatagcatattcaggactcatgtcccgtattctccttgcattatgtgtcagtaatccaacagcaatttttcatttttgtatcatgggttacttttcaggtgaagctcccagaccccccttataaatatttattacatggatactgcacttatcagaatgaagggaacaaggtgccaaataactcacaccatagagaatctattacacatctttatcttattcttttttctgtaatcctcttgctgtccttcttttctacttcctactgtgaaagcttacgtataagttttattaatttgaacaaattaacatattcatggaatgaaaaaaaatcaacagatcttccctgagctcctatatgtgttaagcactctgccatgtagtttttggccacattggaccttaatctcaggatgctcagaacttaaaggggagaaagacatataagcrttagaaatgccaaagcagggagtagaaatgkcaaacccggggaaagaaatgccagcgtggggtaagcacaggttagtaagggaaaacaagcagaagcacctccagctctacctgggggagtcaataaaggccttccaggagaagtgacatttgtgctggcactgagagaacatagaaattctccagatggatgaggtaaggtgaaagcctttctaggcagaagccatagcttgtgcaaagacataaagtcatgaaattacatgacttactatttggagaataataggtaatttttagtgctcctgtaaattctgtgagacgaggaattcatgctgtatcctcagcattagaataatacctagagcatagtaagcactgaataaatatttgttggatgtaaggaaacaaaggagggaaagagcgatggaggaaggaaacataattgaggtgagagcggtaagaaagctttggcaataaagaattttgttcatgtcctagttgggaagagacaagtacaaaaacactcatgattgttgtaaaaactgacatgccttgaaaagaacataaaaagcattatgaaggttccgaggaaatagaggtccacttcagatgaatggatcagggaagttgtcactgaggccagacacttagagttgtttgtacttggttctgaattgtttggctttttaaaaacacatggggccccatgccgtggctcacgcctgtaatcccagcactttgggaggctgaggtgggtggatcaattaaggttaggagttcaataccagcctgaccaacatggtgaaaccccgtctctactaaaaatacaaaattagctgggcatagtggcacacgcctgtaatcccatttactgaagagaggcggaggcgggagaatcgcctgaacctgggaggtggaagttgcagtgaacgagatgatgccactgcacaccagcctgggtactctaaaaatatatataaataaataaaacstggaagtggagagaaggtgttgtggtggaagagggatgtgtgaatttgggactagactagacagccttgctgactctgtcataaatatatcagtattttgtaggcagccatttatcakcctacaccacttacttggaagcaaaacctgacaggctctgatattatctgtagcaaacatggttttcttgttcatgagggtgtctgtgttttttgtgcttgcacctgcataccagagatttggggacagctctttccacagagacaagactaacggggacacatcaactgaaatgccagctgaactagaaacagatctttttaaaatgcaccttggtgcccacacactatgtgtctatgtgtgaacctgcagcacacagaagtacatgcataattctgaaagcagtgaccgggttaagattttaaattactataaataaatagtacttatttttatttttctcagctccatcctatctggctatacctcaattttcatttcagtctaaggcttattgggcaccagttatgtctcctttgacctgctagataatagaaggatttcatgcaagaaaatgattcattaattatatatatattgattactagctatgtgccaggcaatattctaaacaccaaggatgcatcatggaataaaaagaaccaatccttgtcctggaggagtttactttctgggaggtgggtgcggaaaagtcataaaaattgatatcttttgggggtatacatgctttgtgagaccagtaaagcagggtaaggggggaaagagagtgggagcatcggggaccaggaatagcctgtccagtaatgtgacatttgaataaggactagaaaaaaagattaagcaatggaaatatctgggggaggagtgttccagggccaggaaacaactagactaaagaccgtgaggcaggagcacgcctggcactgtgtaaggccacgtggccagagcagaataggcaaggcagagggcagcaggagctgaggtgaggggtgggatgaggctcagtcccatcaggcctgtaggccattgtggggactttggctttactctgagtgagatgaacagccattgcagatggtgagcggagaagtggcatcttctgatttacttcctgctttcttactttgcggttgaggatagactgcaggatgaaagggtggaagcaggaagactacaaaatggtggactagaccaggtgagcaacagtggaggtgaggagaagcaagctcattgttgatatattctgaactgtctgaactgacaggatttgcttttgggttagatgtagagtatgaaaggagtcagctatgatacatagatttttggtctgacaactggaaggctgaaggtgctggtaaatgagatgggagagagtgcaggaagaacagatctgggagatatcaggacctcagttttgaacacattaatgttgagatacctactagtgaggagttggatatacaactctagggctagagatataaatttgggaatcacagcaattcgatggttttttaaagctgtgaaactgaataaaatgacctagagagtgggtgtagaaaaaaaaaaaagaatctcagaactgagcattggggcattctaatgttcggatgtcagggaggtgaagaggagccagcactggagactgaaaaagagaggcccggtagatagaaggagagttgagagtgcatgctgaagccaggtgaagaaagtgtttcaaagaggatggaataataaactgttgtcagatgttggagagagatcaagagagatcaagttaaggcccatgagttgatttatcagcactgaagtctttgacacctttgatgagctatttcagtggtgcagttggggtggtggggggatgggggatagcctgattatagtgccttcgaataggaggggaggaaacaaagattagtagtatataatactctttgaagtatcactataaagagaagtagaaaaactgggccatagttggtgaagaattgtgggatcaagtcaaacttttaattttttcttctgagataggaaacgttgatgtcttgatgggaatcatcctagtcaggaggaaaaatgcaacgattctgaagaaggggagaattgttgaagtgatgtctttgtgcacaaatggaaaaaggttggccttcattgggtggactgtctatgctccctagtaacagagctcacagctacaggtgcaggcaggatggtaaatgtagtcatggaacatgtgtaaattttcttttgattgtttgtgttttctcatgaaataagatataaaagagtggaggcattggaggtttaaagagagaggccaagagattgttgccaaagaacaggagaaagtcattgactaggtaaatatagtaggattgttgggcaacatgaggggccacttgaagtaaaagtgagaccagtcagcatggtcatatgattttctccatgtatgtacagccaagtgggaacaggtagagttggcagagcattagacttagctggggtttgctgggtaaataagaggaatggagaaagaagcaagggaataattatgataatggatcgcagaaatagagttggataaggaaagaaaagaggacagggatgaaaggtgagagtgaaaagatggtagaattaatggagtgtagatcccatggggtctaaagaattgtgataatcaaatccttgacatttgtagtgcttcagggtgtatacaaagtgctttgggctcacataataaccctatggggtaggtagggaaaatggtggtggtggtagtgattttcatatagatgaggcaggattcaaagaggtaaatgacttaatcaaaaatcacacagtgccgggcgtacacagtggctcacacttgtaatcccagcactttgggaggctgaggcaggtggatcacctgaggtcaggagtttgagactagcctggccaacatggtgaagccctgtctctactaaaaatacaaaaattagccgggtgtggtggtgggcatctgtaatcccagctactccgtaggctgaggcaggataaatccgcttgaacccaggaggcagaggttgcaatgagccaagatcatgccactgcactccagcctgggtgacagagcgaaactccgtctcaaaaaaaaaaaaaaattcacacagccagtcaatggtaaagcatagactgaacgcagatttctgttatatgtagtctttgtgcaatgtctgcttacagattactcagtcttgttgaagagatggaatatggaagacaacttgagagaatatgtaatcacgtgttcaattctgtggtatggaatggtataaggagtttactcattcagtaatacatattgaaagcttagtaaggtacaaggcattatcataaggactaaggaaacatcaatgaacaagacaggaaatataatcctgaggttacatgtttttagagcagtttctctgtgattcttctaaggcatcatgttttggttaaaagcaggttgtactaaaaagttagaaaacttgtttttctgctacttacygtgtgtaacattgttacttcaactcaccctgccttagtgggggtccccatggataaactgattatggctttgcaagttctcccttgcctaaaaatgctgtgagtttggatctgtattctagcctaaagaaatagttgctctaaagtgtcatcatctaacttcctgatctagacagtgggaatgccacatcttactttatagtgataagaccctgtttacatagtgagatgctgcacaaacatgcattccaaagtaatcctccatttttgaaacttgggaaatctgaaaaggggacaggtcatgtggcacctgcaggtcccacagtccccgtctttaacctatgatatctgaggacctattaaaagctttaaggtcgtctgggcatggtggctcatgcctgtaatcccagcacttttgggaggccgaggcaggtggatcacctgaggttgggagttcgagacccgcctgaccaatgtggagaaaccctgtctctactaaaaacacaaaattagccaggcgtggtggcacatgcctgtaatcctagctactcaggaggctgaggcaggagaatcgcttgaaccctggaggcggaggttgcagtgagccaagatcatgccattgcactccagcctgggtaacaagagtgaaactccatctcaaaaaaaaaaaaatgcattaaggtcaggcacagtggctcatacttataatcccagtgctttaggaggctgagttgggaggatctcttgagaccagcctaggcaacatagcaagaccttgtctctacaaaaaaatgttttaattagctgggcgtggtgatgtgcgtctgtagtcccagccacccaggaggctgaggtgggaggatcgcttgagcccaggagttcaagattgcagtgagctttgattgtgccactgcactccagcctgggcaacagggcaagacctgtctctgaaagaaaaaagctttgaaataactaatgacttcttccccctcttcttactccttcctgatatgatttaggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttracaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacaggtatgagaacgcacacagatctttctcatagggggttgaggtgaggcccttggattcctggagcattgagagcaggctctagctaaggtttcctgttggaagagcgttcatagataaagggtaaagagtgtgaaggggttggccaaatattagagggacacctggccctaattatgctctaactggaaaccaaaaaaaagtgttggggttgtgataaagctaaaggtatttgtggtgtttccttaggtgcctcaacaccactgccgttcctcatccctcctgttttctctcttccctgtgctgtccagcactctgtgtcccattatctgtcacccatcccatagggaaggtctcaccttggtcccttctctccttcatctctgtctgtcctagcccatttcaggccatcctgcacagtcacactkgacccttgtttgtgcgggttctttgtgatgattattgacgattcagtgttcatttatgtttacttgggaggggacagataaaaggaggaaacagtgatttatgtttgggtttttataatcttcacaaaagagtagctcacctttttgaaatgagtgttaaattgtagaaatgctccttaacatttgtttaggctcatctcaaactctctgggatggttgaagagcagagttttttctggggcagtagaattgacccaggaattctactcgcaggcatattcccaaaacatgtttacacaaacacttgtacaagaatgttcacagcagtattattcataatagccaaaaagtggaaacaacccaaatatccatcaataaatcaaatatggtrtatacatatatattactaagccataaaatggtatgaagtactgaaaacatgttaagtgaaagaagacagagaggaccatctttttatgattccgtttgtatgaaggctcagagcaggcaaatccacagagacagaaagtacattggtggtgactgagagtgacagtgtgagaagcgactgcttatgagtatggggtttcttcttggagtggtaaaaatgttctggaattagatagtgatgatatttgtacactttcatgagtatactaaaaaccactgtattttacactttaaaatgctgaaatttatggcgtgtaaattatgtctcattctttaaaaaaaagttcctcaggtgattctgaggaccagccaggttagggagcccctagatgtaagaccaggttcgtggacatgtgaactgtggagtcacaaagagccccatccttagaaggtcttgcacttcgtttaacactccactattactatcttgaagttcttaatagtttttttaacaggaagttctgcgttttcattttacactgggctctgcaaattatgtagccagtcattcytgaactagatatcctaacctaggaattctgtgatttttatcttccttggggaaggataatgagcccctatttattaagttctttggtataatcttcttgcttcctgagtggaatttcctgttttccccaaatctttgtcatttataggtttcatggaggttgtttttgtttttttcctttattttattcctgatggagagcaatgcatattcagtaaaaaaaagtggtagagggaaaggggccccagctggggcagcatagcgagactagagtgcagtgacacaatcatggttcactgtaacatttttatttcgataaaaaataaaaattagctgggcatggtagcatgcctgtaatcccagctactagggaagcttaggtaggaggattggttgatgccaggaattcaaggttgcagtgagctgtgatcacaccactgcactccagcctggatgacagaacgagaccctgtgtcctaaaaaaaaaacaaaaatgttgggggtggggaataagaaacgaattaaaaggccagggagctgggcacagtgtttcacgcctgtaatcccagcactttgggaggctgaggcaggcagatcacctgaggccyggagttcragaccatcctgaccaataatggtgaaaacccgtctctactaaaaatacaaaaattaggctgtggtgacgtgcacctgtattcccagctactcaggaggcagaagtgagagaattgcttgaactcaggaggcagaggttgcagagacaagatcgcaccactgcactccagcctgggtgacagagggagaccctgtctcmaaaaacaaacaaaaaacaaaaaaaaaagcagactgggcacggtgactcacgcctgtaagcccaacactttgggaggtcgaggcaggtggatcacctaagatcaggagttcaagaccagcctggccaacatggcgaaaccccatctctactacaaatacaaaaattaaccaggcatggtggtgggcgcctgtaatcccagctacttgggaggctgaggcagaagaatcgctcgaacctgggaggcagaggttgcagtgagccaagaccatgccattgcactctagcctgggcaacatcagtgaaactctgtctcaaaaaaaaaaaaaaaaaagcaggggaagaaaaacttcacaaacacaccagtctcaaagctttcataaatgttgttagcagtggcaaatctatctgggtctgcagcaacctcaattcttgcctcctcagaagaaagaattcggccaaagggcataaggcagagtgagacactgagccatgttttagaagaggggtgaaagtttattaaaaagtgttagagcaggaacaaaaggaagtaaagaacacttggaagagggccaagcgggcaacttgagagatttcagtgcactgtttgacctttgatctggagttttatrtattggcatgcttccagggggttgtgtcccttctctcctgattcttcccttggagagggctatctgcatgtgcagtggcctgccagcacttaggaggggctgcatgcacagtgtgtttactaaagctgtacacatgcccacttgaggcrttcttttaccagccaagtgttcctagaggaaggccaaataccagttaaactcgaccattttgcctcatagtgtgcgtgcttgagacttgcctatctcctgagatggtatcagaaagctgctgatcaccagtttcaggtgttttctatcgattgggagaccgtctttccccagcaccagctgcaaccagttgttattttagagagtttaaccgcctgactctcacctgatggttgcctgacattcctggtgagatgggggcaggagaggctcctgccctgctcatgtctgcctagctacctactctaacaatgtgagaaatgggtccaagaagtacctcagctttttaagaaataggtrtgatgaggggaaaatgtaaccaaaaaccaaatggcttttaattgaattattttcttgtgggattagaggtgttctcatcaagaaaatatattcttgagatgtggcaaaaattactcagtggagatatctttcttaatcacatatttaggctgggcatgatggctcctgcctgtaatcccagcactttgggaggccgaggtgggcagatcacaaggttaggagatcgacaccatcctggctgacacggtgaaaccccatctctactaaaaatacagaaaaatagccgggcgtggtggcgggcaactgtagtcctagctactcgggaggctgaggcaggagaatggcgtgaacctgggaggcggagcttgtagtgagccgagattgtgccactgcactgcagcctgggcgacagaacgagacttcgtctcaaaaataaataaataaataaataaaataaataaaaatcacatatttaaaagatattgtctgaatccttttactgtataggacttcagtacaatgaaaatgtggaaactacattatctgagcttgctttctttggtagcaaggttcatttgttcattcacacattattcattcagcaaaccttatggggcattcattttatgcaagttcctgtcataaccaatgaggctacaaagatgaacagtagagtctgagtactcagacatcatagcctagaggaggggacaggcatgcaaccagatagtaacagagtcatgctataacgggaatcaccaagattagcgacacatacaccaccagcttaggcctccctaaggaggagagtattagagggtgacaaataattgagtgttttgtcartggccttattaaataatatatttcctagcctgtaatccaagctatttgggaggctaagacaggaagatcgcttgagcccaggagttcaagactgcagtgagctgtattttttaagaggcagggtcttgtgagccctgtcacccaggctgggatatagtggcataatcacagctcactgcagcctcgaactcctgggctcaagcagcgttcccacctcagcctcccgagtagctgggactacaggcatgcaccacggctcctggctaggaaatatattcttttcttcttctttttttttttttttttgagacagtcttgctctgtcgtccaggctggaatgcagtggcacaatcttggcttactgcaacttccacctcacaggttcaagcaattctcctgccccagcctcctgagtagctgggattatagacaggcaacaccatgtctggctaatttttgtatttttaatagagacagggtttcaccctgttgtccaggctggtgtcaagctcctaacctcaagtgatccactcaccttggcctcccaaagtgctgggattacaggcatgagctattacgcctggccggaaatatattcattcatatatatagatatagatatatagatatatatctgtgtgtgttttagtgtatatatacacacacagaaatatgtatatacacatatgcatctatatattttcttaagcctttttaaaggaattattttattagatgtctagtgttctaattatcagagcaagaatatcatctgtgatagaggtttaaggttatttgtgagatccttctgttgaaaacaattggcttttcttctatctcagaggagaatctggtatgttaaaagattcagtcacatgatgggttatgttttaatttagtggctctcttaaaactggattatatctgtaaaaccttcaggtaaaaaattaaaacttaataattcattcagtgttttttttttaactgagaattgggatctgaggagaaacagaaagttaacatttgactactttcttttgcttagtagcctatttcatttaatcactttatcacctttatttccatttttcawatgatgaaattgagtattttttcttccctgcctagcacttttataactccccggggctaaaaatcttctccgtctacccactccccatccttggctgggttcagaagggctacccaactcttatcagccccagaaactcttccttaatgcaacactgctttccttttactggagcctgttgagaacaatccagtcacctgagtcttcatgtcagcacctgctttaggtgaagagtacctaacccttggtggccacaaaaagacataatcgcagctatgtattgagcatctgttctgtgaaagttgagactttacataaattcccactaaaaagtcacagtaatcctttgaaacaacaacgatttgacccaaggtcacacagctagaacacgggacagttgggattctagtctaacccaggcctgactttgcattataatgtgctgtgtttttgtccctgttctcctggaatataagcatctgccagaaacaggcctggatatttttgcccctttggacactwtgcattgtactggaagcacccccaggggtccctatggcaggctgaggttctctctgcttactaacccatattgccaaagtccttggtctagaatattcctaatttagtaatttcaagggctttaatccagtcatcaggctctattggttagtctgtacactggggacaaggatgtcttagttcaaatcaccactctgattacatgagcaggtcacttaataaagtctcaacttccttttataaaatagggataaaatactttctgttctcaccccatgcttctgcttctccatggatgcatccagacagacatagaacccactggcagcacctcaagttgcacatttcccaaaggactattcacattgttttctgtgtaggggtatcccmtggagttgatcaatccagtgtccctgtccctggtttgctcctatagaggcttcatcatatgtggagcctctttcaagcagatactccctcttttcctttctttccttccttccatctgttcatctgtcctcctttgtgtctgtctttctctctcatttgtctctctgtctgtctgtgcccaggctggagtgcagtggcacaatcatggcctcccagtttcaagtgatcctcccacctcagcctccaagtaactgggactacaggtgtgcaccactacacccagctaaattttttaaattttgtagagacagggtctcactatattgcccagtgtattagtccattttcatactgctgataaaaacatacctgagactgggcaatttacaaaaacaaaacaaaaaaaaaaacaggtttaatagacctacagttccacatgactgaggaggcctcataatcatggcagaaagcaaggaggagcaagtcatgtcttatatcagtggcagcaggccgagagagagctcttacaggggaactcctctttttaaaaccgtcaggtatcatgagaacaacctgggaaagacctgccccatgattcacttacctcccagcaggtccttccaacaacatgtgggaatccaagatgagatttgggtggggacacagccaaaccatgtcattctgcccctgccccctttcaaatctcatgtcatcacattttaaaaccaatcatgccttccaaacagtcccccaaagtcttaactcattacagcatcaactcaaaagtccacagtccaaagtctcatccaaggcaaggccttccgcctatgagcctgtaaaatcaaaagcaagttagttatttcctagatacaatggggatacaagcattgggtaaatacagccattctaaatgggagaaattggccaaaacaaaggggctacaggccccatgcaagtccaaaatccagtggggcagtcaaatcttaaagctccaaaatgatctcctttgactccctgtttcacattcaggtcacactgatgcaagaggtaggctcccatggccttgggcactccacctctatagctttgcagggtatagcctctcttctggctgatttcatgggctagcattgaatgtctgcaccttttccasgcacacagtgcaagctgtcagtggatctaccattctggggtctggaggatggtggcccttctctcacagctccactaggcggtgccccagaagggactctgtgtgggggctctgaccccacatttcccttctgcactgccctagcagaggttttccatgagggccccacacctgcaacaaacttctgcctgggcatccatacttccatacatcctctgcaatctaggcggaggtttgtaaacctcaattcctgacttctgtgcacctgcaagctcaacacatggaagctgccaaggcttggggcttccaccctctgaagcaacagcccaagctgtaccttggccccttttagtcacggatggagtgactgggacacagggcaccaagtccccaggctgcatacagcagagggaccctgggccyggcccacaaaaccattttttcctcctaggcctctgggcttgtaatgggaagcgctgctgtgaagacctctgacatggcctggagacattttccccattgtcttggggattaacattcgtctcctccttacttatgcaaatttctgcagccagcttgaatttctcctcagaaaatgggattttcttttctattgcattgtcaggtgcagattttccaaacttttttgttctgcttcccttataaaactgaatgcctttaacagcacccaagtcacctcttaaatgctttgcttcttagaaatttcttcccccagatgccctgaatcatctctctcaagttcaaagttccacaaatctctagggcaggggtaaaatgcttccagcctctttgctaaaatataacaagagtcacctttgctccagtttccaacaagttcctcatctccatctgagaccacctcagcctggactttattgtccatgtcgctattatcacttttgtcaaagccattcacaagtctctaggaagttccaaactttcccacattttcctgtcttcttctgagccccgcaaactgttccaacccctgcctgttacccagttcctgtcacttccatattttcagttatcttttcagcagcaccccactctactgctaccaattttctgtattagtccattttcacactgctgataaagacatacccaagactgggcaatttacaaaaaataaaagagagagagacataatggagttacagttccatgtggctggggaggcctcacaatgatggcagaaggaaaggaggagcaaatcatgtcttacgtggatggcagcaggccaagagagagagcttgtgcaggggaactcctctttttaaaaccatcagatctcaagagacttattcactatcacaagaaaagcacaggaaagacctgcctccatgattcaattacctcccactggatccctcccacaacacgtgggaattcaagatgagatttgggtggggacacagccaaaccatatcacccaggcttgtcttaaactcctrggctcaagtgatccacccgccttggcctcccaaagtgctgggattacaagtatgaaccactgtgcctgactaccttttttttaaagagttgtgataggactcatataaaaacttacatgtttactttcagctagaagaggtttgtggcagatggagactgtctgttttttcatccttcttgccacctccagattcttatttctactgccaccttccagtcttcacatattccaaccaaaaatgtctaggataaaacctgcaggytcaagaccagaccaggagtgaaagtgagtttgaaatcaacataaggttgaaggaaacaatctcttgakagagaactcgttccaaaaggaaaccaggaatgatgttctagaaggaaaagcagtttcaggaacacatatcaagatgctatatcatatatgtgggatttatttttgcttattttgtgtgtacaaatgaaagaacctcacctgcctcttggaatcaaaatagctgtcagtcctcagaataaggaagcagagagctgctctgagctgtgtttataggcaggcggatccaagtcctcacatttgtggctcagttgtgggcagctatccctgaccagatgtactacacacaaaaagagccatctctcagtagagagctttgatgaattattcatgtgctcaggagtcaacccctgttaggaaagccatcascccttttgaattctcaaagctgaggacttctcttttccttttatcccatccctcctccatttattcagtagctattctagggcctgcacagccactatcacagggactccgaaaggcagctagctgcacttgagtctcaacattgctactcatttgccttattgatgttgaataaatcactttccctcttggaggttttatcatctgtaaaatggagatgatgctcctcacagcgttgttgggaggttgcacaggtaaagcttggagaatgtacaggtacacattgtgaacagcagctgctcacttcactttttccttgtagtggtcgtagcaatagtagtgatgatttytatgtctgtaggacaagatgaacagaatataawttaaatatttggtgtttttacagaactttatagtctatacaacacttacgcagtctcatttaagcatgaggaaacaaagtgagataggtaggggctgataatatcattcctatcgcaaaagcaaggaaactaaggcttaaaggcactaagtgatgatgccagaaagcagagtggaagggcccagaatccaaggcttttgactaccgtctatggctgtgtcctctgactcctcacttttcccaacccattgtcacagagctgtttaccatggctgcttctaagtcacaaaacggacagcaagaaggaagaggaggagcaagaggtttataaatcactgagaactgactattcttttttttttttttttaagacggagtctcgctctgttgcccaggctggagtgcagtggcgcgatctcagctcactgcaacctccaccctccacctcccgggttcaggcgattctcctgcctcggcctcctgagtagctgggattacaggcgcacactaccatgcccggctaatttttgtatttttagtagaaacggggtttcaccatgttggccaggatgatatkgatctcctgatctcgtgatccacccgccttggccttccaaagtgctcagtgctatctgtacatcgatattaacctctgatggctaaactagcaagataacatgatccttcttagaggaacctacaagctactgtgagttacagctcaggcaatttagctcaccagagccccattttgtaactcttggagattttgaaataaggccaaagcctccactgtatcttctctactattttagttttttaccttctcgaactccttggcaggaatttcacagtagtcacatgtctaatcttatggaataaagaattcccaaagttctgaccaactcttctttatatcttccccaccttttctctactaaaattttagtgagactgtcccctttaaatattttgtaaatacttaaacttctagtaatccttaagtttcccgagtaagtcaacactcaaattattttaagtcctgggtcccacctggggtcaaacgatacccataggaatgcttttggggaagtcttcagcatccagtgaggaatgttagtggggtcttcaaatagctctttctagagagaatgactggtgccttraaagtcaggacctcttattcaagctggatttcttacagcagggagaactgtggtagagccaagtagtccattcagattcattctgatgaccttggtccttcccccaccatgaaaagagagacagagagccagggagaagccttgctcagagaccttactctttctgtcttctcatccctgggagggccttttcctccctcattccctccctgaccttttgggttttgttttattaactgaaatcagaccaactcctctggggaacccttgttggaagccaaaagcaaatgtgggcggtaatatgcatcttctccccaggctgagactcctctctcaaggaagaaagaacagagtggagactgacccaggctccagcccagaggcggaggctgctgtctgaatcacccaccctttttttccactgagacaatgaggaaaataaatatccagaccagtttccagccagatctgaaattctaattcctttaaaaaaaaaagaaagaaaaaaaggttattttaaataaccctgaaatatcaggccttcctcctccatctcttgcttgtcatttttcatttacagctggttctagtcatccacagaacaggccrtgagttcagacatgagctccataaaatcctcgcaaatgtttctgtgttgtcctagaacaaactccaaccttgaccaacttcagggaattccaaatcctctgaaggaggaaaaggagacagggagaaacctgaccctattctctycgttctaagtcttcatccttatttctgccytttttttttttttttttaaataccagacactccccctcaccaccccagccagccagcatagatagtctagtgttacctgccaaaacccaaagactgttagacttgggagcatctcgtcccaactccacagcgccagaagctttgaatggctcccaaacatctcataagatcccccctacttttttggttgagtgcttctgcttatccctattaaaagaggataataaatgattgttgaattggtccctgactggattccaaagcccagtctaactctaatattgggctagaggtagaattagaactttgtatttagtggtaaggtcaccttggacctctgaagatcttgattacgattaaacatccggttatgtgtagcgctacrtaggattcagaactctacaaaatcagtagatacagtcttctctctctaggatctgtgctgggaaacagagttctggttttaaatttcagctttgttacgatttatctcagtttcytcaacagtaaactaggagtgatttccaaaccttttttaaagcattgctttttaaccaaatctcacatgaaacagaataatttatgaaacaattgagagggagccactttgagtatagcagaggagagggtcaagtgatacaagctgcactcaactgcccacccttccttctccccactggttgcttgggaaggctggcacacaatgtgaggatactggtccgcagcagatgtttcaaaacagggacctgcagggctgcgctacagaaatttttatcagtccataaaaatatgaaaacatgaggaagatacaatccatgttcataaaactaaatgtaatcagattttaagacttccctttattcagagactcttttttttttttttttttttttttgagacggagtctcgctctatcacccaggctggagtgcagtggtgcgatgttggctcactgcaaactctgcctcccaggttcatgccattcttctgcctcagcctcccgagtagctgggactacaggtgcctgccactgcacccggctaattttttgtatttttagtagcgacggggtttcaccatgttagccaggatggtctcgatctcctgacctcgtcatctacccgcctcgacctcccaaagtgctgggattacaggtgtgagccaccgcacctggcctattcagagattctctttgtgcatgtatgttagtgttctcgtgtgtgtgaagtgacagtcttagtaaatggtagttttccatatttgacattattaaaaattggccgccccatgtgtccatttctaaaagtgcacaagtgtataaacaaagaggcagtgttttcacctgtccatgaaatggaagagtctgggaaatagtgatctagaggtgatacgtgtgtcaggactaactggttgccagcttctgcttctgtactcatggccaggggcctctgaactctaccattaagtccaggccccctgcatcccagcataaagccagtgctgtaggatcttttgttcctagccctgctcttgtgtgctagctatggttagccctgggatcttggctaattttccagtgtctcagtctttgccctgataacctgcctgtagtgtcagatcccacccaggagtggaccctgtcctgcttttatgtagccacttctcatagaccagagtcttaccacacctcagaccagtggctggagcccgcctgcccactggaaggcttctgggttgcatgtggtctctctgcctgcattactgaaaaaaatctgcttctcttttcccagaacatgcttcttcctcctcttggattctactgcccacatttctagtgatgcctcagtttctgtttctgtgttcacgtattcagtgcccttaccactcagaacctgcttttgccagtggacaggggttagagaagagcataagacatggacctgctttcagtggactcctgagccttgttatgttctccagtttttgttctctctgccaaaccagccttggaactcctcttagtgattctctctgcctcctctatgtctgcttctaagaggttctgggcttctcagttttcagcaagatttacctgcttttaactgaaccgtgcctggctccgtgccaagatataactaccagataaaaaattgggggttaacctcaagtgtgaaaatatttaattttttaattctgaatttggtttcaacatcaagcccccatctggccagtgatagaaatgtaagttttaatcaactccgggtattcctggtcaatatgggattttctcagtaaattcaagtttgtcttcttttgtscctgggctgctattttaagtgccccaaggcctagagagctggagacagtttattgaggctggaaggctggagcacagtttgggattgggattgggggaggagatgcatgggagacaagggtaaggacgcrtcttattcctctttagatcmccgtattagtagccacagagtagctgcccagtaaatatccacatgatttttttttttttttttttttttttttgagatggagtctcgctctgtcacccaggctggagtgcagtggtgtaatcttggctcactgcagcctccaccactcaggttcaagtgatcctctcacctcagcctctcaagtagctgggattacaagcatgcgccaccacacccggcaaatttttgtatttttagtagagatggggtttcaccatgttggtcaacctggtctcaaactcctgacctcaggttatccacctgcctcagcctcccaaaatgctgagattataggcatgagccaccatgcctggctgaatgttttagttacagtgtttggttataaattgtaaatagttacacaaaattctttttaaaaattctgacttatttccagatattttcattttgagaaattcactgttggggagaacagaaagctttaaaaacattctcatcttactcataggtgacaaagtgtgagatacctgaaattctgtatattgaaacatataacatgtactttaacatggtataaagtacaatgaaaaacaaaaaaatgaagaaaagctcaaaagagatgatatactaactaggctgaagagatagagcctgccaaagacctgaagtttattttacacatctaccatttgtttattgtttgcttttatttgctacctcctcggcccttttatggatgaggtcagtgaacaaaattcttcatggctagtgaatcattattagcaagaacactcagccaagacagaagggaatagatttcatagaatgagaaacttctagaatacgagatctcaaagcrtccttagagagcatttagttccaaactgctcaaatgacagagtgtctagaggtgaagagagggcaactaatttgttcaagatcatgcagctgactggccaggctagaattaaaatcgaagtttcctgacttttgtgttttaaatgatgttgatggttatggtggtgatcatataaaaatcactttatgatttatagagtgcttttatatatatatatatatgtggtatagaaggcccgtttattacatagggtcttagaatcrcatgaatatgaacccacaacattaatgactttagtctaaacgtggtcttggataagtaaatttaattttttgagcttcaacttctgcatcagtaaaatagaaataagacattcttcacaagattattatgaagattaagaatccacttaaagcatatagcatagtgtttggtacacaataagtacatattaaatgtctgttgaatctgtgactaataacttgttgctgccttctctgtgatcttcacaacagccctttggagacgtctaccatgctacttttatctcccgaaaactaaaatatcctaaataacccctatctctgttttgcccaaactcaaaaacctttttgctatgtgtgattaatatgtttatcaaataataaatcttgctgaatttcctgatttgaggggcattacacttgtcgttgtggtactcaaaaacaaagatgtcttggccgggtgctgtggctcacgcctgtaatcccaacactttgggaggccaagggagataaaccacctgagggtcaggagttcaagaccagcctggccaacatggcgaaaccccgacactactaaaaaaaaaaatacaaaaattagctgggcatggtggcacgtgcctgtagtcccagctactcaggaggctgcggcaggaaaatcacttgaatctgggaggcggaggctgcagcgagctgagatcgtgccactgcactccagcctgggcaaaaagagtgagactgtgtctcaaaaaaaaaaagaaaaagaaatttttaaaaaattcctttcacaatggcatcaaaaaataaaatacttaggaatcaatttaacaaaagccatcctagatctctgtacataaaacaacaaaacattactgggataaattaaagaagacccagaatatggaaagagagatcgtgttatggagaagactcagtattgttaatatgtcagttctccccatattaatcagtagattcagtccaatctctgtcatgatcccagcaggcttgtttgtattgacatcaaagcaaattaggaagtactatataatatatgaaaacagtactatttaacacaacagcatgtcaataataattcagacctttttcagttacaatgttggactttytagagaattttgtggagatatgttagattggtaaataaaagctgttctcattttccttacagtagaaaaatatacccagaagttatgtttattgctcccccaatgagatgttttacttaaaaaaaaaaaaaaaaattgacaggagactgacatccttgcccaggtgactaggcactcagtcactggtaagaaaatcacttgatctctctgaactgtaggctttctgtcagtaaagtattaatattaaactaaatgatcccgkgggttatttccagacctgtgcttctgtgatatggaaaaagaataaatggttaagaatcagaaagaacaagctggtgatttaagcttgttagtacaagtttaccatattagactgttgattttttttttttttttttcccccagacagagtctcactctgtcgcccaagttggagtgcagtggcgcgatctcggctcactgcaacctctgcctcctgggttcaagcaattctcctgcctcagcctccctactagctggaactacaggcacccaccaccatgcccagctaattttttgtatttttagtagagatggggtttcaccgtgttagccaggattgtctttatctcctgacctcgtcatctgcccgccttggcctcccaaaatgctgggattacaggtgtgagtgactgcgcccggccagactcttgaatctttaaattctgtatgctgaccaacaactagcacattgtttgtgcctaaggtgtgctctaataaaaaggaatatggtttcttataataatactaatgggctcttcaaactagcttatcttgtcatttcttctcttggttatttcaaagcataaatttgggattcgatggtttcagttttagcttaaatctgtmtccttggtgatsaacttaaattagatgctaatattttgaaggaggacatgtttatgcaaaccagagtgagaacttttagtctaagggtcagcaaactttctctgtaaagggccagatagtaaatactttaggctttgtcatctgtactttgtagcaactactcagctttgctgttgtagtatatatgcagccataaacaattatgtaaataarttgatacagctgtgttctagtgaaaccacagaaacagacsagatgtaatgtatgggctgtagtttgctgacccctgttctggtgtaataatatgctttggcaggcctgctcaaataatgtactcagtatgcaggcccactcagtacagatagtattttggccttcccagtggtgttaaaaagacaactctcccttttggactgcaattttaaaaacctagagatggcaaggcaacaagacacaagtctgggagatgagtagggaaactacagatgtgaaaccaggagattattgggacccccgggactggaggcaggggctgagaaagagctgccagctacaagctgggtcctgcgaggctctgtagctgaagtcctctactcagcacatgaagggcagctgaccccatttttgtaccctctgcgacagatcctgcctctggtcaaaccctgaaggtctgggaacacagagttcaagatcttttccctcaccaggttacctcccacagtgcagtgctgagggccagctaccatttgtggagcacccatgtgcagggactatgtcatttcttattccccagaacaattcttcaggtagctgttttataaattttacaaattagaactcttggattcaggtaccatccctaggtttcacaactagtaagctgagattcggactccaacgtgcatgttcctttcccagtagcacactgcttctcctgaagccgaagttccccttcagagaattatgtagatctcataattccctaggcaaaactggagctctttgaatccyagcctagccatccacactataccagtttaaggtgcaatcttgtgattattgccgctgatcacgattcttgataagcatccacaactgataagtctgacgcttctgttttacaccaattgccagttgtctcagagtcactgtgaaaggagggaaaagcttatctcttataaagttggttagcttcaaaatacagtgatgtattttggatatttctgtggaaaggttacaagggtcaaatgcatcattaatgtgaacttaatatacccacttgatggattgattcctgtgggaaaactaatgggttcccaaagttcctcgggggagggctgaagtgctcctccgagtataaatttgttctttctgactgcatgtaagctcataaagcataggccaccctttggggctggcctgcagctcagtagtgcctctcgtacctgctccagaccctaagtaaatcacaagagtgcttcatttcaaatatgaatgaatccttgatgggaccaactaaccaacccaagccccacacgaaggaacaggagaagggtctgcygcagctaaggggtacgataggtataaacaaagcttgtaacctgacctcttgcaaatcaacagcacagtgcatggctaaagatagacttgctatccccaaacagaaatacacacaacccagaaaacctcactaagtgataacaatttcttgtaccctaaataactgtttacmtttggatctcatttggtcattcttctaacccagggaggaaagattccaacagaacttgctgctctagtgtgtttattgaagatcgccttgttctggttctggttctggtttttgttttggttttgttgagacagggtctcactctgtcgcccaggccggagtgcagtggtgtggtcacagcttactgcaacctcgacctcctgggctcaagtgatcctcccacctcagctccccagccccccagtctgggactgcaggcatctgccacaatgcccagctaatttatatgtatgcgtgagatatatatatatctcagacatacatatacacacacacatatatatatacatacatacatatatagagacagacagacagcgtcttccagtgttgcccaggctggtcttgaacacctgagctcaagtgatcctcctgcctttgcctcccaaagggctgggacctccttgttctaattggaatgttttctaggcatagaacattgtgctaaacacgrttagagaaaaagatatggtctggatcctggattctaacagcttatagtttcacttcacatgacagatttatgaattcccaattagaataaatggcaaaattatgtactacaaaagatttagaaggcatagactgggcgcggtgactcatgcctgtaatcccagcactttgggaggccaaggcgggcagatcacctgaggtcagaagtttgagaccagcctggccaacatggtgaaaccctgacactactaaaartacaaaaattagctaggtgtggcagtgggtgcctgtaatcccagctactcgggaggctgaggcaggagaatcacttgaacccagaaggcggaggtttcagtgagccaagatcgcaccattgcactccagcctgggagacaagagcaagactccattcaaaaaaaaaaaaaagatttagaaggcatgattaattctaactagggagacaaggcatttccatctctraaatgagatgcctcgagccaaagaaggttgtaaaaggacgtgtgaccaggaactgtgctgtgtcactaagctacagtcactcgctctctttcctctttgcctttcacagaatcaatttctgctaatgtatactgtgagatcgtatgcatcaaggtcaggatgttctgacttggctctccctagcggagatggtgttctttctcagagtcttcccttggaagggggatggggaatcataggtccagaaagatctcatgggatctcatgttactgcctgtctgtcttttcttttttcttcctscgctttatagttcttataaacattaggaaacttatatttctgaactcgagaatctatttatactagtgtttagtactttgatccacaaatgtttacttaccatgcaaataatgagtgatactataaactcaaaacaaataacagatctggtccagttagtgtcctgaccagatctcatagcttgattgctcctgcccccaggcccacattacagagagtacatcttcattcatagcgatacatcttttagtgcagggtaagggctcttggagtaagttctgaattcttattccagggttcatttctgaccttctgtgtggccttggacaagtcttatttctctgggccacagtttctcaaactgtagatgagagatttgagaggtaggaggagggtggtggtgataaattagagactggactctggggacccttccaattgctatattatgtgagttactgtgtaaagttgagccattttatgtttggccttgaatttatgaatttcctctggcataaattatgatatatgccaaaggcctttgagacttaatccttcttaaataatttcaggcttatgatgaaaagtgacctggagctttggmtccagtcttgccctcagcacctgtcagcatgcttttgtttttaggattcttcatatgttccytgtttttcagtgagctttctacagggaccacacactccttagaatcctatcaaatactgttgtcaaaattctttcgtcatcctctctgcactagaacttttagaattttaccaccattccacttctagtaataaaaaatgggacaagtgtcaggccaacagccatttattgagtatttaataattactgtttacctatatttcatatcaaatcctcaaaagaaccctgttgagtaggtgttctctttggcatttgacagtgtgggaaatgagggataaagatattaaaagttttgctcaaggccctgtaataagatagttccagaccaaataccacatgttctcacttataagtgggagctaaatgatgagaacacatggacacaaatcagggaacaacaggcacaggggcctaccagagggtagagggtaggaggagggagaggagcaaaaaaaataactwttgggtactagatttagtacctgggtgatgaaataatctgtacatcaaacccccatgacacaagtttacctacataacaaacrtgcacgtgtacccctgaacctaaaagtttaaaaagaaaaaatgccaatgaaaacattataaacttatgaaaatcmaaaagggtaccctatatatggaattataactgattcatatattgtatgtgctatttaaagtttatatattcaggccaggcatggtggtgcatgcctatagttccagcactttgggaggccaaagtgggagaatcacctgagcccaggaggtcgaggctgcaatgagccataattgtgccactgcactacaacctggacaacagtgcgcgatcttgtctcmaaaaaaaaacagaaaattaaaaaatttwaaaaaaattataattcaactctaagaagcttcttaagaaaacttttaaatacatgtttctcattgaggggaaaaaaattaaataaaatagtttcagaacctgtgtctgggaagtccacatcagggttatttttgttatacctkgttccttkggagccatagattatgtgaagggccagagagaacgtggatgcttatcaatttgcaatttkgatgatccaaaggaaggttttkggaaatatttgctctttcatttgtcactcaaagcctgcttkgccttttcttcagtagaccctaacccttctgtctctgccccagaattaagaaccagaggttgttaaaaccaaaccagtggatcctaatctgaatctctgtaaatatgactaatgaggtctgaggtgggaccagccytctgcatttacatttcccagagataactttgatgtgtaccccygatctaatccaacctcttctttttgtaaatagagacagtgaggcttgggaagatgaaatggtatgcccagattcactcagccagtaggcggtagagctaggcctggacccccatcctcatattttaactttccttccctagtaccattcacctcatagggctcttgtgggagttcttcctctgcacaggtgaaaagaattggstttggagactgtgagatctgattcagatctaggctatgccactttctggctgtgtgaccccagagtttgctattgatgtctctgagcctatttttcttcatccaaaaaaaaaaaatggaggtaataatatgtacctcacagggtagactagaggcacataataggtgcttagtaaatggcagctgtgcttaccacagycactgttgtccttttggttctcattaattccccgtataccatctgtacggcatataattgtgaccaaaacagtgacagttaccttccaagcatccgtcatgtctkggaaagcagctcgtacctctttggccaatctcraggtctcaascagctccatgtgtactccaggaataggagcaataagagtggctaaatgcatgatataaaatgatctctattcctcacagcagtcctacaaagtacttagccctattgaacaagtgagaattaaaaaggcttattaacatatccaaggctacagagctaggagttagcagagtcagactttgaatccagctccaatacagcttttggtctaccactttatgggttctgagacccactgaggcttgagggtggggataaatttttgggggagaagggataaagatgaaaagggcactgagataagggaactagtcattatttggccagtcatcttttccagaaactcccgccaaccacccctttcctgctcatgttatcactagccagtcgatggctgggttggcctgggctgggctcctcggctgaaatccttcagagctttcctgttctagagttttgcaagaaggtgggaggagtgtttgtatgctgggcaggcttcccaggggtgattgtggaaaggaaggggagtgattctgtagggccctaaaaagaagccaggaagaagaaaaaaaaaaactgtttaaaagaaaatagattgactcaggcatttgtgggcattatctttagtctagacttggagatagaagctcaggccaggagtctagaaacctccattttcttcttgtgttttgggtcattaggaaggtcagttacacagcaagaagtaccaaaaacaccccagccacacattgtttaatatcttcctttattttcaccattcttttcttctcccaaggggtacccaggcaataaaaacaaatcctattaatgccttatgcatgtgcatggatttgcttccaaacccttatctcattcacctcctaaaacaacccagtgagacagacaggtaggctagagattatcctccaatacttgatagttatgaattaaagctcagcgaccacacatgatctcacagcaagtttatggcagagctggaactggattcctggtctcttgacttctgtcccgtgcatgaggttcactcactgggagtaaaatttcaacccacttagatctattctcactcccccatgcctgccaccaggtaaccactaatctttttcacatccctgcagatttgcctcttctagatatttcacataaatgaaatcatttctagaatcactccccttcctttccacaatcacccctgggaagcctgtccagcatacaaacactcctcccaccttcttaacaaaactctagatctgtggtcttttatgattggcttctttcacttagcgtaatattttgaaggttcatcaagataacctatatcagtattttttatttctatggctaaataatattccattgtgtggatatatcacattttgtttatccattcgtcaggacattttggttgtttccattttttggctctcatgaataatgctgatatggacattcatctataagtttttggtgtttgtgttttaattcaatcctttcagcaaccctctatgataaactgcagggcaagttatcctagatattaatagtccctttttacagatgaagcaactgaggctaagtgatttgctccaggtcaaatagcaagcagatctgcctttaggcagatctagggacagagccaagtctctccactattagcctaatacatttttttctgttacatgtagcacaccatgtcgcttttgttctatgaaatgtttggaagtatatttgaaaactttaattatagggagtgaccctgaggggtgatgaagccatgaatcacagcagtgccaggtctactaatcagccctgtccagaatggmcatgtagaatgtactccacttaccaatggcaagccatctgaagggagcagctttcagtgagcaaaacaaaacagcaccaaacccaagttggctgaagctcttgcctccaactgatgtggaaagtgaggtagcacctccccggaacctcatctattggggcacaggcagctcatcagaattgggggttggaaccacggaggaagaagtagcaggggtactcggccatcagggtccaaaatgagaaaaatcttattccagaaaagttgtctctgaatttagctttgtaattatttttcctgagataagcaagaaaaccttgtttgatgttttaggttttatggtatatattggtttcctaggacctccatgacaaattaccacaaagtgagtagattaaaacaacaaaaatttactctctcacagttctagaggctagatatccaaaattaaggcattggtggtattggttccttctgggtgctctaaggagagtctgtttctacctttccgttagttcctggtggctgccagcagtccttggcattccgtggctagtagatacatcatttcgatctctaccttgacccatacatcacatggtattctgcctttgtgtttctctgtctctgtgtctcttttataaggataccagttcattggatgagggcccaccctaatccagtatgacytcctcttaactatgtacagagacgctattttcaagtaaggtcacattctgaaataccaggtagayatgagttttggaaggacactagtaaacctagtatagacactaagaaataatcacataaattcaggcagagatctttttaaagttgcaagcagaagtgggattttggcaagttttagtgccaaaacagctttgaaagaatttttctggagctacatactttttttttycttttttcttttttctttttttagagacaaggtgtcactctgtcatcttggctgattgcagtggcgcgatcatagcccactgcagcctcaatctcttgggttggagcagtcttcccacctcagcctcctaagtagctaggcctacaggcacacaccaccacgcccagttaattttttaatttttgatagagacgactctcactaggtttcccaggctggtctcaaactcctgacctcaagcaaccctcctgtcttggcctcccaaagcgttgggattacaagcatgagctattgcacccagctaagctatagatcattagatggagctggctagtttcattgacatgactttgtgctggtagagtagaaatccaagtttctgttggatgaaggcccaattcatcctaatccctacttcatcttcttaacagaccttaaaacctctctgattttgaccacaagaaacacacatatttggatttttgcgccagggaaaattcttttattttttcagtatgatcagtcaacaaatgtgtattgaatacrtaccatggctggggctgttctaggcactaggggtacataagtgatagaaggtgttccatgtacctatgacattcaagattttctagaccttatgtgtatttcattcttttcatccttatagctgccctatgttgatttgtaaataaggagactgagactctgagaggtgaagtgacttccccaagtatgcagctaaatagactgagtcacagatatgactccacaggctgagctcaargmaggggctgcagaggtgaggatgggtcactcctcttttattcatactcacagccaaagcattcaacatagggggcatgaaggatgcatttgatgacaaggcagaataagtaggttgtgtcaatggcgtttattgtaatactgaggaaactcgactttattctgaaggcaataaggagtcagtgaatgttactgaggaataatgatttcttatggtgtgtactttttttgatcaacgcgtatttattgaattttgtcacacactgggcttaatgatgaggataaaaccatttcaaaatctctgccatcactgtgtttacagcctgatgtacaaagtgatgagagaaagattggtattttcctggaattttatttgaaacacaggraagcacaggtaagaaacaasgttgaagaaagaaacaggaaaatgtctttaaaaaaagaggctgggtgcagggctttatacctgtaatcctagccctttggaaggctgaggcaggaggattgattaaggccagaagttcaagactagcctgggcaacatagtgagatcctgtctctacaaaaaaaatttaaaaattggcctggcgtggtggtgcatgcctgtattcctggctattccggaggctaaggcaggaagattgcttgagcccgggagttcgaggttatagtgagctatgattgcaccatggcactccagcctgagcaacagagcaagaccatgtctctaaaaaagagagctttgactgggcrtggtggctcacgcctgtaatcccagcactttgagaggctgaggcagtggtgatcgagaccatcctggccaacatggtgaaaccccatctctactaaaaatacaaaaattagctgggcgtcatggcatacacctgtagttgcagctactcaggaggctgaggccggagtatcacttgaacccaggaagcagaggttgtggtgagccgagatcgtaccactgcatttaagcctggatgacagagcgagactctgtctcmcaaaaaaaaaaaaaaaaaaaaaaggaaagatatttgtaagtcatctgaggtataacagaagagttttaagagggacggtgacataatgacgtgacatggttgctgagaaacagaagagtcatagataatgcctggacttctggcttggagaacttattggctggtgatgatggacctcactgagacagggaacacgagtgatgaagaggtcaatttagattgttgagtttggcccactagtgggacgtctgaagggaggtgctcagcaggtgaagggatatatagcagggagtcccggagagagaactgagctagagatgaagatttgagagttgtcagcacataggtggtaactgaagctgtggaagtggacaggattacccgctggagagtcttcagcgggagagagaggctataggagggtctagagtggagccctgaggaatgcctccactgaaggggcaggcaaaggaagaggagtccaacgagacaacagagaatacagaatctcaccagaggcttgctttttgcaggttccctgtgtcttcttaggcagtagcttgtattctttccatggccctgtggctactctgtcccataatgtaaaccctctctcctccactattagagagttcatcttgcaaatctaatggagtaatgagctatcgattctgttaacaaatgtccagtttactgaaagacttgtaatgggagttaattttgggggtcaatacagctgtcaatggaamagtttttccccagaggcccatcagctttttctgttgtacactggcaggtgtcctgcccagcagcagaaatgcctggagagtaattaatactgtagagcattaatgagctggtgatcctgcctaggaccatgagaagggtacagcctgagataggtcagatgacagggcgtagaaggtgaactgtgtcccctytgacatgagttgaataaccttagaaaatcaacaccaccacaacgttaacccaccagctatcatactgcctaagattacatctttaaacttttatttctttcgaacaagaagtttcactagtggaatttttgagtgctgaatgaatgtgttgtgtttgcttagtccgcagacatgaactaagaatctgctatgtaccttgcctttattaggtaaatgctgggcctataatggtaacaacatcacagtcactgttctcagaaagccatgggttagacaaggaagcatagtgaccatggatataatgggagcatgggccaagtgctgytggcacacagaagaagaagcaagtccaggaagatttgggagagaatatgatatctgtgtagggtctaaaagtctgcatatgagcttgccagtagagtagaggtgaaatccaagtggaaggaacagcagaagccaaaacaaagaatcataaaagaggctggtgtgttcaaggactgatgatgcttccatatgccttgtttatgggtggagaaaagcaggaagtaggtcagactgtcaaaagccttgtatgttatgctaaggaatttggactagcttagagagccagccaaatgaataatgaccttggcttggggtgtagtactataagctattatccgtccttaatacctcacttwctaacacaacagagaaaagcttgagataagagggaaaatgaccaatagacagggagtggtaggcagtggggaatgtaactgtccttggaggtcttaggaggccaggcaggagcagctggagtccagtattaagggacagctccaaatgcatttgtgcttttctcattaatgcagtaaggcacagtccagagcctcaattaatgagtcttcagtaagcaaagcctcatttaacaaagccagccttagcttttttttttcctgtaattagatgtttaaatttcattttttttttaaatttcaacttgtttttcagatgccagggtacatgtgcaagtgygttacatgggtatattgtctaatgctgaggtttggccttctgttcatcctatcacccaaatagcattgtaccccataggtagttgttcaatccttgtccccctctctccctccctgttaacataatccccagtgtctactgtttccgtctttatgtccatgtgcaccctgtgtttagctccaacttataagtgagaacattagrgtatttggttttctgtttctgcattaattcacttgggataatgatgttcagctgcattcatgttgctgcaaaagacatgatttcatcctttgaccacagcaggcgccaccaaagagtgggaaggtggtcgtactcattactctagaggcagaccttgcctgagggtcagggtcacactcctagaccacaggtagccgtacttcctggaagtggggcagatatggcctacattgtgataggaagtcacctccaggctaccccagaagccatacaaaggtaaagaggacctcttcttcaaccaagatggccaggagggcagcaaggggcaggtatatgagagggagagaatgctagtgctggattattttctctgctcttactcttttttcttcctctgacaactcactttgggataaggatacatttccttccttttycattcacagagctatttctccttttcagactccctgagaaatgtttcctcagccggtcatggcccccgctcttctccagcygagctcagcagctctagccagcaccttctccgagagcgcaagtcctcagccccatcacactccagccagccaactctgttcacgtttgaaccccctgtgtcaaaccacatgcagcccaccttgtccacyagcgcacctcaggagtatctctacttgcaccagtgcataagccgaagagcagaaaatgcaaggtaggaggctgccacagccattaggtgggttagtgaccgctcacagggcctagyacttttcagtccttgcttttttaaagacaagcaaaacattatatcgtttcaggtagacaaacacgtctatgacaaaacataattttttgcttctgtagccttcatattttattggcatcatctgtgttgctacacagtgataactgggtgccagagaaacttttcattatcaaaaatcatgctataaaaaatgtttgatttggaggcaggggtgaaggcattaggggacacagtttccgaattgcaaaaaaaaacagtcartttacttgggcttaaaagtatagctataaaaccataacatagttcaacaaatccataccttgcttttgctctagaactgcactgttctgtatagtagctactacctgcatatgtctacataaatttaaattaattaaaatgaaataaaatgtaaaattcagttccttagttgtactagccacatttcaagtcctcagtagacacatatgtctaggggctactgtaccagacagcacagatacagaaaatttccatcataacgaagttctagagcaaggactccctgttctaggataatggtcttttgtttttctaacatcatcagctctttcacaggtgcagaacctgtaaatgtatttattatgttttattcccattgttaggctaagcaaaagtgcagagctgataggctttgccagagctaattcccagttgctaccatagccagcagattacaaatcacattttaattaacttacaagatctaattcatgttatgacaattaaggcaaatagaaaaatggctgtactaatgtattacttgattttgtccttgagaatattttcatacataatctcatttgaaccaatcaatacactgagaaatagccagtatacaaaatttatctccattttaaagatgaaggaactgagaatcatgactaataaatagcagaggttgggctagaacccaggtcttcttgtttctggtcctgtactcttttcactatgctaccctacttttgtttttctgagtcatctgctgtcacacagaagaggctccaacacttaatcttaaggctgcctcagatacccattttcatgaagaacatgattcatttgtttgtgaactttcactagttcaacttccatcaacttatacatgaagagctgagtcctaaaaagatagagtgagttagccaaggtcactgaactagttagtggcgttaactgtaaatagtacctgattctcccgaatcactaaccagagataggcagtgtggtataatgaaaagcatgttcaggctttggagtcagtcggatatgggttcaaattcaggttcttttactttctttgtgatcttgggccaattatttaacctaattaaccttcaatattcttatcttcagaatgggaataactaattcaaaggcttactaatgagtgtaaaatgataaaacatacataaaatagtagtagagagtaaatacattttacctgttcttcytatgccccatcctcttctactacatagacaactgcctgggagcagataaggtgaggtcttaaaatcatagttgtagtgaaaggcaaagtacttagctgtagtgccttgcagactttaacatgcatatgaaatacctgaagatcttactgaaatgctcactctgactcagtaagcctggcctaggtcctggggtcctttctaataaactccagatgataccagcrcagattgtctacagctcacactaagtagaaggctttatatagtagtaacaattgccgccaccaccactccagtgatcctgctgacgcatcagagaacaaacgtagaaacatctctgcttgaattagcctttagggcccactctctgcacccctacctcctctgtgaaatccctattaatcttcctacctggaattcactttttctctgaattgccacagcagttttttattctctctctctctcwcacaacatttggaactttctgccttgtagaatggatttttatattaatacattactattatttgawgatggagctcacagtaggtgcataataatttgaacaaatccatgttgtagagggataagctagtagaagagatagaactttacgcagctgaggaagtcacattgttgtaggcctttgaccaagtcatgttcttctctgtcatggttttcacttgtgtggatgagggaatgagagggtaatgagcaggatctcagggagacttttggagaaaataagttcaaataatgtttgcagaattccaaaggaagttgggagggtaggaaggaagctttcttaaatccagaaagacgatatattttcttgtagtagtggagttgctcgcatcatgctaaacctactgtaataattataaactctggacaaaatattaaaaaataacttttttaaggccctgaagagcaataaaaaaggcagaaactgcaagagatctgactcttgaaagaagtgaaattcagtttacatggcttttcctatgatgttccaataatatatcgtcgagaatattcagtatacaatgagaaaatgccagacatatgaagaaaccgtatacattaacccatagttgagagaactcagtatctagaaagagatcaaaataaacccatattttggacccagcctacaagactttaaaataattatgttaattttttaatctattgtgggtaaaggatataataggtgaagagatggtggattttaggatggatgtagaaaccgaaaaagaattgggtagttccagttccactatggtggtggaagccaccacaggctttccttcccactgattacaactaaaaactctggacaaaatccaaagtgcaatacccaaagactctgaaaaataaataaaaggagatagattgtaaagaggagaagaacttgtagaagtgactacacagagatgaactttttgtctttcatgcatttgcctccaggttgggccccatcacaaagtagcacagtgcaaatggctaaaatgtcataaaaaaccccatctttctgagtaggggaaccagaagaggagccccattggggctggaaggagctagtatattccagaatgaagagagctggagaagggatcttctaactctgggaatgaaactatgtgagtcttaggatcaccttgggctacacatgtgtgggacaaaccgaatcgagtgcaacaaagcctatgtgaactgaaagaagatttgaactaccatacacaggaggagagacagaacttgcagtctgagcctaaccaggttgatttcctataaaaatatcacttctcggccgggtgcggtggctcacgcctataattctagcactttgggaggctgaggtgggcagatcacctgaggtcaggagttgaagatcagactggccaacatggtgaaaccccatctctactaaaaatacaaaaattagctgggcttggtagtgggcccctgtaatcccagctactcaggtggctgaggcaggagaatcgcttgaagccaggaggtggaggttgcagtgggccgagatcacgccactgcactccagcctgggcaactgagtgagaccctgtctcaaaacaaacaaacaaaaaaatagcacttctccatgggattataacagaacccagcatctacacaacatcatgttcacagcattcaggatctgtaatccaaaatgtctcagcatattgaaaaccagaaaaatataacccattctcaatggaagtcacaggtacaaacctcaaaataacccagatgttggaattatcagacacagatttcaaagctcctgtgaaaacaacattccatgtaataaaggaaaacacactygaaactaatggaaagaaaaaaccctctgccaccggacactgtggctcacacctgtaatcccagcactttgggagcccgaggcaggtgagtcatctgaggtcaggagttcgagaccagcctggccaacatggtgaaaccccgtctctactaaaaatacaaaaaaattagccaggcatggtggtgggcgcctgtaatcccagctacttgggaggctgaggcaggagaatcgcttgaaccctggaggcggaggttgcgccattgcactccagcctgggcgagaagagcaaaactccgtctcaaaaaaaaaaaagaaaaaaagaaaataaaaaaaccctctgccaaccaaggagtttatattcggcaaaagtatcctttgggaatgtaaacaaaattaagacgttctcagataaaggaaaaataagagcatttccaagagatctgcttttaaaaactgataagaaatttcctcaggctgaagcaagatggtactagaaggaaacttgaattttcaggaatgaaggaagagcaacagaaatagtaaatccctgcataactgtgaaagattatttttccgttttaacttctttaaaatatgtataagtgttagaagcaaaactcaaacaatgtctagtgaggttttcacctggttttcttactctttagtatgaagagctccctttgccatttcttgccatgtgagtggcctggtgagaaattttcccagctttcatttatctggaaatttcttaatttcaccttcagttttgagagagattttgctaggtatagaattccagaatgacagttctgttttctttcagcatttaaaggataccattctagtcttctgaccttcattgtttctgatgagagatcagcagttattttaatttttattattctatatgtattttccttcctctgaatgattttttcttttcaaaaattgtagtaaatacatagcataaatatatcatcttaaccatttttaagtgcacagttcagtaaagtacattcatattgttatataatcaatctccagaaatcttttcatcttaccaaactgaaattctaaccattcaacaactccccatttccccttccctcaggccctgaaaaccaccattctactttctgtctgtgtgagtctgacttctctagatgcctcatatacatggactcatactacattttctttatccatttatctgttgatgaccacttaggttgattccattatcttggctatcgtgactaatgatgcaataaacataggggtgcaaatagctctttaacatactgatttcctttccttcagatatatacccagtaatgggattgctggatcataaggtagttctattgttagttttttgaggaactttcatactgttttccataacgactgtactaatttacattcccaccaacagtgtgtaagagttcccttttctccacatcctcactggcatctgttatttttcttctggaaaatagccatcccaactggggtgagataatatctcattgtggttttgatttgcatttccctgctgattagtgagacggcaagcttttttttttttttttttttttttactatgaatgttggctgtttttctgtcttcgtttgaaagataactattttcagctaatttgcctcaactccattatttgtttttttttgctgttgagttgtttgagttccttgtatatgctggatatcaaccttccatcagatgaatagcttgcagaatggctttctcccattcagtaggttgtctctttactctgttgattgtttccctttgctgtgcagaagatttttagtttaatatagtcccatttgtcttttttttttctttcttttgagacagaatctccctctgtcgtacaggctggagtgcaatggtgcgatcttggctcactgcaacttctgcctcccagggtcaaatgactctcctggcttagccttttgagcagctggaaccacagtcatgtaccaccatgcctggccaatttttctatttttaatagagacaggattttaccacattagccaggctggtcttgaactcctgacctcaaggaatctgcccatcttgaatctgcccatcttggcctcctaaagtgctgggattacagatgtgagccascacacccagccatttgtctattttttgtttttgatggtgcttctgaggtcttagctgggcccttttttgtttttgcttttgatgggagacttttttttgcaaattccatctcattactcataattagtctgttcagattttctatttcttttgggttcaatcttggtaagttgtgtttgtccaggaatttatccatttctgttaggatttctaatttgttggtgtatagttcataatcatcttttttcttttttctttttctgagacagagtcttgctctgtcctccaggctggagtgcagtggcgcgatctcagctcactacaacctccgcctcccgggttcaagtgattctcctgcctcagcctcccaagtagctgggactacaggcacgtgccactgtgcccagctaattttttttttgtatttttagtagagacagggtttcaccatgtgagccaggatggtctcgatcccctgacctcgtgatctgcccgcctcggcctcccaaagtgctgggattacaggcatgagccactgcacctggtccataatcatctttaatgatcctttttgcatttctatgctgtcagttacaatgtctcctttttcttttttattttattcctttatctattttgagacggagtctcgmtgtgtcacccaggctggtgtgcagctgcgcgattttggctcactgcaacctccacctcctgggttcaagtgattctcatgcctcagcctcccgggtagctgggactacaggcgcccaccaccactcctggctaatttttctatttttagtagagacaaagttttgccatgttggccaggttggtctctaactcctgacctcaagcagtccacttgcctctgcctcccaaagtgctgagattacaggcatgagccaccatgcccagcctttttttttctttttttttttctagacagagtctcactctgtcgcccatactggagagtacggtggtgtgatctcagcttactgcaacctccgcctcccaggttccagcgattttcatgccttagccacccgagtagctgggattacaggcgtgtgccaccatgcccactaatatttgtatttttagtagagacggagtttcaccatgttggccaggctggtctcgaactyctgatctcaagtgatctgtccgcctcagcctcccaaagtgctgggattacaggcatgagccaccacacccagactgattttgtatttatttggatcttttcccgttttttcttggtcagtcttgctactggtttgattttgtttattctttgaaaaaattaacttcattttgttgatcagttttattttgtctcaattttatttctgctctgatcttttttttccccttttactaatttkgggtttggttcttgtttttctgcttccttgagatgcatcattaggatgtttatttgaaaattttctacttttttggtattagcatttattgccataaacttctctattaatactgcttttgctgtattccataggctttggtatgttgtgtttctattttcatttgtttccagacatttctaaatttcattctttttcttttttttttkttttgagacggagtctcgctctgtcgcccaggctggagtgcagtggcatgatctcggctcactgcaagctctgcctcccaggttcacaccattctcctgcctcaacctcctgtgtagctgggactacaggtgcccgccaccacacccagctaattttttgtatttttagtagagatggggtttcaccgtgttagccaggttggtctcgatctcctgacctcgtgatccgcccaccttggcctctcaaagtgctgggattacaggcatgagccaccacacccggctctaaatttcattcttaattttttcattgacccattaaatcattcaagagcatgttgtttaattttccatgtatttgtacaattttgaaattkcctcgttactgatttctagttttattccattgtggttagaaaagatgcttgatgtgatatcaattcttttaaaatctcttggcctaacatgaggtctgtcctatagaatgtcacatgtgctaatgagaagaattatactctgcagctgttggatgaartgttgttaggtccatttgatctaaagcgcagtttaamtctaattgtttccctgttgattttctgtctaggtgatctgtccatgctgagagtgaggtgttgaagtctccaactatgattatattagagtctrtctctccctgtagatcttaatggtgttccataagtcttgcaggttttcttcactcttttcatttgtattccccctttccttctggctgggtaatttcaaactacctttcttcragttcagatattctttcttctaattgatcaagtttgctgttgaagctctctgttgtgttttttatttcattcattgaattcttcagctgcaagatttctgggtttttttttttctttctcttttttgaatttttttgttcatattgtgaattctttttcctaatttctttgaattgtgtgtgttttcttgtacctcattgagttttcttaaggtcattattttgaattccctttctgtaatttgttgatctccttttcactgggctctagttactagccagagttcctttggtgcttttttggtgttatatttccttccttttttgtgtttcttgtgtcctcatgttaagtgtccatgcttctggtggaaagatcacctcttccagactttctggagtggatttcttagagaaagactttcacctgcagttgggttttagtgttccagttgagaaggatgtgatgactgtgtttccacttaggtgcaatggtatagtctccatgcagcttctttgcctatgttcaacatcaacaataactgggagtgcctcagtggcctagactatagaagtttgtgcagcagcggtggtagcataggttgttaatatccttagcgtaaagggctttttgggtctttctcttctcattttccccaaatgaggagactcagtcagggggatccctcttagtgtcaggtctggcatggcctacaagtagctgcagcagtgctgggttctaggtactggtgcttggagcttatgtggcgttgggtttctaagctcagagtctcatgaacctattgtggcagctgggtcttggggtgcaggttcactctccgtagcatggttggatgtggactgccctccgggccaggatctatgatatgactctgttgaaccctctatcagctcaggtcaggggccagctgtgattctacccctggtaggcagagcacagcactggcctcaccctgggcaagaagggatgttctggaggtttggtttcagggaggaggatacaactagaatttgggaacctgagtcaataaggctcaatggcaacttgggtcccagggattgatacaccatgtagcagtgactctacatggtccctctttaggcttagcaaatacccgggaatggcagagtatagctgtgttttgggctacagaggggcagggaacagcagagcaatgactctactccccagggagaggcgtatctcaacagctcagactctagggggctagtgcagctccaggaaagcaaggcactagagttgtttggcctgtagggcagggtgtctcagctcagacactgctctttttccctgaaacacagggtcctgtatcagctcagccttggaatgcaccccctctcagctcagctagggcacccattccccaggggacagtgtgctacttcagctcaggcccaggagggtgtgactgttctgagtagcccaggcatcctttccctggaatgcagggaaccatattattttagctactggggtacctcattctggggagtcagtgcaccgtttcctaggatgcagccactggcttcagcttwggcactgtggaggcatgactgttctgagcagccaagatactgttttccttgaagagagcatactgcttcagctctggcccaagggagtggggagaggggcaggtggattagctttacttctgcttgacccccctgggaagggtgtaacagctgctcacagctcagctttggaatgttgggccactgggctagcaatggctcagccacagcttagcctcaggaatgaaagggagccatggctactcacctctggagcaagacacactccagccatagttccaattccaagatggcatagcacagtagccacacggaacacagctatgtggaccctaggcaacttccttcactgggcttagtgcctatgaggacttcaggggactccagtggtgaggcctgagatgtccaaggtgttgatggcagttgccatgatcctcttgcctaccttctcaccaaaagaacttcgtccttgttccaaactgatcttgcatggagtggtgaaggcctagtgtgtttccttctgttctctgtgtgaccatcccaagtttctggttcatcgagtttctgttactcctctcatgcattctgggactctccctccgttatttttgctaaaatgtaattgttcaggaggccaggtgtggtggctcacgcctgtaatcccagtaatttgggaggccgaggcaggtggatcacgaggtcaggagttcaagaccagcctgaccaacatggtaaaaccctgtctctactaaaaatacaaaaattagcagggtgtggtgacatgcgcctgtaatcccagctactcgggaggctgaggcaggagaatcgcttgaacccaggaggtggaggttgcagtgaacttagatcacgccattgtactccagcctgggcaacagagcaagactctatctcaaaaaaatacataaaattaaattaaattaaaatttaaaatgtagttgtttattcattgttctgcctgtctttgtgagggggacaagcagtaggggtttcttcttggccmwtttgctagcattacttccttttttttttttcttaatagaaatgggtgcaatgtggtatctcattgtgcttttgatttgtatttccctaatgattagtggtgttgagcaacttttcatgcgtgcgttggccatttgtatatcttctttggagaaatatctatttcaagtcttttgtccatttttcagtcaggttgtttgatttttgttgttgttgttgagctgttggagtttacctatattaaacccttagcagatacatgacttgcaaatgtttctcccatagattggttttttactctgctgatatgttctttgaaacacagatattttaattctgatgttcaatttctgcatttttacttttgttgcctgtgcttttggtgtcatattcaggaaatcactgtcaaatccaatgttatgaagcttttcttctatgttttcttctaagaggtttatagttgtagctcttacatttaggtctttgatccattttgagttagtttttttatctgtkttaaggtaaaggtccaagaactttgttcttgtgggttgacttagttttccagttctatgtgkkgctttttttttkttaatctagtttagcaaactttctaccaatatttcttcgacttttttttttttttaagagacagggtctcagtctggcacctaggctggagtacatagctcactgcagcctcaaactcctgggctcaagatcctcctgccctcagcctcccaagtagctgagactacaggcatatgccaccatacttgattaattttttgtagagatatggtctcgctatgttgtctcgagcaatcctcccacattagcttmccaaagtgctggaatgagccaccacacctggcctcttcaaatctttttctgccacattttctttttttttttttttttttgtttcttccctcaacttttattttaagttgcagggtgcatgtgaaggatgtgcaggtttgttacataggtaaacatgtgccatggtagtttactgcacagatcaacccatcacctagatattaagcccaacatgcattagctattcttctcgatgttctccctccctctgcccacctaacaggtcacaatgtgtattatacacccacccccaggtgtccatgtgttctcattgttcagctcccacttataagtgagaacatgtagtgcttggttttctgttcctgcattagtttgctgaggataacagcttccagctccatccatgtccctgcaaaggacatgatctctttcctttttatggctgcatagtattccatggtatataggtaccacattttcttgatccagtctatcactgatgggcattccttctgagacttcagttacttatacactagaccacttgatactgacccaacaatcacttacattatcttttttttccaatccttttctctctgctcagttaagatgattttttaaactgatttttcatttctacatttccccacccttttttttccccacaagtttttaggaagaaattgaagtacagtcagtggcatttatataacatttcctcatgcccccttgtaatccatccttcccttacctcattcctagagaaccagtaacagcctttctgccactacagattgatttgcattttccataawtttacatagatggaatcatattgtaagtactagttttcctgacttctttcattctgcataatgcttttgggattcatccatgtttttccatgtgtcattagtttgttcctttttattcctcagtagtacagtgtatctttatatcacaattcacttttccattcacatgatgataagcatttagattgtttccagttttggctgttacacattaagacccatttgtacttaaacagtaatgagcaaatctttgtagaaacatttgtttttatttctcttggacaaatacctagaaaactatgcccagatggttttactggtaaattctaccaagcattcaaagataacaccaatcttacccacagtctttcagaaaacataggaggaggggattctttcacagctcattttatgagaccrgcataaccctactatcaaaatctggcaaagatgacaggaaataaaattacagagaatatcccccatgaataataaacagaaatcctctttaaaaacmaaggattagcagtcgaatccaactaaatacgtatgtgtgtatatctatatgtgtctgtttgggacaatatatatattttagggaatatgcatgtgtgtatacattargggtaagacatcatgacaaagtagtgtttatcccaggagtgtaaggttggtttgacttcaaaaaaaaacaatcaaagtaattcattacattaagagaatgaaggagaaaaataatataatcataacctcaatagatgcagaggaagcatttgacaactcagtacttcattgaaaaaaaagtatttcttagcaaactatgaattgaggagaacttctttaaactgataaaggacttctaaggaaccctatagctaagatcatacctaatggagaaatattgaacataatgccctaagattgaaaacaaggagaaagtacctgttcttaccacttctatttaacattgtactggagattctcatcagttccatggaggaagaaaaataaataagagtcctggtgtggtggttcatgcctgtaatcccagcactttaggatgctgaggcaggtggatacctggagctcaagagttcgagaccagcctgagcaacatggcgaaaccctgtgtattttaacaacaaaaaaatttttaagtgagtttagcaaggtcacaagataaaaaggtttttatgcaaaaaataagttttacagtatgcagtgaacaattggaaaatgaaaaaattttaattatatatcgaatggtaccagaaaacgtggaatacttgggaataaatttaacaacaaacatgcaacacctcttcactgaaaactatcaaatgttgctggtagaaattaaagacctaaatatggagagtgatgtacagtagttatgaactagaagacctattattatttagatggcagtttttctcaaattgttctgtagattcaacacaatccaaataaaaatcccagtctcgggtatgtctttatcagcagcatgaaaatggactaatacagttaattggtaccagtagagtggggcgttgctgaaaagataccaaaaatgtggaagcgactttggaactgggtaacaggcagaggttggaacagtttggagggctcagaagaagacaggaaaatgtgggaaagtctggaacttcctagagacttgtggaatggctgtgaccaaaagcctgatagcgatatggacaataaggtccaggctaaggtggtctcagatggagatgaggaacttgttggcaactggagcaaaggtgactcttgttgttttagcagagactggtggcattttgcccctgccctagagatttgtggaactttgaacttgagagagatgatttagggtatctggcggaagaaatttytaagcagcaaagcattcaagaggtgacttgggtatcgttaaaggcattcaattttataagggaaagcagagcataaatgttcggaaaatttgccacctgacgatgtgatagaaaagaaacacccagccgggcgcagtggctcaagcctgtaatccaagcactttgggaggctgaggtgggcggatctcaaggtcaggagatcgagaccatcctggctaacacggtgaaaccccatctctactcaaaatacaaaaaattagcccggcatggtgacgggcgcctttagtcccagctactcgggagactgaggcaggagaatggcgtgaacccgggaggcggagcttgcagtgagccgagatcgtgccactgcactccagcctgggcgacagagtgagactctgtctcaaaaagaaaagaaaaacccattttctggggagaaaatcaaaccggctgtagaaatttgcataagtagcaaggagcctaatgttaatctccaagaccatggggaaaatgtctccaggccacatcagagaccttcatggcagcccctcccggtggcccgggaggagaaagtctgtcgctctgtctcccgggctggaatgcagtggcatgatctcagctcattgcaaccttcgcctcctgggttcaagcaattctcctgcctcagcctcctgagtagctgggattacaggcgcgtgccaccatgcttggctaatttctgtatttttagtagaggtggggtttcaccatgttggccaagcaaccaaagaaatttttaaaagaacaacaataaagtcaggatttatwttacttgrtttcaagaattcctgtcaaactatggtaatcaagataatgttgtattggtgaaaggacaaaaacctgtagatcactagaagaattagcaagtccaggagagaaatatatataaatacatatatgtatataaatattttaaatgcatatataaataaaaatagtttaaatatataaatatatataattattaaaagtatataaatatatagatgccaatggagaaaggaaaaacctgttctgcaaatgatgctgaaacagcttgacattcatataggaataataaaaaaagaacagcaacccttcatatcacaccactcacccaaaaattaaaatgtatcagagacataaatgtaaaatctaatactacgaaacttctaggctgggcgcagtagttcacgcctgtaatcccagcactttggaagactaagaagggcagattgcttgagctcaggagttgaaaaccagcctggataacatggcaaaacccagtctctacagaaaatacaaaaagtagccaggcayggtcacatgtgcttgcattcccagctactcagcaggctgtggtgggaggatcacttgagcctgggggaggtcaagactgcagtgagccaagatcattccattgcactccagcctgggcgacagaataagaccctgtatttaaataaaaagaaaagaaaagaaacttctagaagaaaacatctccatgatcttgaggtaagcaaagatttttatataggacagaaaaagcaagaatcataaaagagaaaaaactgtagtttttggtgaagtagtctttatcaaaattaaaactagttcttcaagaggcctctttaagaaaagaaaatgggctgggcgtggtggcccacgcctgtaatctcagcactttgggaggcagcaggcagataacttgaggccaggagttcgagaccagcctggccaatatggtgaagccccatgctaaacctctgctaaaaatacaaaaattagacaggcgtggatgtgctcatctatagtgccagctactggcgaggctgaggctggagaatcgcttgaacccaggaggtggaggttgcagtgagccaagatggcaccactgcactctagcttgggcgacagagtgagcaagactccatctcaaaaaaaaagacaaatcacaaaatgcgagaaaatattcaacgcgcatatctaacaaaggatttgtttgtggtccatataaagaacttctacaactcagkaagaagagagcaatccaatwtttttttaatgggcaaaaaatgtgaatagattcttcaacaaaaaaagatataggaatgtccagtaacyacatgaatagatgatcagtgatctgggaaatgcaaattaaaatctcagtgagattctgctttacctctgctggaagggctaaaataaaaatggctaacaggccagacgcagtggctcatgcctataatcccagcactttgggagaccaagacaggcggattgcttcagctcacaagtttgagaccagcccgggcaacatggcgacaccccatctctaccaaaaacaattagccaggcatggtggcacatgcctgtagccccagctactcagaagactgaggtgggaggatggcttgagcccaggaggcggaggttgcagtgagctgagatcacgtcactgcattccagcctgggcaatagagccagaccttgtcaccaaaaaaaaaaaaaaaacttaacagtgccaggtattggtaagtatatgaatagactttaatcctgtgtttcctctaacattcacattatatactaggtgctctggaagaaagaaatgatgctttaaagtttacaaagcacttttacattaggtacctcatatgatctccaaagtaatcctgtaagattatttttgagtagggggtataaagtgaatcagcccattcatcctgcctcgcatagactagacataactrtgtctgattggattactgaggctactaataccagccttctatctatctcttttttcatttatgtgggaacctgattgtaaagatacagtaaattaagcaccttagaaataaaactgtgaattatgtatttatcatcacttttactgcaataatagccactagtcttccttcaagtactagataatatgtattcttgctaaaataacttcatttctcaaaatgcaggtcttccactgagctaaaataagtaactattcagaataatatctattgccarcggaaagagttttgaactggcagagtcaagacaaatagagttctttttctctttgaagacaagttggtttcactggacttatttttgtcctccagcctttggggcctcattccmgattctagccagtgtctgtcttcttatttcaagaaggctgttaaacctgtaacagatgatacattgatgtgagtcacatgccctgaaaagccataattctggtgagggttactaggagtgaaatttcattggtgagattccagaatcactgaccctgcagcagtagtctatagaaagatggtgggtaaatggtaaaattagaaatgtcagtggagagcttacccatcattaatcttttctaagtcttccctgactcattcaccagaggctttgattgactgaccaaaggcaaaatatacaacttttagtttcacatatacagctttgctctgtaaccagagtcctgccaaaattggctcagaactgcagccagaagggtttgagatacaaagattgcctcatctcataaagatttgtgacacagagttttcttctttcacaggaaggatccatttggaatgggtcaaatgcaagaggatagttcaaatgacctcttaaacatggccagtgacagttacagaactctaaatggtgtttaatctacttacaagcattttatattaagtcacccttaaatgggaacatactcattgaaaatcaaagtgagtccttcatcattagggttcttggagtccagtgggatagaaaaaagcaaaatcatcatatagtatggtatataaaattatatgaaaatgtgtggaagaacaagtacaaaatgaagtggctagaaaaactagaaaaccatttttaaaagccaagggaaggccgggcacagtggctcacgcctgtaatcccagcactttgggaggctgaggcgggcagaccacgaggtcaggagttcgagaccagcatggccgatatgatgaaaccccgtctctactaaatatacaaaaattagccaggtgcagtggtacgctcctgtaatcacagctactcagggtgctgaggcaggagaatcgctttgaacccaggaggcggaggttgcagtgagccaagattgcatcactgcactccascctgkgagacagaatgagactycgacacacacacacacacacacacacacacacacacacaccacacacgcgcgcgcgcgcaccaagggagagactgtatggtggcaatagcctctatagcctctggaagagccattggccaggaatggaaagggaaggcacttggcactgctggcttgagggaatatcttctctcaaacttctttttgattctggggagctcccatacgtgcttgtgtttgagtatcttcctgctccaactctgccatttactgttttcctcatctgataatgtgaaagtaagaggtgtgtctcagaactattaggaggatttaaaatgagatcacatgtgatatgtatggcatagtatcttgcctattttataaggcttctgtaagcccagccctggaagagaagcctctctccaaatccaccacttccaggtggattatccatcccacaaaagcaactcaggtcatcacagtgacacaggcctcagttaaggtttacatgaaaatactaaaggccataagactgctgagtatttggaattccccatctagattattgcccaaagggaccacattttagcatggtttgcgcagtgggggcacccagagacctggctgctagaacaaattccctgccctctgagtatgtaactttgggcaagmgtcccttgttcaactcctcttacttggttactgaggtgataatcagtctccctcaacatgtgtcactattatctatcatatgcctggcactatgccagggtacaggatatggccctctgccttctaggagcacatggtctggtagaagtggaaagacacagacctgaataactgacataaggcagaataaggtgagtgttgcgatggaagcacagagtgctgtggtagcacagaggaaggaatgattaccataaaaaggagaattagggacctgtaatacctttgtagagtgaaaaggcttcttgtggactttgtgtaaggtgttgatgtatcaaggaagcgttccacagggaggtgagtaatgcaagaccagggctgaagtttagactacacaggacatgtttagggatgagtgagtagttctgtgagcgagacaggaggatgccggggtagagggaagttggaacgtaagctagtgggttctacagaggaagggctttgatctgctgatcagaaggtttgggccaagcccaggaaaagggatagcagcaacatacgtttgtttattcatttgcttacttacaacaaacgtttattcattatttataatgcaacaagcattaacctaggtgctaaggagagaaaaatgagtaagacacagtttctttcctcaaggaaatcacagtctgttggcrgagataagtagtaatggtgcctaatataggtaacacttgctacctgctccaagaacaaagttaagcaagtgattaagttaagcaatgcttagaggtagaggatgtaagaatggccttaaaaaatgtgtcttctgagatgagtttgaaggataaatggagtaggaacttgccagattgaggtaagaagccttccagacacagcccaacaatgcagcaaagcccaatgcttgactaactggggcacacagggaacactgcaaagtttggtttggatcctagagtggaaaagggaactaaagagaaaagattggtgagatgagttgggataaacctaggagtttgggcttaatcctgaagcattgaggcggtgttgaaaatgtttacactgggaagttaggaaagtaaatattagtaggatggaaggatcagagaggccctgggcagaaatcataatgtgggtgactcccaggtttctggcttgagtaactgttgccattcccaaaataagagaggcaggaggagaagagttccagaggaagatgatgagttcattcttgagtatgttgaaggttattgcagggtgcctgtgatgctcttgcaaccccatccccaccttgaaatccttcagaggctccccgttccctttagtcctggcctggcctccagtgtcttctctcagccctgccttctratgtgcttgctgcagcctgagcagcttcgagtttctagaacttgccaggttgtgttctacatctttgagccttcaactagaacaccatttcccttctcctgccttctgcctggccagttgtggctcatccttccagactcactcaagataaaacatctctgaaggaggcttccctgacattgtctaccaccacccccagcaagggctgataccaactgtcarcagctacatactcacccctacttgactgtaatgatttgcatccatgtcatctcctgccctactgtgacattcccagaccacccctcaytgggcaggtggcatctctgtatcccttttgcctggcccagatggaaattaggacatcagtaaatgtaaaatgaacaaatccagatgggagcatccaacagagagttggaaattccaaaaaaagcaaaatgaaaggcaccaaaaaaatgcatacaacattaacaccttatgtctaccattcgctccccccgccacccccgtcctcttccctaagcactacattatctaaagcctagatgttcaatcatccaagcccatggctgttggcttggttatgtgtctggaatggaacagaaagggaggaggagtgcagaggcccaaggaggagcatcagtgaaggtttggagactgacctggaattcctagccatcatggtgggtacagtttacatgagaggaagcctggctttacacacctgtttcctctttctaagctctggcccctattttctaacaccatctggtggccacatctgtaaataacaaactcctcaggagctgagagagcttctataaggcaaaaggtccagggattggcctcagagggctattatgtattacagccccaacaagtttatatgtatacgagatttgccttttctgatgagacactccaagagcttttgaccagaatcttaaaaactcctatagcctccaaaaggcttagaatccctgctacaaaggattgattctttttttccccaagtgaaatcctatgaagaatcatacacaagctaaagaagcagacctaaatccctgcttgctcagaacctcaccctccaatttcccaaagcacttacagagaacctggaatctagtttgaaaaccactcttgtgaaacgaarggcttgtagagcatyggggccagatgggcccttakaaatcattgtgacgtactakgtcccacctgagagaggaggcttggtgatacacacagcacgtatcagtagcagtactggaacctaacacaagtctcccctcttgtktctcttctctttttactgcttgccttattgcccaaaacctaaatttaaaaatgtactaatcaaaactttttctatatatagttcccaaacaggaaaccattcttcatatagatttctaggtctctggaaagagatctttcccctcaaaatgcctcttaaccaaccataaatcatggtagaaaataaatctagagcttacgtttgaatagtttgttgtttgtttgtgttggggcgtgtgtttttttgaaacagggtctcattctgtttactagactggaatgcagtggtgcgatcatagctcactctaacttcgaacttctgggttcaagcgatcctcctcccttagcctcaccagaagctaggactacaggtgtgcagcaccctgcccagctagttcttttttttttttttttggtggcaatggagtcttattgtgttcccaggctggtcttgaactcctggcctcaagtgaacctcccacctcagcctcccaaagtgcagggattacagtcatgagccactgcacactgcacctgacccaaataattcttttcaacttacaacatcaatacccatgggctagtttcacagtggcagaatagactcagagaggtaaaatgacttgtttgctgtttcctgtcatcaacttaaaggttctttccactgtctcacaacatttgtgttcgaatgtgcatattctgcggtacttaaaacagtgaacawataggcaatccatctggcttattgatacttgttcagggagtgggggttataacccctgctattaactgccatttggagatgggggacggatgaagtctaacattgtttamacattcatatamtagagtctgaacaaccttcaaaatatgcttttagtcmccattttacagatgcctaaaccaaagtatagaaagagaaagtgctttgcctcaaggtcacacagctagtaattgtctcaccctcstgccctttcccttctttctcttttaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttyggggacctcctggtagacaatatggatgttccggccaccccactctcagcctaccagatccctaggacattcactctggacaaaaaccacaatgccatgacagtggccactcytggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgaggtcagtataagtcctagctgagactcagagggaggaggaggtaacacaggggttctcaatagtttgatggtccttggtcatccatggccgaggggaacttacgaaccacctaggtcactgatactcaaaaacataggtgtcttctacccagatcccttaccagttggtcctccagcactggaggctgttagtagtagttgtctaacagagctagccccagagaagttaatgttctactaatggagaataggacatycttgattaaccacagtataacatattatgggtttagaagcccaaatcattktattttattcatttgtaaatcaaatcaaagatttaaaaaataaattcagaagatcagtccaaactggagtgaaacctgtgtggactaacagactgctaaagcaaaacgaggtcttaatattttctaaatcatacttgaatctctttggttgaagtcaaaacttttatttgaagtacctaaattctattgttacttgttttccactgagagtattccaactctgcatgtaacctcctctgtatgatgaaaaaatagaacaatattaattcctttcattttgcatcttgctttatggtttgcaaagccttttcttgtccatcctgttgtttaagccaggcagagaggttggtgggacaaaacctccttgtctccatctcacatgaggccaatgacagttaagagacttaaatagagttgcagagtcattgtgccagagatgagactcagaccctakagtcccagctcctagtttagacctctttgccgtctttcaatccatcgacaatttgagcagtcatactccgttttggaactgwgatgataaagacatacataaaacatgtkcctgcccttyagagcttacatctcattgggaaaataaaaccaacacatataaatcaggacaagtattgttactgtggtgttcasagaagtgatggctggggtgagcasgacasgtgagtggtgtaggagtcaaaggagaggtgcatakatgagggtagagtagtcaaggacagcttctctgcagatgctaacactggagctacatctagaagcccaggaggaatttttgaactgaggagtgatgtgttcgaagaaattccttatcatttggggttgagagtagtatcttctggagtatcagtaagaccttgaaccacactggtgagggtatgggtaagtgtcaacacatgaatcaaccatgagtacttatgaatcctccttcctctgtcagcttcttcctgtgagacctacgagtacccacagcgtggtggagagagtgcaggccggtctgctgaatccatgagtgatggagtyggctctttcctggtgagtgtgggttaacccaagggtcctcaggccggcctggttaggtaaaaggtcacaccttatggaattaaaagcacaaccccaaaagaktgatggcgtctccatcttaggaccctgcccaagttcttgtctcagttcagaaccctgcgttgagtctttggacaagtaagatataagtattctagtctggaagaaatgtatgtgctaaggtagactggattacaaggttcaccaaccttgtaggtaagcagaggatctagaatgcaatagacccaggctgcacggtgggggaacctctaagacagcaaccttacccacgtggcctcacatgcaggagggaggctgcagtgtgagactccaggcaagggtggtactcacagtcaggctaagtggcagaattatggcttgagtgcaggatcccaggctgccctctggaagatgctaaccgcagttctccaaggtgtcaggcaagaagaccagggcctggcttcaggcccactgaaaagacagtgaaatcaggtaaccaaggcagaagcagcttagttgtatgtcacggcagatagagcaagagttagaggaaggctgggattgctgtatcacacaactctgtagaagctctgactgcagcttggtggtcccctaggtgcctggagtgagccccaggtacttagaaacctggactggggaaacacaactggccccagacctcaccttccagagccaggactcctaatatgctccttgttctgatccagggcctgagatgctgacctgccagtggtgagtctggacttgaggtggagggcaggtcctgaaccaaacctacagtctatggactatgccacccacagtgttggtcaggcgtccagaaagccaagtggacccagtcaccaagaatattttatactctagatttatcaaaaattattagtggatgccaaaggatcgtgaaggcttgaaggggcccacagacctcatatattcttgtctcccactctgcttccttttttttattttttattttttgaaacagagtctcactctgtcacccaggctggagtgcagtggcatgatcttggctcactacaaccttggcctcccaggttcaagcgattctcgtgcctcagcctcctgagtagctgggactacaagcatatgccaccacgcccagctaatactttggatttttagtagagaggaggttttgccatgttggccaagctggtctcgaacccctcacctcaagtgatccacctgcctcagcctcccactactctgctttcttatttggtctccccaaggtctcccttacagcttcaaagtatagctaacccagtcatgacttgtcttgcctcatttacaaagtcttacccccttcctgtttcttcttgctagtaacagctgtatttctttcactgttcctctccctagccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaaggtaagtccattctttcccctgtcccatctctggacagtggctagggactctttccatttgcttaggggtcatgtggatcctggacttgagaggtgtgacttggggcaaatcatgtaaaatctgagtctcagttttcttatctgtgaaatgcagatggtaattcctacctcccaggtttgctgcaaaggagagcatctaggatagtactttggtacatagcaggcgttcagtaaagtcagctttgtgccccctgcatgtagaccaggcaaggkcctcgtctgctacaatctcactctcctggcattggatcagtggcaaggattcaaagggaggagtaggatagctaggcagagatagccccctgtgggtctggccaacagggaattcaaatcttagcatttggaactgaagccctcaagcccttatggcatctaccttcctccactgtggcttgcaccgacctggccaggagcagcagggagtagtcacggtgaccatctatacttcaaatatggtctcttggctgggcgccatggctcacgcctgtacgcctgtaaccccaacactttgggaggctgaggcgagtggatcacctgaggtcagaagttygagaccagcctggccaaaatagtgaaaccccrtctctactaaaaatataaaaattagctaagcgtggtggcaggcgcctatagtcccagctactagggaggctgaggcaggagaatcacttgaactcaggaggcagaggttgcagtgagctgagattgcgccgctgcactccagcctgagcaacagagtgagaccccgtcttaaaaaatacatatatgtgtgttaatatataaatagtatatatttttataaatattaatatattaatatataaatatattttatatatagtcttttatttttaaatgaagtcataaattgagggagaaaaatctgttgtcaaaccctgtgtccccacttttgattctgaaaatataattaccatagatacagcagaaagaatatataatttggaatctgaagacatgacttcaaggctcatcaatatgggcaaagattatacaacctcgctgagcgtcagtttccctgtgtgaaactggaatgactttgcaggcctttataaacatgctcatgtgttatatataaggtgtgtatgtgtagcattatcattactggctgattaccagactttcttttcctgctccagcaaagccaacaccacttgacctgaggaacaacaccgtcatcgatgaactccccttyaagtcacctatcaccaagtcttggkctagggccaagtaagtgcgtatgtgtgggggtgggagcttggagtcgggccattakggaaaatgagtgatgtggtagctggcctgtgggccssgacagctggattctgatgctaacgctatcattakctgatcatgtstckatgtcttgtggcttggkttcctcagctgtaaaagagaataattatacctgccctatatcagatcttaatctgatggagtgtgcagctctaatggctgaggtctgggtgtgtgagggtcagggcccagctggaggctagaaacatggcagcagccatgcagcttccccagtgttaactcttycttcccacaacagccacaccttcaactccagctcctcmcagtactgccgccccatctccacccagagcatcaccagcacagactcaggagacagcgaagagaactatgtccmtatggtgagtccttcgggcttcgctggaatgacgcctttcaagtcccstgggacccacccctcagttccccacttcccagcttagctaactcacctcagcccagggactccktgtattattcatgatttagtctcstgctacaaacccttcttgagcacctgtttatcaagcagtaggagttgtcatcagatgtaaggaagacatgagacctgtcccaacgaagtcatggtcttcaagagcaggggcctgcctctcatgacagtsacatgggtggcatgatstgtgcccttggatagrcagtgctggaggtatctcctcagtggtggaggtatctcctcagtggtgagaggcatacgtgcacataactcactttggtgaggccataatagagctatcaacacaggcagaggaggatatttcttccctgagatttccattaagggcgtaactgcccagcacctggtagtcactgcatagatagtgaaagaatgaattaaccaaccagtaaagcagccaacaaacagaacacaggactatcaccttctcattagaataagacttccagaaagttctagaggaggtggtgctctgctagagcasgagcctggatggacaggatcctagagcgtgtcatctgaagaaatgcgggcttgtgcagcctggagatgaagccaccctcttcagatcttggaggagctaggcgggggagcaagctgctttggggtgactaccccactctaggccacaggtgggagtttcacaggggctgatttggtgcgacagaagaaaactttccagtgcataaaggaaatgtgctcctttcttaagcgccagcaagcaaaggctggatgtctcaggagagccactgttgatgagacttggcctgatgtgctagaaaggaggcagtgtggtacaggggttagcacaggtttggaagtcagaaaacagacctgattcccatcactcaacagctgtgcagccacaggcaaagtcacttctctgaaagtaaagtgaaccacagtttcatctttgctttaaacagtatcaacagtaatcatacctaccttacaggattgtcatgaggattaaaatgaaaacatgaaaagtccttagcatggtgcatgtgtcagagtagggctcagggaaacagtgttcttactcccagaggtgtttttctgggtggtgggttagtctgttttctgcagtcactcacagttttttcctcctcgtgacagcaaaacccagtgtstgcatctcccgttcccagtggcacgaacagtcctgcccctaagaagagcaccggcagcgttgattatctggccctggacttccagccgagctccccaagcccccaccgcaaggtgcctggagtagagttgrgggggcagtaagagctctcagggtcccggaggcagagatcatggaggccagggtgccttcaacactgaacagcagcactcagcctccctcctgctccagtacccagcttttatgatgcatctttagtcatagagctttcatctaggtctaaagactcctattcctgctctcagagcacagtaccctcagtcagagaacctcatcagtcagcccatcccccgtgttgtagagatgggcaaatgagtgcacagagatctgattgtcctaaggttacaaagtgaatcagcaacagatccaggaatgaggatactgcctcctggtcctgggctctcgagtgggtccagagccctgccgtcgatacatcagccttcagaagggacttccaggcctgggaaagcctccccaggaggyatccttatagctaagcagtctagacagaagggtgcagagctgtgcctcagcatggttccccttcacagggtggcagtgagcacagcacgtaaagtcctgtggctgatgtttgtttgcacctagcaaattccttcccctggatragcgacctgacagagatgggtggaggcagagatgaaggcctggacccatccaccagggccaaggaagggcctgggtcctcccagaagccgggaagtaagaagggctggcaggtgctgctacatcctgcaggagggatgatgagtttggagtctgagctttaaagcccacattcagaaagagaagccaggctcctgaggctggtcagtggcaggcagaggccatgctcttctccccttcagacagctcaggaagatcccgtgcccaccttcttcctccccacctaactggtaaytcacagctactccctctttcccactctgtcccctcagccatctacttcatccgtcacctctgatgagaaggtggactacgttcaggtggacaaggagaagacccaggccctgcagaacaccatgcaggagtggacagacgtgcggcagtcctcrgagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcraggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaragtggataatggactttttcaytcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctakgcccaagggctaktcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaastggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaamtaagggtgggggatctgaatgtttwtatgttgactgttcttgactaaattttcaagagtttcagaagcaacaggacagmccagrcgtttcattctaccctggggcgaacagaacttcttcctcccaaacaatgacttcctgccatgtttgatggggacagctaccactgtcctctgcccccattcccctttcagctcccatgagcatgcatagttcaccagmccaatggcctagccattctctaagtcccatcstggaagaagttatttcttcaagagstgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacasagacttcaaatgctgatggagggcasaggaagtacttagggaggttggtgtcagaggcasgagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaamaaaaggcctttgagcatatgggtccagccactcagaagtgyaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccstgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattstggtaactaccaaaatccctcgggtgcaagtgtaggggtagagatggaaggatgagaggtgaaattgaccttttgaaagcaaagctstggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggatyggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaayggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgwtgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaartgcaccccagaaccagctgccgtgtccatcttgtcttgaggrgcttggtggtggaaccygttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagtaaggtaagtaagtcagtcagtccacacgtttacttacaccccacttcagtagattcagtagagggctcttggctccctgtggcatctsacacgtcactggggggcaggctgagtcctggcctccccagaccccgtgagcaaaacccagtggccatcacagcccctgagtccaaggaagaacaatctcttgcttaggcttacttttatttatttaagaacatgggtgtctgtcttstcttcggttagaagttagaagggggctacagcagtgtcagggcacttcacccaacctgcaggtggctgctgttgcagctacaaaggccaactgctcagaggagcccacaggcttcctaagagcccacacttcacaaggaacatgaacacctttgcagtaaaatcaggactctaaccacaagggggatgcaagtggtggcttctcaggccctgaggcaggcgtggaggggctgtgggggcaaaggcctcctgctgtgagaagctagccccccgcccccccccccaaaaccatgcagtggcgcttggtaagggggcaggtctcggtctctgttcttctcagaaaggtacagacagtgcaggtaccccccacccccatatgagaaacaaacaaacaggacagccagaggagacactgccccccccacccctttgtgcaaggcttggatcctgctgtgctttataccgtacagcagtcggaaggaaaatagtacttgatgtcaaaacattggagctgaggtctagcctgtttcctgaacatcatcagatcttcccgcatggggagcctgctagggaaggagggggaggcaaagacccgtgtgtgcccatctcggctgcttcaagttaaccaggacacttgggtgtaaagttttaatgggactgatccccaatgaaagggacttaggtcttacttccatatctgagagaatctctgtgtacccttcatcaggctgaggactaaggtgccatgagctgtaccatccttcctcttggtagggcctgcctccacagcttccctcaggccctacctggctcctggagggaaggggtcaggttggcagcaggttcacattagaagaccagtctgtggaagtcaccaccattgccacctgcaggattgcagccccctggagagccttcatcctcatccttgtcttcatcaaagcccctcccccagtgcggagatgtggggagtgcagagatgtaggccgccctgctccgggcctccttctcctgctcctgggaacacagatgagaggagacttagacttagaattcacaccctgaagccagagtgagtctacccagcacaacacctttcaatgtttcctctaggtccccagggcctggacacacagagacattgcagctcagtggcaggatatccggggtggacaccttcaaaagacttcaaaagaccccctcctctcaataaaaactctagtccctgagccagctgatactagggtgtgactgactagctgacaagggcctaatgtggtaccgagaggtctgaggacttcgagggtcatatcacaccacacgggaacctgtccgcaggcctcatgatcacgaggaatgggctctgcctatgagaaagcccatcctcctgctaccaggacgtcagcctcatggcgatccttacccgccaccctgcctccatctggacagcatggcagaagctgtccctgagagcctgactcagcctcaggcccctccctgggctgctgctggtaaaacagcacataggctgtgtccttggggaagaaggagttgatgttggtgacacccggtctggtgtccccacaccagttgctgtattcccccgcacaaaacacaaactccaggcactggcacccatcccactggtcaaagcccatgctgttccagctgctcagtatgccagtgccacccttgactctagggagtcacacaggaggctcacgtgggtagtgggaccccctccccccacacccgaagcatcctcctccccctcagactcaactggtccctgtactcctccttcagcacacttattaactgcattaatggggttttctagatgatacagaatcatgtcattatctcatcccaggagcttcttaagctgttaagcaacttcagcaactctcaagatgatacatacaaaaaccaatgtgcaaaaattgctagcattcctatacaccaacaagaagcagggagccaaatcatgaacaaactcccattcacaactgctacaaacagaataaaatacctaggaatacagctaacaagggaagtgaaggagaggacacaaatggaaaaacattccatgctcacagatagataggaagactcaatagcatgaaaatggccatactgcccaatgtaattaacagattcaatgctattcccgttaaactaccattcacattcacagaattagaaaaaactattttaaaattcatacggagccaaaaagtccatatagccaagaccatcctaagcaaaaagaacaaaagtggaagcctaatgcctacctgacttcaaactatgctgttttgcttactgtagccttgtagtatagtactggtataaaaacagacacatagaccaatggaacagaatagagaactcactcagaaataagactccacacctacaaccatcttcaacaaacctgacaaaaacaagcaatgggtaaaagattccctgtttaataaatgttgctggaagaactggctagccataggcagaatgttgacattcgaccccctccttataccttatacaaaaaattcactcgatggattaaagacttaaatgtaaaacccaaaggtattaaacccctagaagaaaatctaggaaataccattcaggacataggcataggcaaagatttaatgatggaaacatcaaaagcaattgcaacaaaagcaaacaatgacaaatgggatccacttaaactaaagagcttatgcggagtacaagaaactatcatcagagtagacacaacctacagaatgaaaaaaaatttttgcaaactacccatctgacctaagtccgatatccagagtctacaaggaacttaaatgtccaagaaaaaaacaaccccattaaaaagtgggcaaaggacatgaacagacacttctcaaaagacattcattcatgtggccaacaaacgtacgaaagaaaaattcaacatcactgaccattagagaaatcaaaaccacaatgagataccatctcacgcaagccagaatggtgattattaaaaagtcaggaaacaacatatgctggtgaggttgcagagaaataggaatacctttacactgttggtgggagtgtaaattaattcaaccatcatggaagacagtgtggcaattcctcaaagacctagaggcagaaataccatttgacccagcaatcccattactggctatacacccaaaggaatataagtcattctattataaagatacatgcacatgtatgttcactgcagcacatttcacaatagcaaagacatggaatcaacccaaatgcccatcaatgatagactggataaagaaaatgtggcacatatacaccacagaatactatgcatccataaaaaggaacgagatcatgtcctctgcagggacatggacggagctggaagccgttatcctcagcaaattaacgcaggaacagaaaaccaaataccgcatgctcttactcataagtgggagctgaacaatgagaatacatggacacctggtgggggtgggaggggaccaacacccactagggcctgttggggggtggcgggggagggcgagcttcaggaagaatagctaacagatacagggtttaatacttaggtgatgggttgatctgtgcagcaaaccaccatggcacacgtttaagtaacaaatctgcacattctacacatgtaccctggaacttaaaaaataaactgcgtcattcattactcagtgtctgttactttgaagtaaggggttaggtctgtctgggccaccagtatatacccagcactgagcaacagatgaatgggatttacaaaaaagacttagaggggaaatgacttatctaagccagtagtgggactggactccctccaccaagagatcagatcaaaggccccacggctcagctcacctgtaggtaaaggatgttgtctttggaaatggcttccatcaagtccttgtgcagggtgggctctgtccggactctagaagagcccaactcagmctcgggcccctccctgggccgctgccggtaaaacagcacataggctgtgtccttagggaagaaggaggtgacgttgctgacagattcgaaggaagagaaggacacccgagtgtcaytgaacaggtaccactggttctcgggctctggcctatcggcagttcccagagaagsggcagggcgggcagcgccctcacgggcatagcagtagtagtgaccactctccgaagacactccagagtgcaccacmacactgcagaggtcatakgcctggccacggccaccagccagtggcaggcggagcascagggggatggagacgtcatccaggatcttgcggcgccgcatggkgygcasgtcgaaagagaagcgcascagtgtgaggatgaggtagcacggcccttggctcagctccaccaccttctcggcatcctgcagggaggcacacgactcrcagtagtagcggttttctgctgtcagcttctcgggggacaggaagtagttaaccaggtccaggacggagcgggagccctcagagccacatgtccgctccccggaggggatggcagcatccgggtgggtccccgctcccaggctgtcttcttccttttcctgctcagcctccttttctgtctccttctccaccttctcttcttcctcttccacctcctcctctttctccctctctccttcccctctggtgctttcctcctcctcccccacttcttccttctccgttctctcctccttcccttcttcctccctctctatcctttcctcctgactgctctgcccaccagcttccttggagtccaggccttcgatgtacaggctggtkgggggggtgtcctctgtgatgcagtgtttcctttgcctccgaggacccaccctgcctggcccctgtgcactggttggtgggggcaactcccgggctgtgatgtcttctgtggggcgcatcacagagcccaggcggcggcggcgacagcgctcaggaggagggaaggcgagagagaggtccgtgaaggcctcctcccgggaggagacgttgaggcagcagagacagcagatccgagtcactatcttgcctccaaacattttttccacagaggttgaacttggggccgggggctcctcgggmrgagagggcgagctggactgcttgagtttctggcagatccttgtgcccgttttctcctcttcrtgcagcctggggcagagagcacagagtcactacatgtacatgcgggtccccttccggggcactcagcttatccatgcccatttaccttccccaacagccacacattgagacgcacacaaacacacatgcacacaccaaacacccacacatccacgtacatgctcacaacagcacgcttgctacactcacccacacgccctacataaagacttgctggagctatgtaatgtgctcccatggcagtgacaaagatgcacggcccggtgtgcagacatacacaatgacctcccagagatcacttccactcagcatctaccaaacctccctcacactcagtccctgcccttccagcacaccccttctccacgccctccacatgttggaggcagcacacttattccctggacgctgcaacacagctcagaggtactgggcttgcccccaaggaccctctagacctggagtcttcgcgtagccctggcccccttaccgatccagcaggtacttcagatactccgagcagtcctgctgggtgccagggctgaaccagggcgtc

SEQ ID NO: 12173 - DNA, 14842 bp, Homo sapiens
cgtgcccgaccagccatggagtgtattgagccaaggagaaatatgatctgactttgattaagtgtggccatgcctgtctggagagctggccccaatatctggcttcttctgattctttccatccccttcagaggtctgcgtcccagccccaagggactcctcctccaagcttctaagttttaacaacttcagcctctttccttcgttgcccttgtccaaggacggtagctacttcctgcagtttctctgtccgtgacacttagtgttttctctttgccttttcaagttttcaatatctagttaacacttttatatactaagttctctctgttagaataactggcatggttcctgtctccaagtggaccctggctgcactctcaatggtagacatccaactgtgaataagactttgtctctaggtctccctctgtcacccaggctggagtgcagtggcgtgatcatggctcaccgcagcctcaaacccctgggcttatgccattctcccacctcagcctccctagcagctgggactacaggtaggtgccaccacgtctagctaatttccgttttgttttttttttttggtgrgggggttgggggcaggtagagatggggtctcactatattgctcaggctagtctcaaactcctggcctcaaatgatcctcccaccccagcctcccaaagtgctgggattacaggtgtgagccattgtgccagcctcaagcaatgatcttgaagttggttgcaaggaaaatgccttccctgcatttgtttcccagggctgctataacaaatggccaccaactcggcagcttcaaacaacagaaaagcatctttcatcattcgggaagtcagaaatccaaaatcaagatgctgtccaggccgagctgcttctggggctataggggagatctttcccggcccctctagctcctgacagcttcaggcgttcctcagctcatacatgcaccactcccatctctgactctgtcctcacatgaccttctctgcatctctgtgtctcaaatgtctctctccctttcttttataaggacccctgtcactgggcttaggacccaccctatatctaggatgatctcttctcgagatctttaatttcatgacgtctgcaatgacctttgttccaaataagatcacactcacaagttccaggagctgggaaatgaatatatctttttggaagccacctttcagtacattcttcggtggcttgtctgtttccccctctgggatggaagctgcacaggatatgtacttggaatggctggtgcaggactggacatatggaaggagcctcaccaaaggtgtgttgcctggccaatgtttactatgtttacatattttgcatttacatgttttaatccatattttaaaaatctatgtacaggttttttttgctttgtgttttttgagacagggtcttgctctgtcacccaggctggagtgcagtggcgtgatcacagctcactgcagccttgacctcctgggctcaagtgatcctccccgctcaggctcccaagtagctgggactacaggcaaacaccaccacacctggctaatctgggggggatttttttttgtttcttttttttttttttttttttgtagagatgggatttcaccatgttgcccaggctggtctcaaactcctgagctcaagtaatcctcccacctttgcctcccaaagggttgggattaccggcgtgagccccggtgcctggcctgtactgagtcctttaagcctcccttgacctgttgaccctgctcatgacctatagaggcagtggaggtctgctggtatttggtggtttttttctacctgcagattatttgaagtttgttgggttctgtctcctagtaatgttgaaggagtgagtcatggcttcatttgcattctttgttgagtttttacatttaagtgaggatgtgtgcaaagatttgaactcaggtgggtgccattaaccttgatagtacacttcagctatattaactcagccttagcaacagctctaggataaattattacccccgttagatggatgaatatccttgatagatagcagttgcctttcatgctgggaatctttagtcgcccctgcagacccctctccatccttccctcccctgctcagcacttgtgaggctgccttttatagcttatattggatccaatgattgttaggggcagcaaaatatcagcaggagaaagagaagagaggaagctcagggtgtttttttctgccacactgcagtccccgaggagggccacacagcgcacgtcccagccgggcattgttaacttaaactatggtgtgaacgccgctgcctctcactcatgggtcactgtgaacagcaaacacatggcaccttggatcctgcagacacgctggcagtggagaaagggagggagccagccacgcctgggggtcactctcatgaatggcgtagagtgggggccacacgtgaggacaggaagcatgaatggccgtcccagaacatccacatgagggttattaatagagccgtcccaggagaggacgcactgtgcttgggagggacaaccgaggaacagagccggctggaccgtaagaagtcctgtgacatgtgggaaatgagggaggcgctggcaggctaccaaaggccctctggctgcctctcctccctgaccttactccccagtgaaggtggccactgccactcgggctctgcgttctaggccctctgaggctggctgcatcctcctgggtgtgcttgatgacccaggagccatgtccctccatttaaagggctgtgcggagcctgaggggctgggaacataggcaggccatgactgggaaatcagacagggccattgtgagttgaatcatgtccccaaaattcatgtccacccagaacctcagtgtgtgaccttgtttggaaaagagatctgtgcagatgtcatttgttaggatgagatcatactggattagggtaggtcctggtccaatacggctgatgtccttgtaagaagaggagagatgcagacacagacaggcaggggggaggctgagtaaaagccgaggcagaggctgcagtgatgcatgtacaagccaaggaacacccctgattcccagcaaccctggaggctgggagaggcaaggacggcccctccctagagtcctcagagaaggcatggcccggtccacggtcacagcctgttggcctctggaaccgtaaggagaccatttctgttgtttgaagccacccactttgcggtgctttcttaggacagccacagtaaacgaacccaggcatcttgtatttgcaaagggtgtttgctgtgggcctcactgcatccttagttttgctttaggtctttgggagacttggcctgtcctggggcagccccatgcagcggtgatgcagaagtcaggacctgcattcggcctgcctgggttcgaatgtcagtccggcctcctcctagtggcggcagattgaatctccaaagatggccacgagctgccccaccccatgtgctcccaccatgggacaccgacactcctcccatcggaagcagagtccacgttccctcctcttgaatctggacaggcctgggcctgtggcagaagtgacgctctgtgacttctcagactaggttatagcattgaagtagcttccactttcctcaccagagcacttgcctgggagccctggggcaaccatggtgtgaggaagcccaaagccaccgctggagaagccctgagactccatgaagagaaatgcctggccagtcccctcctgttccgactccagccactgtctgactgcagtagcatgaaagaccctgagacagagccacacaaaatcccaaattctggccagtcgcagcagctcacgcttgtaatcccagcactttgggaggccaagcgggcatatcacttgaggtcaggagtttgagaccagcctggtcaacatggcaaaaccccatctctactaaaaatacaaaaaattagccgagtatggtggtgggcacctgtagtcccagctactggggaggctgaggcaggagaattgtttgatcctggggaggcagaggttgcagtgacccgagatcgcgccactgcactccagcctgggtgataggacaaaactccgtctttaaaaaaaaaaaaaaaatcccaaattcctgatccatggaaatcaagagcgggaataaaatgattgttgttttaagccaccaagtaatttggggctaatttgttacatagcaacagaaagtgaatacaggggagtaccatgatttctgttgtataaatgaggaaagtgaggcatccgttcatccattcaactatttattgagtgcttgctatatgccaagcactgtctgagcactgggatcacagcagaaacaaggaaaacaggacccctcatttatggagcacaagatacagacaggcttagtaatggctgaactttaatctaatctaatctaatcttcaattctgtgatcctaacgcccagggctttctcaccctacaaagaaagtcctctgaggttgaattcttgtctctcaccccagcttcttcctccagtggaggtgagagagagaactgaacccttcccgttggaagttcagctccattcccggggtgaagaaggcagacagtgttttctgccccacgttaccctattgttgggggtagcatcaggcacttgggctcccagaggaagctttgaggagggaggagagtggcgggaatgtcccagggtgtgagcacttggggaataaagccaaccaagagcttttgcctcgctccccagcacctactgtgcttatcttaatgggatcacttttctagcatgatgtgaagtagcttcgggcagaactccaaaccttagagagatcatttgaaaataccatttgggctgggcgcagtggctcatgcccatgatgtcagcaccttgggaggccgaggcaggtagatcacttgagatcaggagtacgagagcagccgggccaacatgatgaaatcccatctctactaaaaatacaaaaattagccaggtgtggtggcgcacgcctgtagtcccagctactcaggaggctgaggcaggagaatggcttgaacccaggaggcggaggttgcagtgagctgaaatcgcaccactgcactccagcctgggcaacagagcaaaactctgtctcaaatacacacacacacacacacacacacacacacacatatatgcacatatatatgtgcgtgtgtgttcatgtatatatgtgtgtgtgtgttcatgtaattatgtgtgtgtgtgtgtgtgtgtgtgtgtgtgtgtgtatatataaaattgttcatcataagtgacagatgactcctgttctcgggagcccatcagccatcagtctgtttttttgtctctgactgtggggtgagggtcatattcaagccatttattcaagaaccacgcgactccctgcttgacttagatcccagttccagcagagctgtctgctgtgctctgagagcgagcagttccttctgtctgggtgagtttttaagttcatgctcacaggctggtccccgtcaccaagacaggtccgctgttctcagcctcaaaaacaaacaaatgaacaaacaagaatgaagaggactatttatttatttatttatttcagagacagcattttgctctgtcacccaggctagagggcagtggcatgatcacagctcactgcagcctcaaactcctgggctcaagtgatcctcccacctcagcctcctgagttgccaggactacaggcgtgcaacaccacagcccagctaactttttttttttttgtagaagtgggggtctccctatgttgcccaggctggtcttgacctcccgggctcaagggatcctcctgcctcagcctcccaatgtgctgggataacaggcatgagccactgcacccggccaaagggagctttaaaaagcatccagagcaacttccgcaggcagctgcataagctgcrgtaccgccggacgtcagagccaccttggcgttcaccctgggctctgcctatacacttggctggccaccccgagtcaccaaggacaagggtccttccctcagaaccctgtcccacaacctggtcaaaaactccaagaagaccatcaggcaccagcatgtcactcttaagaagtacaacccccccaagctggcagcaccrgggccagctgccccctgaagaccaaggggacgagatctcagtgtcagaggagctggagcccagcacgctgaccccggcctcagctctgaagccctcagacggcatgaccatcagcagcctggtggaagaggcttgctgccgcaactagcagtrcctcggrmtgggcaccctgagcagcagcctgagctgggccaaagctcttccgcatttctctggacaaccgcatgttgaccaccaactgctgcagctacccggggctgctgatcgtgccccagggtgtccaggacaaygccctgcagtgggtgtcccactgctactaccagaactgcttccccgtaatctgctggtrcagcgggtggtccaaggcagtgctgctgcgctctggggcctgcagggcagaggtgtcctcggcctcttcaaggcccagaacgcaccttctccaggccmgtcccaggtggactcgagtagcctggagcaggagaagtacctgcaggctgtggtcagttccatgccccactatgccgacgcgtcgggacgcaacatgcttaccggcttctcctcagcccacatgggcagtcacattcccagccccrgagccagggtcatcacactgtccaaccccatggcgcccttgccctccagatggactgcaccccgaagtaagtggggcagtgtccagaccagcgggcgcagcagtgggcttggygccaatatgggctcctggttagttggcagagacgtgctggccccaccccaggcaacagggccccctcgcccacccgggcttcctgcggctgcagcgagtagccctctacrtcctcrggaacaaagcccagctcaagggtgtgcggccagactccctgcagcagtgggagctggtgcccattgaggtattcgaggaacagcaggtgaaggccaacttcaagaagctgctgaaggcatgtgtcccgggctgccccgctgctgagcccagcccagcctccttcctgtgcttgctggaggactcggagcggctgaccccaatccacaagctgctgcaggtgccagtgctggtggtggagcccctggattcagactcctctgtgctggtgggcctggaggatggctgggacatcacctcycaggtggtatccttggtgcagctgctctcagaccccttctattgcacgctggagagcttccgcctgccagtggagaagaagtggttgtccttcagtcatcccttcagccaccgtggagcccacaccctggctgggcaragcagcggcttcacacctgccttcctgtagttcctggactgtgtaacaccaggtccatctgcagttctccatggagtttgagttcagccagttctacctcaggttcctcggctgccaccatatgtcccgccgttccggaccttcctacttgactctgaccctgagagcattgagctggggctgctgtatgaggagaagggggaacgcaggggccagctgctgtgcaggtctttgtgggagtgtgtggaccggctgagcaagaggacgcccatgttctacaattmcatgcatgcacccgaggacacagagctcccgcagccctacagcaacgtgtccaacctgaaggtgtgggatttctacactgaggagatactggccaagggccctccctatgactgggaactggcccargggccccctgggcccctggaggaagaacggtctgacggaggtgctccccagtgcaggcaccgcgtggcgtggccctgctacgacagctgcccctgaccccagcctgatgctatctcacttctgctggaggagctgcagaggctggagacagagctgggctaatgccctcagtgatggaaggacacctgggaccaggtgaaggctgcacagcgcctggaaggctggccagacggaagtggcacccctagctcccttctagtgtccactgcaccccaccaccaccgttcctgggtgtgtgactgccggaggggcccgtgggctccaccctgagcctcagcctggacagcgaccagagtagtggctcgaccgcttctggctcctgccaggctgcccgccacagcaccagcaccctgtgcagccagttccagagagctgagagtgagaacgggtccaacgagggcactctgtagaagaaggaggccttcatgaagccttggaaggcccgctggttcatgttggacaagaccagcaccagctgtgctactrcaaccactgtgtggacacagagtgcaagggtgtcatcgactggcggaggtggaggctgtggcaggggcacgccctaagaccatggatgagaaggctttctttgacgtgaagacaacactttgcgtttacaacatctgtgcccaggatatgcccttggcccagcagtgggtggacgggatccagagctgcctgtcagacacctgagcctcccggcccygcccagctgctctgcttccggtcgttactgaccactaggggtgggcagggctgccccagccatctttactgccccagccctcaacaatattgaggccctgagcccccagcacatggtgcatacagcccctgccccatcccgcccygccccacccagctggccctaacttattttggggtcacagctgagcactgtccctggaggtgaccaaggtacagcccgcaatgggcctgtaaatagcccagccctgtcagcgtgtgctggtccagccagccggctgcaggcgagttgtttctagaaccagagtctatataaacagagagctaatgccaaaaaaaaataataaatacataaagaaatcatacagagcaagacaaatcatccagaaatcacctccagggaactgaagcacttattccaggacatttgaccctgcagcctggtccctctctccctccctcccgcctccatctttccccccttccatcttctgtgttcagataaacaccaagagccttcaaagagcccccgggaaataactcagtttcttgggcacatatcagctgccatgaatggttctacacactgaagtccattatctcagtgactgcgaggactgaatgagcacagcctggagctgagtcagtgttccataaaagttggctcttatttttattatactggacacagaaaggccagatgccttccccaaagcccctccctgtgggtggcagtggcccaggaagtctggcactaatgtcagtgctgtcacctgccactctgtcctcaagggcctctgggacatgctgggaaggcaggccgtgagccagatgttgcagagctgggccctgagacgctgtcccttcagtgacctttcctgtccagggcccacagcggaagctgacatgtgtgctgcccctcccctccgctcccctcccctccccaccccattctactctatgggctttggtgggaaaaaaaccagggccccatcccctgaggcctaggccagtgcagacatagacctcgaactctgcccaacatggatggcctctgcccaggtgtgggagaacaaaggcaaggaaaggctcaaggaacgttccaggcatcaggaagccaggcttccccttcagggctgtcgagtgctcaggtttctatgcctgtcagtcaccaacacttttgcagtgggcagctactatgtgccaggcacaaagggtaactgggcacacctcttttcttggaatgggtcagaggttgtcatcaaggaggtgatgtttaaactgagctcaggggaataaggaggagccagggttcggggaagagcatcccagcagaggacagagccaaagccagcgcttgaggaggcaggggtggaaggaatgtagtggtttgaggagccctggcaggctggtggggctggagagggagggtaggtgggctaattaatgccctcgcaaagacgtccactccctaatccctgcaacctgggaatctcaccttatatggcaataaacagactttgcagaggtgactaaacttttgcagtggtgactaaattaaggctccggagatgggaagaccatcctggattatgcaatggaccctaaatatgatcacaagtgttcttattatacaagagggaggcagagggcgacaccaccacacacagaagcagggaaggcagtgtgaccacggaggcagagactggggtgatgcggccacaagccaaggaacacctggagccaccagaggccggcagaggccaggaagtattcccctgacagcctccagagagggcggccctgccacacctcgacttcagcccagggatactgattttagacttctggcctccggagctataagataatacatctgtcttgttttacgccaccgagttgttggcaatttgacacagcagccgcaggaaactcatacagacgcaggaggagagcttcgagacggtttaggaaactcacatggagggcagctcgaggagagctctgagacagcttaggaggcagctggggaaagggggaaggggctggattttgttcttagtgcttctccatccccctctcattcacctcctcctttctcccctcaaagctcctcagcccttttaaaataatttcacttgttgcagtaagcaggtgtcagtttttgtgaaggtatgaacacgttttaaaaccttgcggaaggtcgaggctgcagtgagctgtgatcgcactactgcactccagcctaggcaacagagcaagaccctgtctttaaaaacaaaacaaaacaaacaaaaagacaaatatatatatatataaaactcagagacatttcctttaaaaataaaataaataaaatctctggaggagaaacaagcttctgggcccatctcctcctccctctcctccctgccatctctcctctcctcaaatgtccctgcagtgtgaaccccggccttgaggctgggagcagggaggccaagagaggaagctgtactccgcctagctcctggctgtcagcacccatggctggcaggattgccacaaactctggcgctctaaaggctgataaagccccacagcctgcacgtctggagcctgggcctccagccctgataagctggacctgtcagcaccatggccacacctgctgtaggcagtgagcgccacccgcctcccctggccactcccactcacggcttcctgttccctgtgcacagccaagccctggccaccatgcctaggccacccctccctggatgaagaacaaagtggagtggccatgggcaagcagatttgcccattacatttcatctctgcatccccccaaccccatcccgctcttaagcaccagcgctggggatcagaagacctgggagattcaggataggggtgctggagcccaccaggcacacagttccctgaggaagtcacatgggccgatcacacgcagagcatgaagtgctgtcagcagctccaacacattcctgggattctccagcccaccccatgtggccctgaggggagtgtgcaagtgcatgggggctgagagcctgggtcattgtcacggccaagcaggaagcaaactatgagagtctttgctccagccgggatcacctgtgcccgcacgtgagtgggtacaatgttctccatccctcgcccgggaagtcatcgttcatcaagcctgggctacttcccgtggtgtggaaaacctccactcaccacagcccaccaagcgggctccaggatggacccagtctgccggctctggtaggagagttagaaaggcctcttggaaaaggtgggcaggcagccagggacaggcacccctaagagatcctccagggctcttgctggtgagggacccgctcgcccttctcaccgtcctgggcttagtttagcaaacacctgttcacacctaccatgaactcaccactgttggacgaaggcgacccccaaatgtccctgccctcgaggaatgtgtagtcaaaacagagaaagaccaaacatgttttgtcgggttttttgctttgtattttattaattacaaagcccagatgtcaccaagtttcccaccaaacctcagaaatcagtggtagaaaaataacaaagtaagaagccccaagccatataatataaacctgggggttcaggctagaggggtgaggggcgtgcagtggaggtttttttgtttgtttttgcttttttgttgtttgagacggagtcttgctctgtcacccaggctggagtgcagtggcgccatcttggctcactgcaagctctgcctcctgggttcacaccactctcctgcctcagcctcccgagtagctgggactacaggcgcccaccaccacgcccggctaatttttcgtatttttagtagagacggggtttcaccgtgttagccaggatggtctcgatctcctgaccttgtgatccacctgcctcagcctcccaaagcactgggattacaggcgtgagccactgcgccgggccctttattttattttattttttttgagaaaaagtaactcaagtttacttttctcaaaaagtagtagaaatcatgccaggcatggcggctcacacctgtaatcccagcactttgggaaactgaggccagaggatcgcgtgaggccaggagtttgagaccagcctgagcaacatagtgaaaccccatctctaataaaaagacaaaaaattagccggacatggtggtgtgcacttgtggtcccagctattaggagactgaggcatgagaatcgcttaaaccgggaggcagatgttgtagtgagctgagatcatgccactgcattccagtctgggtgacagagtgagactctgtctcaaaaaaaaaaaacaaaaacaaaaaacaaaaaacaagaaaaacacacccatatatgtatatacatatgattctatatatcctgtatatatagaagaggacgcacaattaaaggtaactccctcccatcgaactcccagtccctcagctcccacctactcccctcccaggcatcgctgatcaatttcttatgcctccttcatgaattttcctctacagcacaagcacatgcaatttttttgcatatttgtactacttaaattattaagttatttaattactaaattgtcttagagataattccatatgaacatatttagacctaatagcataaccatgtaacataaattccaaaccaggatgcgttggtatgacatgggttgtgttaaaaagccccccaatggatggatgtaaaccagaactgccccagacaaatgtgtcttagcaggagctgggagagagccagccaagcaaagctgatgcagccccattcaactcaacacagcttttctgggtgtgttttatttttatttttaatttttaattttttaatttaaaaaaatagaaacggagtcttgccatgctgcccaggctgatctcaaactcctggactcaagcgatcctcccgcctcggcctcccaaagtgctgggattacaggcatgagccaccgcacccgtctgagtgtttaacaagcctaagcatgtgacagtgggacctggggtagggagggtcaggctctgagcccccacaggcactgagccatctctactcatatccaggagacagtatgggggttctgaggggaacaactatgccagtttttggggaaacatgttcatcattttcctgagcacttccctctacctttgctacggaaaccccagctcaccctccgagcctgattcaaggcccatctgcttgtcggctttggtctcggagaggtgccacggagtcaggctaaagagcagggcaggacaggggacctgctggggctgaccgctgagccacggacagccctgtgggtgagaccggtggacattgtccccaagccccattccagcagtgcaccctcccatggtgtcatccttctggcctcctttggtagaccaagtctcctttgcccaggtagcctgtctgtgacagccacctccctgcatttctaggcccccattgtccaagagtgaccagggcacttccctcttggtttccacctcaacgagggcaacgtgtatctctgagccccggctttgtgccaagcactggagttacaacagcaggcagattccatggagctgatgttctgatggggagcaccagcacacagcaaaaacggtcctacaagaacagatggcaataagcctgagcctaatgtcctggcctgggcaggcctctctagggaagggacatttccattgtctcacattacattgagtaagtgggactcagctgggcgaggaggagagggtgtgaacttggtgtgttggaaaacaggagagatggtcacgggtctagggcttggagtgagagctgggcagggctggaatttgtggggccttctggacggtgataaattcagaccccatcccagggccatgagcagtcgctaagggaatttaaacaggagtgtggggacaggatcaaatttgccaccctccctctccagggaaaacaccttgggctaagaggaaaggcaaatgatgaagccttggactccaggccggggccctgagaggagggagaggggtcgcctccatctccgagcagcgggactaagagccctttggcgcctcaccccaggaagtcggctctgtaaggacttccccagcttcctctgaggccag

SEQ ID NO: 12174 - DNA, 48264 bp, Homo sapiens
  misc_feature (1)...(48264): n = A,T,C or G, or insertion/deletion polymorphism (see Tables 1-2)
aaacaataatttttttaccacttcttagtctatttctgcagttttaatttttgcaacagagaatgtattgtatttctttttttttttttttctcttttgagacagagttgtgctctttgtcacgcaggctgacaaagagtagtgcagtgatgccatctcagctcactgcaacctccgcctcccaggttcaagctattctcctgcctcagcctcctgagtagctggcattacaggagtgtgccaccatgcccggctgagaatgtgtttcaatagatgtgtgtcttttttttttggagacagagtcttattctgtcacccaggccagagtgaagtggtgcaatcctggctcacagcaacctctgcctcccaggttcaagcaatccacctgccccagcctccccaataactgggattacaagcgtgcaccaccatgtgcagctagtttttgtatgttttagtagtatgtttttgtatgtttcaccatattggccagggtggtctcgaactcctgacctcaagtgatctgcccaccttagcctcccaaagtactgggattacaggtgtgagccaccgagtccagcctcaacagatgttttaattgaatagatgttaaaataattattaatgttcatgatgatttaacttcaaggatattccttaaaacgtgaacagaaagaacctcctcatgattttaacagtttctgatatttgctttttctgagagtttactctcttattttccatctagttcctaactcatctggaatttctgttgcataaggtatgaaacagaagctatctttccctgtgcactctccacggaggcgttcaggcactcctggctgacgcgtgctgcctgcctccttcacggcctacatccctacacacacagatgcctcttgtgggaccaggtgcagtgaggcctgctttctaacctggattccctcatccacaaggtatggttacgaccagagcttcctcctgagagcgcagggagcttgtgacacctcccagaaatgctcaggggacgctggccaccttgcagagaaacccctcctaacgggaagggaacatgggtacgcgaggctccggtactgaccgcggctgggcgacagcaggctacttggataggggacgctcactctcctcagctcatccagcttctcctgtagcttccgcacctggctgtcggagcggctgaccctctgccgcaggctcttcagctcgccgttcttcttctccacctgctcccgcaggcagcacacctggctcttgttctgccgggaggagaagcagtaggagtgcagtgagtcgatgagcttgcaggcccctgacgccgacaggatgacctcgttgatggacatggggctggcgtcgctgtgctcgctctgcacggcttccgtggctggctttggggtgacgtcggcaggaggggcagaggggctctgggaaggcttctgcggtgtygcggtaagtgatgagctgggagggctctgggccaggcccttgtcgggtcccaggctgctcccactgcagcttggttccacatctttcttcagcctcttgcggtcaatgggctctcgggggacagatggcctttctcgggtgtgcttrgaggagaaactgtacgaatgaagtgagccgataaatttgcacgccccagatcctgggggcgtaaagtcatccatagaaatgccactcttatctgtcacgcccccttcgatggaggaagtggcgctctcatcgccagcatctgtggcagacgcttctgcttttccctgactgcctgccaccatggtggccagtccatctcctggagtccgttccagagcttgctgggcctgctcctggctggcggcctcctgggccgccctgggtgtggcttcaccttgcagagcagcttgcttcaacctgcgggactcyggcttggccatcgggtttccactcgaggacggtgaccaacctgcagctcctctgcyggtggcggcactcgagtgtcccctcacaccccctgtggccttgctggcatcttttctccgggtgcggccatggcctccagcccccctcttcttctcggtcaggtggaagatggatggcacggccgtrggcttcagcaggcgatgctggtcctccagcctcttggagaagctgtctttggtgaaatgctcactacagagaaatgaatacttagtgggagtccagttatccctctgaacagcttttaaccattggattagacgttktgagtcctttrgggggaacctacaggacaaatgacaaaaagtaattagaaataattaaatgtctccccttaaaataatcaactgtaaaagcaaaacaagtatttttgcacgcaccctaagccgtattgacttcatccacttaaaaaaatacttcaaaaagatttaaagaacatcttctacctgcagttattactggagtagaaatctgaaagacccgttgtctacccatacagagcttatagtctgtagggcggatgggaaagaaggtaaccaactgctccccaggctgtggtaaatgcccaatggggacacaggatgctgacagacagtgccaggatggcctcaggacagcaggaaatagctcctagaagctgactgctaaccaaccctcccaacttgcctggaaggtaggactctgggtaccaaaaccagggccagcatccacagacactagggcgtgagaggtcaggactgcatggaggcagccctggctgtgcgcaagcagctgagaatctggagacctccagaagactccagagctacagttctgtgttcctgttgcatgcccacctccaggagtaaaaatgctccttttaaaagtcaaccagcccagggacagggcacaatggtgctcacctgcagttccagttacttgggagcctgaggcttgagggttctttgagcccagaaattcgaagttacagtgagctaagactgcaccactgctccccatcctggggaacagagtgaaacccggtcttctcccctcaaaaaaaatcaaccaactcagatgatccttgaggacattatactgaatgaaatagggcaggtgcmaaaaaacaaacactgcatgataccactcacatgaggtactcagagtaatcaaattcatagagacaggagaatgcgggttcccagagcctagggagaggaggactggggtattaatgtttaatgagtccagagattccgctttacaaaataaaaataattctggaggtggatggtagtgacagctgcacaacaacgtgaatgtatttgttgccatgaattgtacactgaaaaagcggtaggaaaggctgggagccgtggctcatgcctgtgatcccagctactctggaggctgagatgggaggaccacttgggtccaggaggctgaggctgcagtgagctacggtcataccattgcactccagcctgggtgacagagtgggactctgtctccaaaaaaagttaggatggtaaatttcatgttacatgtattataccataatttaaaaatggtgagaaaaaagcaaccagcgcaggaagatactgaataggatgtttagtcatttctttattacctaataaagatccttcataaccatttcttcattaaggcaaactctgtgtttaagaacataggcctgggccgggcggggtggcttatgcctgtaatcccagcactttgggaggccgaggcgggtggatcacttgaggtcaggactttgaggccagagttcgagaccagcctggccaatatggtgaaaccctgtctctactaaaaatacaaaaaaattagacaggcgtggtggcgcttgcctgtaatcccagctacttgggaggctgaagcaggagaatagcttgaacccaggagcgggggttgcagtgagccgagatcgcaccaatgcactccagcctgggcgacagagggagactccttctcaaaaaaaagagaaaaaaagaaaaaaaaaccaggccctaatgtgcacataagggacagggtggtcagttctaactgctatttgctccacctgaggccagtgtggaccaggacaaatcctaacaggatggactgggccgttctaagcaacaggaccttctaacctcctttctgaacactgtgaggccaactgcaaaggtacccccccacccccaattccgatgtcctttcctcccataccatgttagaccgttgcaacacgttgcctcgttttcaaaaaacaataacaaaacttctaggacacaagctctgaaggaaattgtcaagaaagtgcgctggctgacttgtgaaataatctaatgttactaattcttataatacattgtaatgatttaagacttacagcaaactactgtgaactttcaataaccctataaataacacgtgccattcccgtctttaaaacttaaataacaccatgcaacataaaacagaaacatctccaaagtggtttttaaagtctgttcgcggttctggtgcctcccgcgtgtaatccgcagaaatctcactgaaataggctgaactcacaaggccttagaggggtttgggccctgccgcgggggcccacgtgggaagcggccgagagccccgggccaggctctaagggagcgcaggaggatgccgtccccagccggccgtcccgtagactctccgcgcgtacccgcgtcctgggctcgggggcccagtcccggaaagccctctcgggggctgtcagctacggaggcgcaggtcgcgtctgcccggtcgctcctgctcgcagacatccaggccgacggcccgcgcggtccggagagtcagcagtcgcggccgagcaggacaatcggcccaggacctgcgttaccagagcgtgcggctttctgaagctaggcgccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggggcccgcgtacctgtggaaggagacggcgcgcttctcgccctttccctgccggttggagcagttcacgaccgcacagcagatcaccatcgcgggccttggcccagccgcgcagccaggccccggccctagccgcccgcccgcccgcggaccgccccgagggagggagcgcggcggcgacacggctcgggacgtgggccggcccgcggcgtccgcgccgtacggcaagatggaggcgcaggcgcccgcagcgggcccgcccccgccccatcccccgcccgcgtcctcgccagccgcgggttcgggcgtcttcggaccagcggggcgccgcaggcccctcgcagcgtccgtcggcaggcgggcagacgggcgggggagtcgccccggcggggcaagtccgtaccgcgacatgggcgcgccgagcacgtccgtaccgcaagatggctgctcggacggggacagagctcgcctctgccgcctcgacaactgctcctgggtcctctaagaggaggaagcgccacccatggcacacagtgtcccgtcggacagcagaaccagccgtcgtcccacgacacgaccccatgccgcccgcagggcgccccggggctcgcgtcggcccggccgtacgccaaaatggcggctcccgcgtatttccgctcgcgcgccgtatcgtcttcgccgcctgcgccggcacacctattggcccccgcggcgtcccgtcgccgcgtcgcgttgctggcccgtcggagcgacgccgctcgggtcagtcggcggccggactgggaagatggacgcaggtgaggagttgccgggggtcggtctttccgcaggaggtgctcgccttatcattggcctcccctgctcgggtcgggctgccgcgactcgcctcggggcacgccggtgcgggccaggctgggccggggcggcgggcgctgcgggagcgcggggcggtgttggtgggtggtgggcggtgggagcgggagggggacggcggcgcactgcgccgcggaacccgccgtcggttgcgctggagcttctgcttttccggtcccgtccggagcgctccggaggttgtggctgcacaggcccttgcgccaggtcggccgtggagggcggcggagcctgccgggcggggagaggcgcggcggcgaacggggcggccgcggtccgggccggggacgcgagcggcgggcgaaagcgtagcctttccgcagctgagcgtgaagggatggaagctctttaacttttatgaagttattggtaggttggaggagagaaacgtgacgtgttcatcacagtatacgtatcttttttgtttttgtyttcaatttagtaaccagtagattctccaagctgcttttccgtgacgagaaagagaaacagtgaatttgtatcatcgggtcttagtttcttggggtcctaagagagagagaaagagaaggagtgtgtgtgtgtgtgtatagggagtgttggtttttttcctatcctttcatgcttccgctccatttttgctagcaagattattttaagtcagcgccaaacccatcgctagcccagtagccctagaaatatttttacacagaagttttagctcattcattctttgtaggaactgatttgccttttaccaagtatcccccatctgtaaagaaagattttcatctggtttaattctgtcattctgaatgggattgtttttactttttatttttctggtagctacaacataaatttattaagatctgagttggaaaactgtaatgtgtattgccaatatctattaaaatgatttgtagcagctcaccacttaaatgtggtaggtggctggaggaaacaggagccctgactccctaaggagcatgttgaccaggtgtatatcttgtgaagtttgtcttttagaataaccgtcattcacggttgaactatttgcagctgtgtactatttgttgtttactattttacaactgttgtattatatctttttaggtgttattgtttgtgatgcaggatttttctcagccactctggcagccagagacctccggctggcgaggcccctgcccaggccttgcttgggtccaggctcgccgcaggagataccccatctacttggtccaccggtgggcacctggtttgcactatggcacggataccatggccaccatgactgtatgctcagcccctggcgggagtgggtgtgtgggtgagtgagtgccgggtcccgccagctgtttcaagcgcaggcagcagagtgggctctgcagagcttacagctagacatgtggcaagcaactcccacggcggactccagcgtccagacaaagggacagtggattctggtgtccagacaaggggaaggtagtggcgcccaagcaggggtgcttacaaccctgaagcccaagaggggktgttgcagagtgtcagcagccctgttactcccattgccctgctccaggctatagctctggggctggctccgtccccgctgcttccctttgctgcctcctgtcacgtggggtgtcacagtgggtggctgccctttgccggcagagggcccagggccacagtgttacagccttctttgtacttgcattcattgggtccctagttcttgtcccacgtccaagaagaatgagactacacttaacactgacaatcgaagggtgaggagggtggagaatagttttattgagtgatgaaacacccctcagcagagaggggactcaagggtggtcttccacccaaagtcgggtggtctcccttggtgtggctgggtccagggcttttataggctcagaatggggagtgtgtgctgatttgtctgtgagtatgcaaaaaaggttaaaacaaagtcactactcaaaggtgggcacaacagtgtaataaaccaattagagaaaagtaggtatatgtaaaataggtgaagggtggggattaattagaggaaagcgcaccaaacaggaagagaggttcgcaatccagtctgtggatttatccgagactcgtcgcttggctttcaggctttaaactgtggcttgaaggttgggtttcactggtgacccacccctctctgcctaggatttgtctgcctcctgcctctatcatttcgataccttgaggctggagtatcatatgagagacttggctaaggtcaaaaacacggttcagtgtcgatcatatgacctaaaatgtgaaaatcatcatgttcaagttgggagaacagttatgttgttacatggcgatactttattttatcttttattttcccttgacaactgtgttgacatggtgatactttaataggacactggatgctgctgcatgtgggatcagagtagaaaaggtgtttgcatttaaaggtctctgtttatgctgataaaaacgtatatgatgtttgtaggatatcatggggaattttccttctgacttgatgctgtatttcctttcagagatgattaatgatctgccctcctttgatctctagagttcttgaagattctgccttccttgaccatgtgtaatacagtttctgttctgatagtcattaattcaatacactgtttgttactgactgtcagatatgtgttaggcattgttctagacactaggactagagaagtaacaacatagatgaaaaccattgccctggggtagctaacgttctagacatgagaccagcattagcagcgaagtgcgtggctcctgggggatggtgatttgggccaaggatgaggaggattggaattgtagccaggatggccaggaagggtctcactctgaaggtttaagttttgacgaagacttaaagcagtgtaggaggaagggcaggtagcaagagcctggtgtggctcrggtgcagcgggtggcggtgggagaagcaggagctgaggatagaaaggtgacttaggctcagtgtagtggggccttgccagctcatagtgaggactcggtgtttattctgaacaggatggcagctcatagtgaggactcagtgtttattctgaacaggatggcagccgtttggaaggtttcattctagaggaggagtcacatgatagactgtgttcaacaggcttgctctggcatctcttttgagaatgtactgcagaggggcaagggcagaggcarcgagaccagctaagagactgttgaacaagccagcaaggagatgccagtggattagctcagggtgggtaagaggttgacttctgcatgtgttttggaggttgagacaatagaatttgtttgtagattggaagttgggagagggatgggtagagaggggaggagttaaagatggccccatagtgtatggcctgagctaagcaactcagatggaggggggcggggcgtggtggctcacgcctgtaatcccagcactttgagaggcctaggtgggcggatcacaaggtcaggagatcgagaccatcctggctaacacggtgaaaccccgtcgctactaaaaatacaaaaaattagccgggcatagtggcgggcgcctgtgatcccagctacgcaggaggctgaggcaggagaatggcgtgaacccgggaggcggagcttgcagtgagccaagactgcgccactgcactccagcctgggcgacagagcgagactctgtctcaaaaaaaaaaaaaaaaagaaactcagatggggaagacttggggaggtcctgtctggtgggaagctttctgttgcgagtttggatttatgtgtgttgaatgtgaggtggatgttagacatccttgtagagcagtgtccagtgggcttttgggtctacaggtttggagctaaaagaataagcctgggctggagatagactggaggtcacatcagatgaggtcacccagggtgtgaatgtgggtgggaaagaaaagaggccaaaggcctctgcgggtgtggagaggtccaggaggtggcaggcagaccacagtgtggctgtgttctccaccagtccctagcactgtccctaaaagcatgctccccattcagacgactggcaggtgccagcacttaaatagccacactgcccattccttgaggacagagctggtgtcttgtgcttgcatttctagtgcatcacttgtgtctggcatgtggttggtaataaaaaaaaaacagaacttgaattaataataacctacacattcccctactatcaaagctttcagtttgtagagtttaacataaatccagtatgttagcataacatgtaatgaatgcagaggctgctggggagtggtttttttttttttcttgagacggagtcttgctctgtttcccaggctggagtgcggtgggcgcgatctaggggagtgggttttaatgtgcgcaatctgcccagtgtgtgcactgaaacagtgttttctagctttctgatgtagctaaatttggagttcctttctctctttctctgttttcattcaggactgaactactagcattctcatgtaaactcttggagatttaaaaaaaagtagtaatcatatgcaaactgttatcttaaacctaagagctttctaaaggaaaagaagaacctttgttgaatttataaaatataaatcttttggaaaataacttctaagtgttttaggaaggtttcttcgaaatgaagtggtttacagtaagctcttaaatttactcgttttttttttgtagtcctctctggttgaatgaagtgtaattggtactaaatggagagaagttggttaaattcattgagtacaattccctacatttctgcctgtcagattagtagtactaagtcacatgttttttctgatggaattactatattattaaaatgccatctgccctcttctgcttgtgatcgcagaagtcccagggaagagggcgtggaaaatcaagtgtctgggatccagccgaccaaatgggagaactgcttctaagggggactctttcttaaggtgtacagcacctctccgtctttttttttttttttttttttttttttttttttaagacggagtctcactgtcgcccaaactggctggagtgcagtggctctatctcagctcactgcagccttcgcctcctgggttcaagaaattctcctgcctcagcctcccgagtagctgggattacaggtgtgcaccaccatgcctggctaacttttttatatttttagtagagatggagtttcaccatgttggccaggctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacctggaagtctagagatgggtctatatatttatttatgtatatatgtacatatatatatataaacatatatatacgtatatatacacataaatatatacacatatatgtataaatatatatatacgtgtgtgtgtgtgtgtgtgtatgtatatatttttccccccccccgtcgtccaggctggagtgcagtggcgtgatctyggctcactgcaacggggttttgccatgttggccaggctggtcttgaacccttgacctcaggtgatccacccaccttggcctcctaaagtgctgggattacaggtgtgagccactgcacccggcgagtggatattttttccgaagtttgactccttttctatcaggagctacatgaattaccttataaatcacatgatgtggcaygggaagatgatgaaattatgacaggggctatgaaataagacaagggaacctctccatggcgaattgctgaggcagctggtgtcaggcctaagtggatctcatwcatctgagagtcagtgaaggaacaagtgtggtggctcacacttgtagtcccagcactttgggaggctgaggtgggtggatcactggagcccargagtttgagaccagcctgcttaacatagggaaaccccacctctacaaaaaatacaaaaattaggcatgacggtgcatgcctgtagtcccagctactcaggaggctgaggtgggaggatcccttgaggccggaagggggaggttgcartgagctgagatcacaccactgcactccascttgggtgacagagccagacccttgggtgacagagccagaaggaacgtttgggaatggaatcatcgtgttggtcgatctgcagatgttagtgattgtgagcgttagttttgcacccattgtgggttctcaccccacttggaaaactggtggctgtgccccatttcatgggtgaggagactgaggctggaagaagtccaggcctgtgtctgtcctgtagctatygaccaggctctcagactccagaaacaaacctcagtaggaatcagaagtgttggccgggcgcggtctgcctgtagctatcgagcaggctgtcagactccagaaccaaacctcagtagaaatcagaagtgtcggccggttgcggtggctcatgcctgtaatcccagcactttcggaagctgatgtgggcggatcatctgagatgaggagttygagaccagcctgaccaacatgggagaaacccatctctactaaaaatacaaaattagccaggcgtggtggcacacacctgtaatcccagctactcgggaggctgaggcaggagaatcgcttgaaaccgggaggcggaggttgcagtgagccgagatcgtgccattgcactccagcctgggtgacgagcaaaactccatctcaaaaaaaaaaaaagaaagaaattagaagtgttaattccaaaaaagttatcttcctccattataaagtaagatctggaaggtcagggaggtctttgtaccgttctgatgcctcagtccatggctcctcattgtgtcttcctcttcagctggagctgcgagggtgtccaggaggggtgarttctgctcggagggcctgccgagggcattccttcctgtcctccagcatgagagggacagtgtggggcccctagagtacagggaagacctcctyataactgaagagatgcgagtctgagagtctttattggctcttttgtaggaatcgctgcaggtctctttggtccttggagccagcccgtgaggccgggggcaggctcttgctctctaaatgcagtcactcttggaggaaaggacgttatgttggattcagtgttagtaaagagactcatgtttggttgggtctctgttgaccttgtactctgtgctgcacctctgcttacagaatacctcccawccatgccggttcgtgactgctcacccgtttcagtgatctgagarggctggccctgaaagagtggttactgctcccgtgcagtttagagcttttcctgcaccttgacttgtccgtttcacagtgaggacaccaagtcacaagaaggtcactagcctgtaaggttgcgtgactgctcagtggtgggctcagacttctgactccacagctggcgctccagctgtcaggaacgtgctccaggtgtgacgtgtggacactccccacttgcagcgtcctccacagtaccgagaggagggtgcagtgtggtgggagaagcaagggatcatgttttcagagtgtccgccactagccctaggggaatgtatgactcgctcccaacagagggcaggattctcggggagggccggagtgcgtttctctggacggaggagcagagcagcttggggcacggtgtgggagccctccttagggacctcatgggtcacgttcgccgtgrctgcgccactcctgttcactgccaagcaccgtgattgctccttggatttgctcccctggggtttcctggtctccttgatggtttatacagtgagcaatctgaggccacacacctgtaattttcacagttatagctggaggtgtggtggtgtatttgaacttaatggaacacctcttattcccttcactctgaagttggcttccttgcctataaagtttggtgataaacctaagaaatacacctgctrtgcattttactgcgtccgtgatgaaaatccctcaacttcacagccgctcaggcctcgtgaccctgctttcagagggagcctttttccttttcttccttatctatacttctctcattcctttaccatttatatttttaatatgggaaactagacatcctagaagtttctcagcttccagattctgttactgcagactgttactgattcaacaatatggtccttttcctgatgacatacgccacattcttctgaagtacagatggtctccaaactaccatggtttgacttacaattttttgactttacgatagtgtgaaagcagtatgcattctatggaaaccatacttgacgttttgaattttgatctttttctgggctagcagtatgcctccagatactctcgagatgccagatagctcctcgtcagccacatcatgagaagggggaatgacccctgctctacagggcactgtgttgccagctgagtttgcccaactgtaggctaatgtaagtgttctgagcacatttaaggcaggctaggctaagctatgatgttaggtagattacgtgtattcaatgctttttttttttttttttgagacagagtttcactctcccacctgggctggaatgcagtggcgcgatctcaggtcactgcagcctccgcctcctgggtttaagcaattctcctgcctcagcctcccgagtagctgggattacaggcacctgccaccatgcccgagtaactttttgtgtttttaatagagatgggatttcaccatgttgaccaggctggtctccaactcctgacctcaggtgatccacccgccttggcctccccaagtgctgggattacaggcatgagcccctgtgcctggcctcagtgcatttttgacctaagtattttcaatttacaatgggtttattggacataatcccatcctaattaaggaacatctgtagtctacaaagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtggccaggcgcagtggctcacgcctgtaatcccagcactttgggaggccgaggcgggaggatcatgaggtcaggagattgagaccatcctggctaacacagtgaaaccccgtctctactaaaaaaaatacaaaaaattagccaggcrtggtggcgggcgcttgtagtcccagctactcaggaggctgaggcaggagaatggcatgagccgggaggcagagcttgcagtgagccgagatcgcgctactgcactccagcctggtgggcgacagagtgagactccgtctcaaaaaaaaaaaaaaraaaagaaaagaaattagaccggtggtgttttcatcctttttccttgagaataagttttctggattttagtctatatattgaataaagcctacaggtcaaagaatagtagggacttctgaagattcaggagtggctttagagaggtagcagggacatcatgatgtttttcagctctttaaaaagataggagtgggccrgatgctgtggctcacgcctgtaatcccagcactttgggaggccgaggtgggtggatcacttgaggtcaggagatcgagaccagcctggctaacrcagtgaaaccctgtctctactaaaaatacaaaaattagccgggcatggtggcagatgtctgtaatcccagctactcgggaggatgaggcaggagaatttcttgaacccggaaggtggaggttgcagggagccaagatcatgccactgcacttcagcctgggcaacagagtgagactccatcacaaaagaataaaaaaaaggcatggaccttaattcatcctaattcagtttttgtaatcatgtgcagaaacaagtaacatatatataaaaaggcaggagagaatgtaaacttggactttatttattcacagtcaccaagcagtttggttgataatgtctctgaaagcatggacaagtgaaatatgtaagagcagagctcttgggggccaggtgcagtggctcatgcctgtaatcccagccttcgggaggctaaggcaggtggattgcttgagcctaggagtttgagaccagcttgacaacatgattagacctcatctctacaaaaaatacaagaattagctgggtgtggtggcacatgcctgtagtctcagctgctcaggaggctgagaccggagaattgattgagcctgggagtttgaggctgcagtaagctgtgattacaccactgtactccagcctgggtgacaaaatgagtcccggtctcaaaaaaaaaaaagaaaaaaaaacaggagcagagctcttggacaaagccctgctgtggaaagcttgcttcatctggctgcagccgctccacaacgcccgtcatcttgctcaggaagccacagcactactctaggaaaggggcagagaggggcctgggtctcccacagctgagaatcctttaaacagtgcctgtagggccctctattgtggatttggtagttctgcctgcaccgagggagatgctwgcaggtgcttctgaaccctgtgtttgggaattagctgcgcatacaattaaggcttttgggtatagtaaaatttgtgtgcctttgaccctgtggttctgagtcctcgatgttaatgacagagcggacattgcagcccttctgtctgccagccagcacctcattggaagtgtttcattgaaacgtcacacccatatgctgaggctgtcctgttgttatcccattttatggatgagggaacattcacacttagaagttaagtgagtggcccaggaaactacagtttaccagtacccaagctgggctttaaattctgactgccccctgcctccccaaggggattgtgcacagcacagaagttcacacacgatgctttttagtatcagcttaggtggagatctgtgtttatgtagaatgctgaggaaaccacaggcatagtatgatttcacgtacgaacctgtgcataaagacttctggaaagagtcattgctgggcaacgaggcttcacgtgatttgtgtatttttgtagtcttcagaattttttatgattagcatatgtcattcttattgaagtgtggggttgttatcaaaaagtaaatttagatgtgggagaaattcatatgtgattgattttcaaaagattgctgtaaagttgctggtgaaggatgagtgatcagacaccatcagagctggagaggcagcagatgggaattgtgtgttcccagttccctgaagagcagctggagagagatgcctctggtgccgccccagaatacgcaatgggcatctcgccacatgggtgtttgggctggtgcattgctgctggctggcgccttcttttcaggaacattgtgggacatgggtatcctcagccacagttctgtggacaggaagaccctgggcctctctagtttctttctttcttttttttctttttcttttctttttcttttttttttttttttgagatggagtttcactcttgtcacccaggctggagtgcagtggcacaatctcagctcactgcaacctccaccttctgggttcaagtgattctcttggctcagtctccctagtagctgggattacaggcgcccgccaccacgcctggctaattgttgtacttttagtagagacggagtttcaccatgttgaccaggctggtctcaaactcctggcctcaggtgatctgcccacctcggcctcccagagtgctgggatcacaggcatgagccactgtgcctggcctagtttcttaattgaagtaaaacagagtaagatggcatgcagggctaatcattagcccagcaggtaagcaccatggctctgcagccagctgcctccttagaaagtggggtgttgcsccatggaagtggtggcatgctcttctggtagcattgttgaaatgaaaacaggttcagtccttgatcactaggctttttgtacccgggtacctctggggacttggcagagagtttgatctctcagtgtccaggggttaactttctacctgagagtagcaccccatgcttctccagcacctgctcctaaccaggaaattggggtagaccagaaccccagtcttcccagcagctcagtgtttcttgcccyggagcatctgccttcatcacagtgactctgaacacgctgccatggtgacatctggtaaaccttaggatggccatggaaaacgactctttgccctgtttcttcttggcttcccttgcgtacaaggatgaaggaggtggtttaactttatttttgtcctttactttttaagtctaaagtaagtgcttgaatcgggtgggttttcatttttttgctttctcacccctcaggttggcccctracttggcctctcaccctcgtgtcagctgttagacactgactcagtggctcagaatatgaaaggctcaggaagtagcatgctggccccacctccctgtccccataccttagcagagcagctgcccagcagggcctcctyctctttcctaagagtttactccatccatggtgggtgtcttggtaggcccgagatacgagagggagtgctgctgttacaagaatttacagttgttctcttcrgcacagaaatgctgtaaatggcctctttcgatactagtttatgaaattataagtgtctgatgattgtgcatctttggtttcaacagctactctgacctacgacactctccggtttgctgagtttgaagattttcctgagacctcagagcccgtttggatactgggtagaaaatacagcattttcacaggtatcggccatgctggagcccaccctggtctgaccgcttggcctgcagaagcattttgtgatcactgttctctgctaactctgccataacttgtgacttgcaaacttaaggcgttgtgtgtgtgtgttttttttcttttaaacaacctctagaaaaggacgagatcttgtctgatgtggcatctagactttggtttacatacaggaaaaactttccagccattggtaagtactctgttttattacaacgcgggacaaaatatgtttttaggaaggaggaaaacttacgcttgtagatttgacttcaatatgccactgacttcatttgaatcttcacagcaatcctgcttaactgaattggccgaggcctcacgtgtagtagtggcaaagctagaatccacggcgcctgactctaggctagtgtgttttcaactgcaaatcccagcttattactggagctggaaatcagtatcatgagttatgaccaacgttgttttaaatgtaggacagaatgtcatagaaagcggtgtgtgtccgccacgggcacgcagcatggcgcttcagggatcttcgttttcgtttgcatgtttgagtgtgtgttctgggtcacagctgtacaatgtgtttcttacttaggtccagaatgtttggaagccattctctgtagccctcatcttttttagtattttccacacttaacctgtggggagatttgaagggccaggtgaatgtgacatgtttttatgtaacactaaggtgcattctgttaaaagccattcatcattgttgtataccctggagctggaaggagatggggactggttctcagccttgcctctcaccggcggagaactgaggccggaggtgagggccgggctggcgtcatgcttcctcagtgccaggtcagggtttggtccctcttctaggggtggtttcattctttatcctgaagtgaggtggaagtcaaatagccacaacggctggacattggagaacactgacgcgtagggacatacgacagtgtctccttaggttgatatttaatgatacaccttgtgagatgtaccctgggaatattgatatgtaatgatatattttaatgacataccttgtcagatgtgccctgggaatagttgctcattccacagtttccgcttgtttcgcagctgcgctgaacctgctctcttggccgccttggatgcaggtttgtccccagcctccatctccttcacagctaccctgccgcgtgctgggaaggagaacaggactggagcgaagcctttctggtttggcagaggccttgtggaggaggtagaggctggggatgagcctgcacatgaagcagccctgtcgcagttctgaagggcagtgtgctgtgtttccttcttagccccacggagataattttttaaaattattactttcatttttttaatagatggggtttcgctatgttgcccaggctggacttgaactcctgggctcaagcagttctccctcctcagcctcctgagtgtctgggactacaggtgcacaccaccacgcctggctctgagatacgtttttatcagcagtagagcgatcagcagtggagcgagggtgaccatgggcactgctgattgggttgttggtgggtgacggccaccactaccccaagacacagggtttattgtccgtgccagtgcatggagaagctgccggaagcccagaggtgggcacagggcgaaccttgtggtctgacccctgaatctctgcttctcaccctggtgtgcagccacctagcagcctcttgtctgctgcacaggtggccctctctgttgtcacagctgtgcagtggccttccactggacccctgctatgggctggcagtgtttcccacgtgcctgtcacatgccgcgcagttccatggtgcatgttgtccatctttctgggccccagggagtggccgtgagggcagggcccaggcacctgtgctggaagggctgagttgctgcccttgcggcccttcctgtgctctcagcagcactggatgtcatcaagcgtttgaatttctgcctttctgataattggaaaatgcgttgttttgtttaactttgcattttctggatgacttacgrgggtcagtgtcttcatatgtttgtcagacattccttttgctccgtgactgacttgttcatgtgttttgcccattttgagraggttgtcgggacatttcactctccagtaaatgtggcccttggcgttactgagtcctaagaggtgtgtgttgccccaggtggagctgatggaggagggagtcggtgcctgtggtgtgggactgacyggctgcctcctgccagtgggcttgtggcctgtggggccatctggccatgagcacttctctctctgtctgccacgacaggggggacaggccccacctcggacacaggctggggctgcatgctgcggtgtggacagatgatctttgcccaagccctggtgtgccggcacctaggccgaggtgagtcacagccctggggagggcgcatggccacggtgttctcaggaagcaaaggggactgtggggtcagggctctttagagcagaccrcaggtaaaacagtaagtagaacttgggggtttcttgagtaatgagccacttgtttttcttgatttaaaaaactgactttaaagaatgctaataaatccgcatgggcaacatggcgagaccccgtctcacaaaaaatacaaaaattagccaggcgtggtggctcctgcctgtagtcccagctacttcggagactgatgtggagaattgctagaacccaggagatggaggctgcagtgagctgagatcgcaccactgcgctccagcctctgcaacagagttagaccctatctgaaaaaaaaaaaaaaaaaaaaagaagaagaagaatgctaataaatgttttaaattactgaaactgttttctgtacagatttgttttgataacttggcgtatatgtatttgaaatcctggagaacatgggtttttacttttaaaagattctgggctgggtgtggtggctcacgcctgtaatcccagcactttgggatgccgaggcgggtgggtcacgaggtcaggagatcaagaccatcctggccagcatggtgaaaccccatctctactaaaaayacaaaaattagctaggcttggtgrcatgtgcctgtagtcccagctactcgggaggctgaagcaggagaatcgcttgaacccgggaggtggaggttgcagtgagccgagatcacgccattgcactccatcctgggtgagagagcgagactctgtttaaaaaaaaaaaaaaaaaaaaagattctgaaaaaggtttggatgccatctgtatctttagtgtgaaagtgaaaacttgtttctcatatttatggtagagctgacctgtaattttttttccaatagattggaggtggacacaaaggaagagrcagccagacagctacttcagcgtcctcaacgcattcatcgacaggaaggacagttactactccattcaccagataggtgggaggctgcagaatgtgccaggccccacccgggctgtctggagagggtggagtggtcggtttcccctcagagcttttctggtgtcgtgggatgtggagcaggaggctgtaaacctgtaaacactgacctctgaccatctgtgcgctgctgtcacatcaccyccgtgtcatcccacatcacccccgtcccacccaggcccagaccctgggccttgcccttcctgctgtccatgcggcttgcagtgcctggtgctcggcacagtctggggaaattggcctcgccccatcagtgaatctgaatgctcagattgaagtggagtgagtaaagaagagttggcctttcttgcaagcaaggccggcttttgagcactgtgttttcacttatagaaggaagtggtcccttcatttcccctccttttctaagttcatagtgaaggacagtccctgagaccttgtttgccccctcatgcctcccccgatcttgttggggcatccttccgtctggaggctgggtcgggtgctgtccaggccttcctgtgacgtgtctcctggcaccaygtgccaccagaggtcagggctgggggcgggtgtgtgttgctaatgtgtatctgttccctgcagcgcaaatgggagttggcgaaggcaagtccataggccagtggtacgggcccaacactgtcgcccaggtcctgaagtatgtactgcgcttccactgctgagcatggggcagcagggatgttccctgggggttaaattctccttgagtcttcatggctacaggaaataaggggtctctaattatttacttcatggccctcagaaggtttctcagcgatgactgtgttgaggtcttgtgaataggaatttatgttttctaacaaaatgaacaccgtagtccacatcctggctggcacattggacccttgttctttgctgcatggatccacctgtaatggtggcttctgatggggtgggcagctgaagctagtctgcagccatctgtgcgggtgccgggcccttccacctctgcaggcttgttggaggctgccctccgcgggccttgccacctgcctttctcactctacccggagactccctgtagcctcgctcaccttcccatacacctcagcgtctgaaagtgtgctctgcacctgctccgcaccgcttcctttcgcacctcactcagccccattgcgtgcccgccccccagattcctctgagatgaccttccctgcagttccagaaacttgcctgtggtttcagcttcgtgtccactcttcactcctcttgacccatccagggtcatttggtctgattccatgtgtcctggcatcccagcatttttggggaggctctggccagatcccccaggacttgtcccctcagggtctcctccccactggtctgagggccagcgtctccccagcctgtcttcagccacggcccccttgaagcctctccttctgcatctgcctgttctgtatcccactcaaggccctcaggcatcccacgttccacattcctgaaatggccctgtctcccctcacccwcagcctgctcctcagcatggcagtcactgtctccacccagcttttctgtcaggttccctggggtcctgcacaagtccgtctctgccacatcccacgtcacccgcgtcccacgtcacccccgtcccacatccccagcctgctgctccctctgtctccagggcccgccctgtgtttggcgtggcacctgctcagtccctactgcatgcccttcagagtcctctgtccagcagctccccagcccccaccacacccttccactcacacttctcttgctgctgcctggagtggccccaccaagtcagcgcygtttctctggaagcaccaggccactcgccatgctcgctgtttctcctggtcccctgcctgctccccaccagcccccgcccctgttgctggatgatcctccccaacctgcaagtgctgtggcactcaggcacatggacggcttccagggctgatttgtccctggactccaagctcaggtccagctgcttattctgcatttccacctgggtatctgtgtgcatggtgacctgacagccagagcccgtgctggccccagcctgcttctcctacagtggtccttcaggtgctcaaaccaaaatctgggattgttctagacccctctttttgagacggagtctcgctctgtcgccaggctggagtgtagtggcatgatctctgctcagaatcccaagtgattctcctgcctcagcctcccgaagtgctgggattacaggcgtgagccaccgtgcctggccaggactcctctcttttttctttttttttgagacagtctagctcagtagcctgggctggagtgcrgtggtgcaatcttgggctcactgcttcctccrcctcctgggtcccggttcaagcagttctcctgcctcagcctccccagtacctggaattacaggcacccgccaccatgcccagctaattttttcaatttttagtagagatggggtttcaccatgttggccaggctggtcttgaactcctgacctcgtgatccacctgccttcgcctcccagagtgctgggattacaggcgtgagccaccgcgcctggccaggactcctctctttcttttttttttttttattttttttccgagacagagtctagctctgtagtccaggctggagtgcagtggtgcaatcttgggctcactgctacctccgcctcccgggtcccagttcaagcaattctcctgccttagcctcttcagtagctgggattataggcacatgccaccatgcccaactaatttttgtatttttagtggagacaaggtttcaccatgttagccaggctggtcttgaactcctgacctcgtgatccacctgcctcatcctcccaaagtgctgggattacaggcatgagccaccgctcctggccaattcctctttatttcagtgggcccattcaaaatatcaattcctctttctttcagtgggcccattcaaaatatgtccagactctgaccagtgttcatcctttcactccctgtgctggtcccagccccatcttcttctttcttgttgatcttccttctctctttgtcatcctagagtctctttagcaaataacagcagagccatctgcataaaacatattggccactgctctgccttgaaccgccctggctcttcactgctgactcaggcggggctctacccgacctccctggcatgacacsttgtgctcctgggacacaccagcctcagggcctttgcatgtgtggtgcctggcacttggaccctgttcccccgacacctgcctgggttgcgccccatgtctgcccaggtaccctttggcaccaaggtcttccctgtggctacgttagtagtgccactccccgttcctgcgttactgttctctgcagtgttgaccaccggcccacgtggctgctgcttccttgtttgccctccgccaggtcagctttgccagtgctgctgtgtcccttgtgtgtgggtgcgtcttcggcactgcatctgggctagaggtgggaggaggaaggtggtgtgggagtggggcggggaagcaggctgtcctcccatcttcagcactgcagctgggctggagatgggaggaggaaggtggtggggcaggggggcagtggggggcaggctgtcctcccagtgtcccccctgggcttgtgcattgggaggggctctgtgtggtcaccccagtcccctgctccacccccacccagctcccctccacaggtcttgcattctgtccccgggagcaccaggtctttgctgcctcagggccttttctattgttttaccttttgttgaggtcctctgaccccacctccgccagacctgagatgagatcagagtcgtgttagacttttggctgcagaatctgcccttccctcagaaggggaaatccaaggccatggttcctcctcactggcgtgcacagtcgtgcttcccactaagctgcagatttctctataaggactcagattccttggttgtcagctcagcgtgtttggtggaggggagagcagagcagagcgtgaaggtgctgggaggcctgcctcaaagttggcaaaacccacagcgtctcagagctgcgttcatgttctagttcctgcctctgtgccagtgagaccagaaaaccaggccactcaamagcctcttgcgtgtgctctctatgaatggaggctggggcaagggcaggacccctgggcctcaggcgagaagaagcagatttaccctcagctttcttcctgtctgtggcattggctgtgccccggattttaggagccttggcccttctcatccgagaagcacctctaacgcgaaccctccttcgcgcagctatagctgcaaagatgaaccgtctttgaattgtacaaaagcttatggtcattctcctactctctgtaggaagcttgctgtcttcgatacgtggagctccttggcggtccacattgcaatggacaacactgttgtgatggaggaaatcagtaagtggctcagagtttccatggacaagaaagttgaaatcacgggcaacatacacacttcctcgcctgagtccccacgggagcctcggcgagtgttgtcrgtcgccccatgccgtgcaggtgctccgtggggcctgtgcgccaagccagatgcacggtggcctcgctctcctatcccggcggtcataccaagagaggagagcccaggctgtctggaggccgcgacttggtatctcacgtcgtgttttgtgtcttggttacaaatcgtttatgaaggccctgctgtgcttaggcgccctcgtgtgggaattctggtgaagttattttgcgtgccttgatgtgcgacagagagatgtagcaaccatctctagctgcaccatctcgagcaaaggcacgtcgtgaaggcagagctcttttcagctttctggaagaaaggtctgctgcaaccctgaaggaacctgggcgtggcaayatttacatctaggaggaaaactgtggctcagttttaacaaatgggctcattgagtgagttccaaattcatgtttcaccttccatgatgtagccaagctgagaactcttaaaaatgcctcayygcctttttcactcagggccacctttttcccaaggaacttctcaaaactccctcaattccaattttattgaagttctacatgtaggctattgccttgaatccaattttccataagaaagagctcatttaggccgggcgcggtggctcatgcctgtaatcccagcaccttgggaggccraggtgggtggatcatgaggtcaggagttcaagaccagcctggccaacatggtgaaaccccgtctctactaaaaatacagaaactagctgggcatggtggcacgcgcctatagtcccagctactcgggaggctgaggcagaagaatcgcttgaacctgggaggcggaggttgcagtgagccttgatcacgccactgcactccagcctggccacagagcgagaatccgtcccccgccccccaaaaaaaagacctcattcagagccacagccgtaactgcgcacagattcacagtgggagtgggtcctgccctgtgactgtgggtgtgccaggtcaccacacaggtgtgtgctgggtcacagacacgccccttccctgcctctccattctgtttcttcrtcgtctggccatcctcgggggcattgtgacacagcggagggagtgaggcaggactttataagggagagtgaggctggcttctgcagcattgagagctttgccacagcaggctctccttccaggattctgttcctcagagacttgaacttgggatcataaccaaagggtgtttgtttcttccatctgcctttttcctccattctgtttcttgaaatttttataaaacattggaaacacaggaagagtacaaagaaagagaaaaattattgattttaccactcagaaataactcatatgagcattttgacattcttactctcagtatttctcctgtgcttttcaaaaacttacatagtttcctaagtattttctcctggccatgagtgacagcattgtaattattaactggctacacaatatactattataccttagttccctgttcactgccccatcctccctcccgtgtttggggaaatcacttaccccctcgttccgcacgcgtgctcaggatctcaccaagtcacacctcagtccctggcctcggattagggaggctgttgctgggtgcagtggccaggaaggcgcaagggtcagggcttcctagaacctccgtccctctgggtgcaggtagcactggtgggagtgttgggggcagcttgtctgtgtggactccagctccgtcccttcgggagtctcagggctgcccaaagcagtgctgctgaaacgtggcttgtcagagtgagagtggagtcaggtcctggaagagcttgaatctgcatttcccagcccctggggatggtggctcccgggaggatgtggaggctgcctggtctgactggcttcgtctcactgcgtcagctgcctgaaaggacactgttcctcacaggagcatgtggaaggtgcctgatgcccccatttaggaagaaaggcatccacatccagccagcaaaggcactggcattgatgcacaaggcttgggtttctgggttcctgagtgtggcgtggtgttgtgaggaggacatcggggtcgttctgaatgacccctaccaaaagccccaggagggagtagtggggggagggcaggaagcaggctgcttttttcagtcgtgctgctaagagtgcgcaagggaggacgtctgaggaagaagtccgcaaagccgaagctagagaaacagacgtgtccttggctaagcaaggacttttcttctagtttctcggaactgcttgtggaaggagcagttagataggagaagactgatgccattcagaaattccactaaagcttcttcctgcagcgaaagagctgcctgacggtgttcccactcagattttaggtgaagcctgtggggtaaggggagaccttactgcctacagtgtccccatccaccaacccatcccccccgcaactcatccttctgtccacccccagtcaaaggccagccaggacatccttagcatgctcttcttgtccttaacgttgatgggcttagacctttctaacgacagtagacagaatgtcactgaatgtagggaggaaatacagattggaaaacgtgtcagtctggcagtgaggacaaatgactccaatgaaagaaaagtaaataccagagcaagcacagtcagaaacagagtggggaggagaatcacaatagctgraactcaactctctgagaggcagtgcagccaaatagaggcagctgagagcagagtatgtggattagaacttttcgggagagttggccactgaaggagtaggagaaaattcccctgagttggtgagagttgagtctttagagctaaagacccccaaatttttttatcagaagtacttaaacatacatrttcctgataatatttccaaattgcagaagtaaagggaaacttctctaaacatccaaataatagtatcactactaagctgctttgaagaaaggcagtctcaactggcctgggcatctcatctttgtgccataccaaatgctactggaaaatgtttagaattctgagaaaagacctggcttcatgaggtgagagtaggtatgtgtactgtgtagttgtcattgatagagaaatataaattttaaatgtgttcaaaatataaagagaacacgagaaaatttcaggtggtggcaggaataggcaaaagcccgttgcaccctgttgacagcagggtgtttgtgacgtggtaggtcacacactcagtgctgggctctggaggcacagaagcaaccggcccagctacgcatcagcccttgagccgattcatgtgttcgatcatattcctgagacagtagggtctgtgcaggtaacaaagcaccagtcagcaggaaactcaccaccgggaagcctttctatcaaaacataacttcaaaatcagtaaagtgggccgggcatggtggctcaygcctataatcccaacttcaaaatcaataaagcgggccgggcgcggtggctcacgcctataatcccaacttcaaaaccaataaagtgggccgggcgcggtggctcacgcctataatcccaacttcaaaatcaataaagcgggccgggcatggtggctcacgcctataatcccaacttcaaaaccaataaagcgggccgggcgcggtggctcacgcctataatcccagcacttcgggaggccaaggtgggtagatcacatgaggtcaggagttaaagaccagcctggtcaacatygtaaaaccccatgtctactaaaaaaaaagttagctgggcatggtggcacgccctcgtaatcccagctgctcgggaagctgaggcacgagaattgcttgaacctgggaggcagaggctacagtgagctgagatcatgccactgcactccagcctgtgtgacacagtaagactgtgtctcaaaaaaccaaaacaacaaaaaataataaaaatatatagaaaacagaataattaacagattagctatggaaagatcaaagctacaggggacccagataacacaacaggcagagtttagtagatacgtgtcaaaccctagattgtgacagcagagtgtgcctgggaatttctatgaaactaatgcggaataaaatgaaaaaaggacaaaaccctgctgcctggaaatgtgaaacctcaaaaaagtcaagtgtagagaccstaactatgtatctgaacctgatgtgtacagaactcagaagaaaacctgtgtatcttcagtactagtatatgggttctttacaaagtgaaaattaatgaaataagcatacaactcaagaattcggaaaaagcaaaattaactgaagaaaccaaagaataatattaaagacaaatacagaaattaatgatttaaaggaagaaatgtattaggccaggtgtagtggctcatgtttgtaatcccagcactttgtgaggctgaggcaggaggattgcttaaagccaggaattcaagaccagcctgggcaacatagccagacgtctattttttttttttttttggaacagttctgctctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctggacctcattctataaaatattttaaaaataaattttaaaattaaatttattagaactaacacatactagaactggctctttgaagcaataacatatatgttttaaaaaaatcaaagttaaaatccctcccttggctaagcrctgtggctcccgcctgtaatcctagcactttgggaggtggaggcaggcagattgcttgagtccaggagtttgagaccagccgcctaggtaacatggtaaaacctcatctctacaaaaaaacaaaacaaaaaaactagccggacatgggggcatgtacctgtagtcccacctactcgggagtctgaggtgggaggatcccatgagcctgggaggttgaggctgcagtgagacatgattgcaccacttcactccagcctgggtgacacagtaagaccctgtctcaaaaaccaaacagaaacccaaacaactcccttaaggctgggcgtggtagctcctacccataatcgcacctctcagggaggctgagttggaggattgcttgagaccaacctggacaactccctctctataagaaatagaaaaatgaggccaggcacatggctcatgtctgtaatctcagcacttcgggaggctgaggtgagcagatcacttgaggtcaggagttcgagaccagcccggccaatgtggcaaaaccccgtctctactaaaaatacaaaaattagctgggcgtggtgacacacacctgtaatcccagctactggggaggctgaggcaggagaattgcttgagcccagaaggcggaggttgcagtgaaccgagattatgccactgcactccagcctggacaacagagaatcggcttcaaaaaagaaaagtcagggggcacagtggcccacacctgttgttccagctactcgggaggctgaggcgggaggattgcttaagtgcaggtgtttgaggctgcagtgagctgtggttgcaccactgcactgcagcctgggtgacagagtgagaccccgtctctaaaagaaatttaaaaagttctgtctcagaatccttgttttccagctgtctgttttgagaaatttgagtcctacaaaaaagttcagtgagtcatggccacaaaccctccacctagatccaccaattgtgttttgacacgcttggtttttatgagcaagcctcctacgaatgagagtgttcctgagagccacacagcctcatcaccacaaaagaggtgacgccacgactcaccagggtccgtcttggccccttgctgtccagggaacaacccrtgccgctgatttgtgttcctggttgagggtccggtgctgtgtgtatatagttgtgatgtctttctagtctttaattgagaaggttctgcctctttgttgtggttgttgctgctttgtggcatttttgacgagttcaggtcagctgaccatcccacacgctggatttgtctgcttcctcacagttgggcttgggttgagcctgtggctgagagtagcctctgggtggcagtgtcctctgctctcccatccggggcctgcagtgggacactatgtcagatccccrgagatggtgtcttttttcctttgtaattaatgaataatccagtggtgacactgagcatgtcctggtgagctgtgtgactcctgcctgataatggtggtttttctagcctgtcctttcctttcacgtttattggttggcgttctgagaagagccgccttttctcccatcacttagtgtgcagtgtgctacctgtcacctgtctgtcacctgtcagtcactgtcacctgtcactgtcactgtcacctgtcactgtccatctttttgatgcttgacggttccacctttggccggtggccacctcagtctggtggtgtcttttgccgtgttctggcrtttttcgtttatgttwtgagccctcccttatgttctgggttaagcagatgctgcaggcacctctgaacattccctgcctggccctggaatcagcctggctcctctgagtggggagtggtgttgagaaacctcgatctagacgccgggcatgctccatgctcccggagtgtcttctcccatcaccgcaccctccggttgatgtgtcctccggaccattgactcaygggtgtgtgtaggcagaaggggtggaagcgaggaaaggcgttgctgaggaggcccggagggagcgggttctggctgtgctggcactagccaggctggcaggctgcgtgggtacttctgtgattttcctctcaagtgcacgtggctttttcttgcactgtttcgtgtgtgtgctttatttcacaataaaactcttgaattaagtatgcatagaaactatttcttttttctctgggtggcaagattatgaaaaaattttcttacgcttttctatattttccaagtttgaatttcactgtaagcacctggctttgtacygccctttttctgttacacrgtcatcatttgcttgcttgttgtgggagcacttttgcacaggtctgcttggttastgaaagcatgtctccctttctaggaaggttgtgcaggaccagcrttccctgtgcaggcgccactgcgtttcctgcagattccgaccggcactgcaayggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcttgccctgagtccccgtccccttctcccagttcttagtcactttcagcgcatcgtcgtcacgtggccatttgtgcagccggctctcgggggaggggtaaacaaccctggtttacaccgttgcccaaggggtgagtgggcgtgaggcacgtccatcagtaggcacgtgctgctttcgttctgcaagtgtcaaggcgagtgtcgaggatgaaagcatgaggcgcttgcagggggtcctyggaaccaggtgccactcctcggcctgacggggagccccgccccctcccgggtctccactgtgccccaggcatgcccaccccactcccccacagccctcttggcctgaggtcccttcggagggtgggttggcctgtgaggaagggacgtgtgggcagggcctggggatgggcagggctgtgtgaggagctccagccacaggctcccccatgtcatgaaagcaaaagggggcggggagcggtggctcatgactgtaatcccagcactttgggagggcaaagcgggcagatcacgaggtcaggagtctgagaccagcctggccaacatggtgaaaccccgtctctactaaaaatataaaaattagccgggcatggtggtgcgcgcctgtagtcccagctacacaggaggctgaggcaggagaatctcttgaacccaggaggcggagcttgcagtgacccgagatcatgccattgcactccatcctgggtgacagagtgagactccatctcaaatwaaaaaaaaaaaaaagcaagcagaagggaaaaccatcctttcttcaggtaactcaaattttagaccaaggagtcacatttgtatggaactgaaatgtggcttcctgttaaaattattcagttgtctgaacttggcccctccgtccagccttctgcccatcctgtggggtctcagctgcccccacacataggccccgtctccatcgcttctgccctgtcaggtcaaagcactcagcagggccacctcccgcacccctgctcacatctcctgccaggccccctcactcccggcctccccaaagcccacctctgacatgaagcttccctgagctgagcctgcagattgggtttcttgtgcctgtgggatgtcctgtggtctttcctggacagtaagctctttggtaccatgtcccctcctgtcccctcttgygtcacccagttgggcctcagcaggcccttggkycccctatggcagtgggtggggggaccgtctgctcccacctgggacctgtgctcagtcccccgcccctccacagcactgcttcatgatgccccagtccctgggcgtcatcggagggaagcccaacagcgcccactacttcatcggctacgttggtgagtccagggttcccaccgtgtccctgtgggcctgggccttttaagggcattccatgagcaggtaccacaccccaggtgaccacttgaggccactggtggaaaagcagcatgccctggggttcattttcagcctggtcgmgggcggcctcctgtgtgcccctttccctsatggtctggtgccctcggctccctccccacctcctgcccactgcttctcagtgtgatgtgggtgcagtgggtctgaaatgcggcctcctctgtccctttcctctgccggctcggccrcccacctgcccacctgcctcatcctcccaggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacgtggcggccacctgagcacacaggcatttggtgctgaatgctgtttgggaatgacgaggaaaactttcggatttttgcgttttttttttcagcatgttgsgataagtactgtgttcacgtggttgggaatctgaagggtataagagccggaactgtgtccttgcaccctcacgtccctcccccaggcaccacctcctgtgcagccttcatggccttcgagtggcccagagagcgtgtgtctggatgtgagcgtgtgtgggcgcgtgctgagtgtgcatggatgagtgtgagccatggtgagtgtgtccccctcacacctacatttaaacacaygggcggcccctccacccacccctgcaccaccttcgtcacacccacatttaaacacgggcggcccctccacccacccactcctgcaccaccttttgttttccggaggctctgacttgacctctctgggggatttcctaagaaggagcttccctgtttttccattttgattacctagttgtgatttttggtgtgtgatttatgcagacctgcctgccctcaaatatatttgatggggaaagaggccaaaaaacccccctagaaatcatgaatgacggtgacatgctcagggaagcagttaaccgaatcgggggctctgttgtggatgctccgccccatttaggaggaagaaggcagatctgggcctgaaatgggacggtctctgagctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcrcgatctcggctcactgcaagctccgcctcccaggttcacgccattctcctgcytcagcctctggattagctgggactacaggcacccgccaccacgcctggctaattttctgtatttttaatagagacgggttttcactgtgttagccaggatggtcttgatctcctgacctcatgatccacccacctcggcctcccaaagtgctgggattacaggcgtgagccactgcgcgcagcctggcgcacacttcttaccagaacctagtcacgaattcctcgtckaactagaattaggtatgtttgttactgtaaacgcagcttggtggcttacagtgattgrcactctaacagtcaggtcaggctagagagccagccaccgcagacagaggagtggacgcgtgaacgttgagttgagaccaaaggggccacctggtgggataactgtcctcacccgtgaggaggaggaatgtcccctgtccccgggggagagtgctcctacaccagcgccgaggcggcagaatggtgtcttcaggggaagagagtgcccagtttgagcttctccccccatttcgtttctttttgtgttaacatctgcgcatctggcagcgttgagaattcctagtgactgtcattacaggcggcagctttaaggatgtgattgccggtgacccttggccggtcccctgtctcctggctcctcagcaggaggctccctgtgtcacggtgtccttgggcagttctcggtggcctttgccgccaagcttccagggagctgctgggcgaaggctgagacccagcggccctgcctcacagtcacagagagaagagctccccacttggccctaactcataacctgccccaatcccggaacactcggtgaggtttgagagatgcacaccacgtaacatctcgtgggcgaatcaaggcacagcaacgcagtggagcctgaggggagccgggcactggtgcaggggaccatgcacagggcaccctcggagctccrttccyggccacaggagccaaggcaggctggaatgtccagcacctgcatgctgggggcctctgctgcgccactggcagtgggaatggaagcccccacctcttagccgactgcagatgggggtgtcgtgttctgctcatcgtcatttcgttttaggggtttttctgtaagactgaagatgacttcartgattggtgccagcaagtcaaaaaggtttgtagccgccccacacccacagccgagctgagccacccagggagacaggcagyggggcgtgcaggggtcgaaggcctgcgtccaggtctcaggcagcctcactgggccgtggggagctttgtcccgcctggcacagctatgtagctgagcagggtggggcgtcctggattgcccatctggcaacacagttaacaaccctggggayggatgttgcgtgttgactttagaatgggatttccagtgtcctcatccgtctcctgttgagatgggggtggtgatggggtgctgagctacgccggcckagtgcgtgtggcccacccccctctgccgtggtggtcagactgtgctgtgtgttgatcaccacactgggttctcgtgtagcctttagtgtggagctgcctctgttttctcatcagtgagatgggatgacaggtttgtccgctggctgtggccggctggcccctttctcttggccgcagcaagcactggggtgaggctgcacctaacggccatgtctcactaacagctrtctctgctyggaggtgccctgcccatgtttgagctggtggagcwgcagccttcacatctggcctgccccgacgtcctgaacctgtccctaggtgagagctgccaagtccaggtggggtccctcggaggtacgatctgtgcccttgcttcyccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgccsgggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatcyctgtctccctgtggraaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttractcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagygttctctcgacactgccagccccgtgttagcacctgggcctcagtcccacttgctcccaggcgccggttctgtggttggtttggaattaaagtcctgtttgaagttgtcagacacagacatgaatttctkgggcgctccctgagtcagagtctcagaagacctgtgcaggctggcgtgagaggagcggcagccacacygcggccccacgcccaaggaytgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggkcggcctgggcagaagggcggctggctgtcctggagctgctgctggagcctgccctcagagtgtccctttccagtgctgtggcattctgtggcagcttccccaggtgtggtgacggggggggcggggcctccacctgtgacagycaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccrctgctctgctgcctgtcctgggaaagtakctttgccccactaggaaatgtaaacaggagggcttggggagcgtgggcacttttctcatgagcagctactgcggcrttggcaggactcgctgctgctgctgctgcttgtgtaggtcggggagcyrgagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccrcgtccgagttcatggtgcgccgctgtgctgggagctgcagtggkaatgtgtgggacmccttgaccaaaggggagctttgtctcgtgtgttttgaaaaaggcttaatgaagagaatgttgttcattcttagtagtatagtttgcaattcttaatggcaaataataagtttcagtagaaaacaaaccttgtgtctattttttccttaagttctaattgaatgtgagttccagaaaaaaaataagtgaatgtttcagcccgttcacacgtaaaggatgtggctgcctgcgtggcgggctgtggggccctgagcaggtgtgtccccagccctggcagggggcctgtcctgcctgcagcctggctctctaccagccgtggcatcagccacctcatacaaccctagaaggaaaaagtgcaaggaaaataggattttaggaaagtaaaatggcggttcccatcttcagcaggaggaagtcacaggaagtgcctggagttgcagggtttgcctcgatttgaatcatagcaaagccttccccaagtgcgcagtgactgtcctggcctgtgggaggccatgcctggggcacagcagggggcttggtgaggacattgctcactctggccagtgcatccctgtgggcagccctggtataggtgtgaagggcccaaagccagaccggagggggccctgctgggtccccggtgaggtggctgaggacttgtggcctctccgatgctcgtattcgcttcttgtggctgctctaaaagatgatcacattcagtgcctggaacagcacagcctcttccagacccggagggcagacagccatgtcgtgctgtgggctctaggggagaacgttgctgtgcctttctagcttctggatgccagaaactgcttggctcatggctctttcctccaaccacacagccagcaacatggcatctctccagcttttgctgttggcatctcatttcctgactcggaccgcctgcctccctgttatgcggacccgtgatgggccaggcatggtggcgccagcctgtaatcccagcactttgggaggctaaggtggatcacttgagcccaggaaagagaggctgcagtgagtcaagattgcaccactgcactccagcctggatgacagagtgagacccagtcttaagacaacaaaaaaaggcccctgtgatgacactgggcccacctggatagtccaggaaagtctcatctgaaggttcctcacccaggcccatcccacagcccctggcaatgcttacccaagagtgaaatcctyttgttttgcctgggtttgtctcttggccacagaagggtgctgagacccacagctgctgcccccacagatgggggaccctgcctgccttctactccagcacactgtatgctgctgtctatgcggagtgtgctctgtgggacagattctgccaggagtgtcaaatcattccttctaagtgtcacttaaaaggggatgcaatgggctcggcatggtggctcatgcctgtactcccagcactttggggaggccaaggcaggtagatcacttgagcccaggagtttaagacaagcctggctggcaacatagcgaaatcctgtctccacaaaaaaattasccaggcacagtgaaggcctgtaggcctagctactcaggaggctgaagtaggaggatcacctgagcccaggaggtcaaggctgcagtgagccacgatcgtgccactgcactccagcctgggcgacagtgagaccctgtttccaaaaaaataaaaaataaaggataggatgagaagttaagctccagggttgcaatgaaaatagcagagttaacttaggtgagttcaggacgtaagctgtgatgacactcggatatagcctggctggacccagcgagcccagggcatggctgcaactgttcagacccacagtgggactccctcaactaggcaggaaccagggtccaggaaggccctactgggcccaatgaaggctcttctctcctgggatggaggttcccattcaaagccagctccgtcctcagtctaagaaaagtgaagcgttccacaaacaattttcaggtctttttttactagtgtctggaagacatttaggagaattccaactgattaccatttacagtgatcacaatgaaactgctcagagttatcactgaacttcagtaagaaaatacaacagagtgccatcaggacaggggagagggcaggagactgctccatcgctctgctcatgtccacactgccaaggtccccaccacgggggtccccagtgcaccccagctccggggcagaagaggcagcctgcagatctctgctgccgggaaagagctcctgaagttgtggggtctggactccgctggggacggggccttccgcgagtctcccacctctcgggggactgcagggagaggcgtctccagtgggcagccttgggtcacttccatagctcccccagcggcttctctgtggcagtgcggatggcgtcctcagagagcacgcggatgtcctcatggacagcttcgatgcttttggaagcatccaccatctgttcccaccggggtttcaggagaaaaagaggctcatcagcacgttccaggctrgtcacgggagcccacgcctgtaatcccagcactttgggaggcccacgagggaggactgcttgtacccaggagttcaagaccagcctgggctacacagggacaccccgtctctacaaaaaatgtggcaccactctactccagcctgggtgacacagtaacaccctgtttcaaaacaacaccatgtttcgttctgtcctctgtgctcgtggggatttcacacaggccgggctctggaaggccaacctgaacctcctggcacactgtggtgacctccgggataccccacacctttctctgaacctcaaccttgacaagtgtctacggtagtcacccggcattcctgccacagccctgatgcaggagaaacatgatgtgccaactgcccactcctgctttaagccgacctcagcctcgtgaccccaaccccgctgagtgcccacttgcaggagtgaggcacagcccacagcacagccaggcccacccagcccaccaggtcgaggtgactgtccctccagctcgcaagcggcgagtcggaagcacagagggcagaccctgccctgcccacgctcctgtggctcctgggccctgcctggaaggtgaggaagttccgcagcagaagccagacagcaggaccagtgcaacactgggcctgactcgtccttgcggggaagatgaatttggtcctaacagctgtgctgcacaatggcgtgaacggtgcgaggagcgtggggagggcataagcccgcaggacagccttctctccaccagaaggcaggcagtgagagggactcagaagcgctggcatctcagcggcatcccggcttctgctgtcgggtggcaccggacccttctcaagcttctgggacagcaaattctagaaaatctgccaggggcgtagaaggcacttggaagaatctaaccatttcatgaggtgtgaccgtgacggaaggagagtgactccctacacaagggccaccttcccagatgcctctcactggccactgtgcagccacacagctgtcgcccagaaccgcccaagatgagcctctccgggcggaatgactgccagagagaatgccgcactgccagaaaagggcactgctatcccacctgcgttccgggaaacgaaaagctgcgtgaccagcatcatctgcaggcacagccagtcgggctggggcgagaccctcggccctgctctggaggaggagctcaagggactgaagctcygcgggccgtggccacaagcgacagtgctggcgcccgacgtgccagaagccctggctgccgcctggaaagaggccacgtgggcagcggtgggcacgggcgactggagtctgggagagaggtaggggctgcggtcgggaggagcagaggcggccagcctgcgagtccactgggaggggagagtccagcgtcctgggagcagagccagacctgggactgctgagactgaaggaggcaggactgaagggagaggcagcacacagcaccctcctgaacttagatggccaggtgctgctgcagggcccatgcccagcgagaggccgcaccagaggacacagtggcaggaacaggctggcgctcgtgtctgaagaggggctgaggatgtggaggattgcgcagactctcacctgacccaccagacaaagcgccaaatgtcaacatttagcaaaactcatcgggttagaatttgctggcactggccgggcgcgatggctcatgcctataatcccagcactttgggaggccgaggtgggcagatcacctgaggtcaggagttggagaccagcctgaccaacgtggagaaaccccatctctacaaaaaaaattagccaggcatgatggcacgtgcctgtaatcccagctactcgggaggctgaggcaggagaatcacttgaacccaagaagcggaggttgcagtgagctgagatcgtgccattgcactccagcctgggttggcacccagagcaagattctgtctcaaaaaaaaaagaatttgctggcaccgagaacccctgaacgactactcccggggctccacatctgggaggaccagacggaaacggcagcagctttgctgacacgactgtgccagccaccacggtgtcatcctgagccacttctccacgcttcctagtgtgcaattctgggattctcaccttccagttcaaagtcgtgtctttcatgagctggtggaaacaccggagcgcccgctcctggaaagccccgttctcatagcgctcatggccaaacgctccccgcttggcakcatccgccagctgtaactggaggaacaggaccaggtcrggtttgggaaggcccacgtctggctgtttacaccartctagggaaaaattctgccaagaaagaacccaacagttaaagcttagtgtagtctaggtttttgtttcgaaagtcgtaaaaacaggaaaaaatgaggggacatttggtgaggtaccaagatgtgagactgtttatattgtggctcgtttaatttttagaacctcaaaygtgtcsgtttctccagtgtcacctttgtttttcctttgtaaacagacaagtggacagaaaagtaggtagatagaacggctgccagtccccgccacccacagcccaggccccatggaggccctcccagcgcagctacaggcctgctggccaggagcaaacagtctatgtacagaacccctggagacccccggcctagaacgcctgcagcacagagcagctgggtccggacacaggcacgaggtccttggcagtgtcttttctgccacacacacgccagggtctcctctcccgtggaagagcaggaagaagacaggcactcctagagcctgttatgtgccagcctagtctcatccactggcccttcttgccagggctgtgccagcaccctctctccctcccttactcatcccatctccctccaaatgctgtcctgtttccggaggaaaggtaggaccagaaaggctgtgactgcaggccacacatcacacaacagcacaatgagctgagggaaggcgtccacgagaacctcccacagagcctgcggctctgtcagctgatccgcacagcaggaagaagcaaaggaatcatgagtcttgtcctccttattatacaacgtaatacttcagaggggaaggactcaagctaacacatgaagaaatggcagaattaaaaagtgagggcgtggccgggcacggtggctcgcgcctgtaatcccagcactttgggaggctgaagcgggaggatcacttgggcccaagagttgttatagcgagctttgcttgttccactgtactccagcctgggcaacagagggagacgccctctttcaaaaaacgggggaaaaaagtactacaaatgaaccatctttgaaaatgcatctggaggctgggtgcagtggctcatgcctgtaatcctagcactttgggaggctgagatgagtggatcacttgaggtcaggagtttgagaccagcctggccaacatggtaaaaccccgtctctactaaaagtatgaaaattagctgggcacggtggtgcatgcctataat
